United States Patent 10,428,344 (NUCLEOTIDE SEQUENCES AND CORRESPONDING POLYPEPTIDES CONFERRING MODIFIED PHENOTYPE CHARACTERISTICS IN PLANTS) - sequence listing, part 2

SEQ ID NO: 2524 - protein, 142 aa, Zea mays
  misc_feature (1)..(142): useful for making plants with increased heat tolerance as described in USSN 12/515,707
  misc_feature (1)..(142): Ceres CLONE ID no. 1377080
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 375.3 for HMM of FIGURE 2 of USSN 12/515,707.
MAGVGPMTQDWEPVVIRKRAPNSAAKRDEKTVNAARRSGADIESVRKYNAGTNKAASSGTSLNTKRLDDDTENLAHERVPTELKKAIMQARTDKKLTQSQLAQIINEKPQVIQEYESGKAIPNQQILSKLERALGAKLRGKK

SEQ ID NO: 2525 - protein, 142 aa, Glycine max
  misc_feature (1)..(142): useful for making plants with increased heat tolerance as described in USSN 12/515,707
  misc_feature (1)..(142): Ceres CLONE ID no. 1057375
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 373.7 for HMM of FIGURE 2 of USSN 12/515,707.
MAGTGPMTQDWEPVVIRKRAPNSAAKRDEKTVNAARRAGADIETVRKYNAGTNKAASSSTSLNTKTLDDDTENLTHERVPTELKKAIMQARTEKKLTQSQLAQLINEKPQVIQEYESGKAIPNQQILSKLERALGAKLRGKK

SEQ ID NO: 2526 - protein, 142 aa, Triticum aestivum
  misc_feature (1)..(142): useful for making plants with increased heat tolerance as described in USSN 12/515,707
  misc_feature (1)..(142): Ceres CLONE ID no. 897172
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 377.2 for HMM of FIGURE 2 of USSN 12/515,707.
MSGVGPLSQDWEPVVLRKKAPTAAAKKDEKAVNAARRSGAEIETLKKYNAGTNKAASSSTSLNTKRLDDDTESLAHEKVPTELKKAIMQARMDKKLTQSQLAQLINEKPQVIQEYESGKAIPNQQIIGKLERALGAKLRGKK

SEQ ID NO: 2527 - DNA, 821 bp, Panicum virgatum
  misc_feature (1)..(821): useful for making plants with increased heat tolerance as described in USSN 12/515,707
  misc_feature (1)..(821): Ceres CLONE ID no. 1775129
gtgagcttagcgagtcttgggactccagaaggttcccacctccgcctccatatcttcttcttggtcctccgcctccaccacttcgcgtgctcttacgtttccgtgttgagagagagacagagagagaggacacgcgagaggctgccgtgtgggggccggagagtcaacgacagcgagggggagagaaggcgatggcggggatcgggccgatcaggcaggactgggagccggtggtggtgcggaagaaggcgcccaccgccgccgccaagaaggatgagaaggccgtcaacgccgcgcgccgctccggcgccgagatcgagaccatgaagaagtacaacgctgggacgaacaaggccgcgtccagcggcacatcgctcaacaccaagcgactcgatgacgacactgagaatctagcccatgagcgtgtcccaagtgacctgaagaaaaacctcatgcaagcaaggctggataagaagatgacccaggcacagcttgctcagatgatcaatgagaagccacaggtgatccaggagtatgagtcgggcaaggcgatccctaaccagcagattattagcaagcttgagagggcactgggaacaaagctgcgcgggaagaaataactttaaaacttgtgccccggagcagcatgaagctgaagaagacaaggcagtctgtctgcttgttatctaatgcttggtttttaatgtcatgcagattgtttctgtgtttggtacatgagtgaataacagtgtcgtggtggaccttgtaatgccttgctgcttttatgtgtcatatgacccctggtacgtaagagttgcgcg

SEQ ID NO: 2528 - protein, 142 aa, Panicum virgatum
  misc_feature (1)..(142): useful for making plants with increased heat tolerance as described in USSN 12/515,707
  misc_feature (1)..(142): Ceres CLONE ID no. 1775129
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 371.4 for HMM of FIGURE 2 of USSN 12/515,707.
MAGIGPIRQDWEPVVVRKKAPTAAAKKDEKAVNAARRSGAEIETMKKYNAGTNKAASSGTSLNTKRLDDDTENLAHERVPSDLKKNLMQARLDKKMTQAQLAQMINEKPQVIQEYESGKAIPNQQIISKLERALGTKLRGKK

SEQ ID NO: 2529 - protein, 139 aa, Solanum tuberosum
  misc_feature (1)..(139): useful for making plants with increased heat tolerance as described in USSN 12/515,707
  misc_feature (1)..(139): Public GI no. 8895787
  misc_feature (1)..(139): Functional Homolog of  Ceres CLONE ID no. 41712
  misc_feature (6)..(76): Pfam Name: MBF1 Pfam Description: Multiprotein bridging factor 1
  misc_feature (84)..(138): Pfam Name: HTH_3 Pfam Description: Helix-turn-helix
  misc_feature (1)..(139): Score of 362.1 for HMM of FIGURE 2 of USSN 12/515,707.
MSGISQDWEPVVIRKKAPTSAARKDEKAVNAARRSGAEIETVKKSNAGSNRAASSSTSLNTRKLDEDTENLSHEKVPTELKKAIMQARQDKKLTQSQLAQLINEKPQIIQEYESGKAIPNQQIISKLERALGAKLRGKK

SEQ ID NO: 2530 - DNA, 826 bp, Gossypium hirsutum
  misc_feature (1)..(826): useful for making plants with increased heat tolerance as described in USSN 12/515,707
  misc_feature (97)..(525): Ceres CLONE ID no. 1836022
  misc_feature (97)..(525): Encodes the peptide sequence given in  SEQ ID NO: 90
gcatttctgaccaaggaagaaaaattctcttcctttttttattccttcctttttcctttcatccaatcgaccaaattcagagcttacaaaagaaaaatggccggaatcggacctttaacgcaagactgggagcccgtcgttattcggaaaaaacccccaaacgccgccaccaagaaggatgagaaagtcgttaacgccgcccgtcgagccggtgccgagatcgaatccgtcaagaaatcgaatgctggggcgaacaaggcagcatcgagtagcactactttgaatacaaggaaacttgatgaggaaactgaaaatcttgctcatgaaagagtgccaactgaactgaagaaagccatcatgcatgctcgaatggagaagaaactcacccagtctcaacttgctcagatgatcaatgaaaagccccagattatacaagagtacgaatccggaaaagctattcctaaccaacagattataggtaaactcgagagggcactcggtgcaaagctgcgagggaagaagtgaggagggtcttatcgttaatcaaacagaagttgaatatggggtccagttcttgagtcctaaaaaatggtgatgtaaataaatgcactctacagttactatggctcgcatgtaataacagcgtcttcgatgttatctgaagactatgactatgactgatgaaatgaagtgtgttcttgactgttgcaagggattctctgtgctatttatattttgcttttgtgaatttagagtaagacacactcctttgatgaacagatgatggtttctacaattagaaacaccaataaatttgttttggcgt

SEQ ID NO: 2531 - protein, 142 aa, Gossypium hirsutum
  misc_feature (1)..(142): useful for making plants with increased heat tolerance as described in USSN 12/515,707
  misc_feature (1)..(142): Ceres CLONE ID no. 1836022
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 369.6 for HMM of FIGURE 2 of USSN 12/515,707.
MAGIGPLTQDWEPVVIRKKPPNAATKKDEKVVNAARRAGAEIESVKKSNAGANKAASSSTTLNTRKLDEETENLAHERVPTELKKAIMHARMEKKLTQSQLAQMINEKPQIIQEYESGKAIPNQQIIGKLERALGAKLRGKK

SEQ ID NO: 2532 - protein, 140 aa, Nicotiana tabacum
  misc_feature (1)..(140): useful for making plants with increased heat tolerance as described in USSN 12/515,707
  misc_feature (1)..(140): Public GI no. 20086364
  misc_feature (1)..(140): Functional Homolog of  Ceres CLONE ID no. 41712
  misc_feature (7)..(77): Pfam Name: MBF1 Pfam Description: Multiprotein bridging factor 1
  misc_feature (85)..(139): Pfam Name: HTH_3 Pfam Description: Helix-turn-helix
  misc_feature (1)..(140): Score of 359.2 for HMM of FIGURE 2 of USSN 12/515,707.
MSGGIAQDWEPVVIRKKAPTAAARKDEKAVNAARRSGAEIETIRKSAAGTNKAASSSTTLNTRKLDEDTENLAHQKVPTELKKAIMQARQDKKLTQAQLAQLINEKPQIIQEYESGKAIPNQQIISKLERALGAKLRGKK

SEQ ID NO: 2533 - DNA, 429 bp, Populus balsamifera subsp. trichocarpa
  misc_feature (1)..(429): useful for making plants with increased heat tolerance as described in USSN 12/515,707
  misc_feature (1)..(429): Ceres ANNOT ID no. 1482906
  misc_feature (1)..(429): Encodes the peptide sequence given in  SEQ ID NO: 92
atgtcaggaggtggaccaatctcacaggactgggaacccgtagtgatccgcaagaaagctcccaacgccgccgccaagaaggatgagaaggccgtcaacgccgcccgccgctccggtgccgagatcgaaaccatcaaaaaatcaactgctggtacgaacaaggctgcttctagcagcacttctttgaacacaaggaagctcgatgaagaaacagagaaccttgctcatgaccgagtgccaactgaactgaagaaagcaattatgcagggtagaacggacaagaaacttacccaggctcaacttgcacagttgatcaacgagaagccccagataattcaggagtatgaatccggaaaagccattcctaatcagcagattataggcaaactggagagggctcttggtgtgaagctgcggggaaagaagtga

SEQ ID NO: 2534 - protein, 142 aa, Populus balsamifera subsp. trichocarpa
  misc_feature (1)..(142): useful for making plants with increased heat tolerance as described in USSN 12/515,707
  misc_feature (1)..(142): Ceres ANNOT ID no. 1482906
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 373.0 for HMM of FIGURE 2 of USSN 12/515,707.
MSGGGPISQDWEPVVIRKKAPNAAAKKDEKAVNAARRSGAEIETIKKSTAGTNKAASSSTSLNTRKLDEETENLAHDRVPTELKKAIMQGRTDKKLTQAQLAQLINEKPQIIQEYESGKAIPNQQIIGKLERALGVKLRGKK

SEQ ID NO: 2535 - protein, 142 aa, Oryza sativa subsp. japonica
  misc_feature (1)..(142): useful for making plants with increased heat tolerance as described in USSN 12/515,707
  misc_feature (1)..(142): Public GI no. 50944921
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 366.5 for HMM of FIGURE 2 of USSN 12/515,707.
MAGIGPIRQDWEPVVVRKKAPTAAAKKDEKAVNAARRSGAEIETMKKYNAGTNKAASSGTSLNTKRLDDDTESLAHERVSSDLKKNLMQARLDKKMTQAQLAQMINEKPQVIQEYESGKAIPNQQIIGKLERALGTKLRGKK

SEQ ID NO: 2536 - protein, 142 aa, Ricinus communis
  misc_feature (1)..(142): useful for making plants with increased heat tolerance as described in USSN 12/515,707
  misc_feature (1)..(142): Public GI no. 1632831
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 376.0 for HMM of FIGURE 2 of USSN 12/515,707.
MAGVGPISQDWEPVVIRKKAPTAAAKKDEKVVNAARRAGAEIETLKKSNAGTNKAASSSTSLNTRKLDEETENLTHDRVPTELKKAIMQARMEKKFTQAQLAQMINEKPQIIQEYESGKAIPNQQIIGKLERALGVKLRGKK

SEQ ID NO: 2537 - protein, 139 aa, Parthenium argentatum
  misc_feature (1)..(139): useful for making plants with increased heat tolerance as described in USSN 12/515,707
  misc_feature (1)..(139): Ceres CLONE ID no. 1609842
  misc_feature (1)..(139): Functional Homolog of  Ceres CLONE ID no. 41712
  misc_feature (6)..(76): Pfam Name: MBF1 Pfam Description: Multiprotein bridging factor 1
  misc_feature (84)..(138): Pfam Name: HTH_3 Pfam Description: Helix-turn-helix
  misc_feature (1)..(139): Score of 351.0 for HMM of FIGURE 2 of USSN 12/515,707.
MSGFAQDWEPVVIRKKAPTSAARKDEKAVNAARRAGAEIETVKKAAAGSNKAASSSTSLNTRKLDEETENLSHDKVPTELKKAIIQGRTEKKLTQAQLAQLINEKPQIIQEYESGKAIPNQQIITKLERALGVKLRGKK

SEQ ID NO: 2538 - DNA, 900 bp, Arabidopsis thaliana
  misc_feature (1)..(900): useful for making plants with increased heat tolerance as described in USSN 12/515,707
  misc_feature (1)..(900): Ceres ANNOT ID no. 864102
  misc_feature (116)..(718): Encodes the peptide sequence given in  SEQ ID NO: 98
atagcgaaatctctaattacttaatctctgaatgcttaagataataactataatctaagagtaattaattaaacgataagtggttaaatttgttgaggttaaaagtgaagcttcaatggcaagaggtcgaaagctgacgatgagccagagcgagaggtacctaggaagcagctatagttacggtgacagtaacggaaactccgccaccgacgaatcagagctcacggaggaggacatctggtcacacgccgtcgatcacagcccggagatgctggaatctcatggagcgtggaacacacgcgatgctgtggtgaggaatgggcgcgtgggtggtggtttgtcgctggcgtttgaggacgcgtcatcttcgccgaggatcgtgcaccagatacgtggcggaggagaaggaggaggaggtggtggaggaggaggaagagttgagaggcagttggcgtcgtcggctccggtgaacgtgccggattggagtaagatataccgagtcaactcggttgagtcgatacacgagtctgatgaagaggaggaggaagattccgggatgatgatgccgccgcatgagtacttggcgaagagccaacagcgacggagcagaaaatctggcggcggtggctcggtgtttgaaggagttggaagaactcttaaaggacgagaattaaggcgcgttcgagacgcgatttggagccaaacagggttctacggctaagttagtaatataaaatttgaaagaaaaaaaaaacaatataaaacttcaacataaaaactttggaaaatattttgcttattttgtcagtttagagttaattttgcaactttcttgaatcccaagcttgagatgtataagatttatatattgcttcccatgcaaacgctttttcttttctt

SEQ ID NO: 2539 - protein, 201 aa, Arabidopsis thaliana
  misc_feature (1)..(201): useful for making plants with increased heat tolerance as described in USSN 12/515,707
  misc_feature (1)..(201): Ceres ANNOT ID no. 864102
  misc_feature (82)..(201): Pfam Name: DUF584 Pfam Description: DUF584
  misc_feature (1)..(201): Score of 400.8 for HMM of FIGURE 3 of USSN 12/515,707.
MARGRKLTMSQSERYLGSSYSYGDSNGNSATDESELTEEDIWSHAVDHSPEMLESHGAWNTRDAVVRNGRVGGGLSLAFEDASSSPRIVHQIRGGGEGGGGGGGGGRVERQLASSAPVNVPDWSKIYRVNSVESIHESDEEEEEDSGMMMPPHEYLAKSQQRRSRKSGGGGSVFEGVGRTLKGRELRRVRDAIWSQTGFYG

SEQ ID NO: 2540 - DNA, 746 bp, Gossypium hirsutum
  misc_feature (1)..(746): useful for making plants with increased heat tolerance as described in USSN 12/515,707
  misc_feature (104)..(736): Encodes the peptide sequence given in  SEQ ID NO: 98
gtgagcttagcagagatgttcaagtctcttctcaaggggactccatttcattttttattttatcttttttctttgttggaactcaatagtattgatttctttcatggcgaaaggccggcgactgtccaccagcagaagcgaacggtacctcgggagtttcggttacggtcacaaccaagtggaaaccgtcacggacgaaacggaactcggcgaggaagatgtctggtccatggttgataccgtctcagaccgacccgaccagggtgacggtaatccgcggagcgagtggactacacgcgtcgagcatgagagtaatgggaatgagcacctgggccgccgccgaatccctcgagatgagcgccacgtgggcgggttgtctttggctttcgaggattcttcttcgaccaagcctaggatcgtgcaccagtttcgcggccacgacaaggtggcagccgctgcttcgccacgtggacacaagatggccacttcagcgccagtgaacgtgcctgactggagtaagatttacagagtggactcggtggagtctatacatgactcggatgattgtgagtcggaggagatgatgccgccgcatgagtacttagcacgtgagtacgcccggagtaagaaatctggtggggcgtcggtatttgaaggcgttggtcgcacgctcaagggccgcgacttgaggcgggtcagggatgcagtttggagccaaaccgggtttgatggatagccccttaaat

SEQ ID NO: 2541 - protein, 210 aa, Gossypium hirsutum
  misc_feature (1)..(210): useful for making plants with increased heat tolerance as described in USSN 12/515,707
  misc_feature (1)..(210): Ceres CLONE ID no. 1870154
  misc_feature (1)..(210): Functional Homolog of  Ceres ANNOT ID no. 864102
  misc_feature (122)..(210): Pfam Name: DUF584 Pfam Description: DUF584
  misc_feature (1)..(210): Score of 431.2 for HMM of FIGURE 3 of USSN 12/515,707.
MAKGRRLSTSRSERYLGSFGYGHNQVETVTDETELGEEDVWSMVDTVSDRPDQGDGNPRSEWTTRVEHESNGNEHLGRRRIPRDERHVGGLSLAFEDSSSTKPRIVHQFRGHDKVAAAASPRGHKMATSAPVNVPDWSKIYRVDSVESIHDSDDCESEEMMPPHEYLAREYARSKKSGGASVFEGVGRTLKGRDLRRVRDAVWSQTGFDG

SEQ ID NO: 2542 - DNA, 660 bp, Populus balsamifera subsp. trichocarpa
  misc_feature (1)..(660): useful for making plants with increased heat tolerance as described in USSN 12/515,707
  misc_feature (1)..(660): Ceres ANNOT ID no. 1518825
  misc_feature (1)..(660): Encodes the peptide sequence given in  SEQ ID NO: 100
atggccaagggcaggagactaacaacaagtcgcagtgaacgattgttagggagtaactacagctatggcaacggccaagtcccgatggtgaacgaggtgtccgagctgggtgaggaagatgtgtggtcgatggtggacgacacggctgaccggagtgacagtgctgttagtaattcgaacggagcgtggaatccacgcgcagaacttgagagtagtttcgatcacatgtctatcagtggaggccgccgtagaatcccacgagatgaccgcaacatgggggggctgtccttggccttcgaagattcctcttctgggggcaacaaaacagcctcctcgagaatcgtgcaccagtttcgtgggaacgatctcgtggcatcggcgtcacctcgtcacatggccacatcagctcccgtgaacgtgcctgattggagcaagatttatcgagttaactcggttgagtcgttgcatgactcggatgacgggttcgacgatcaggagtcagagatggtccccccgcacgaatacttggcacgtgagtatgcacggagcaggaaaacaggcggtgcctccgtggtcgagggtgttggccggacattaaagggccgcgacatgaggcgcgtgcgtgatgcagtgtggagccagaccgggtttgatggctga

SEQ ID NO: 2543 - protein, 219 aa, Populus balsamifera subsp. trichocarpa
  misc_feature (1)..(219): useful for making plants with increased heat tolerance as described in USSN 12/515,707
  misc_feature (1)..(219): Ceres ANNOT ID no. 1518825
  misc_feature (1)..(219): Functional Homolog of  Ceres ANNOT ID no. 864102
  misc_feature (130)..(219): Pfam Name: DUF584 Pfam Description: DUF584
  misc_feature (1)..(219): Score of 428.1 for HMM of FIGURE 3 of USSN 12/515,707.
MAKGRRLTTSRSERLLGSNYSYGNGQVPMVNEVSELGEEDVWSMVDDTADRSDSAVSNSNGAWNPRAELESSFDHMSISGGRRRIPRDDRNMGGLSLAFEDSSSGGNKTASSRIVHQFRGNDLVASASPRHMATSAPVNVPDWSKIYRVNSVESLHDSDDGFDDQESEMVPPHEYLAREYARSRKTGGASVVEGVGRTLKGRDMRRVRDAVWSQTGFDG

SEQ ID NO: 2544 - protein, 195 aa, Glycine max
  misc_feature (1)..(195): useful for making plants with increased heat tolerance as described in USSN 12/515,707
  misc_feature (1)..(195): Ceres CLONE ID no. 642872
  misc_feature (1)..(195): Functional Homolog of  Ceres ANNOT ID no. 864102
  misc_feature (110)..(195): Pfam Name: DUF584 Pfam Description: DUF584
  misc_feature (1)..(195): Score of 388.6 for HMM of FIGURE 3 of USSN 12/515,707.
  misc_feature (122)..(122): Xaa is any aa, unknown or other
  misc_feature (181)..(181): Xaa is any aa, unknown or other
MAKGRKLTTSRSERFLGTYAYSQGSAAVNPSELREEDVWGAGDDAGEREWDPHFAAMSNGGGSRRRIPRDTDVHRRVGGLSLAFEAPASGASPRIVHQFRAREEMASTPRVRHMATSAPMNXPDWSKILRVDSVDSLNDDYNDEDESEMVPPHEYLARSQTMVANSVFEGVGRTLKGRDLXRVRDAVWSQTGFDG

SEQ ID NO: 2545 - protein, 159 aa, Zea mays
  misc_feature (1)..(159): useful for making plants with increased heat tolerance as described in USSN 12/515,707
  misc_feature (1)..(159): Ceres CLONE ID no. 1448431
  misc_feature (1)..(159): Functional Homolog of  Ceres ANNOT ID no. 864102
  misc_feature (28)..(159): Pfam Name: DUF584 Pfam Description: DUF584
  misc_feature (1)..(159): Score of 272.4 for HMM of FIGURE 3 of USSN 12/515,707.
MATGKSYYARPSYRFLGTDQSYYAANDSGFEFDESDLYSSDSPDFRRKISKPVRSVKKSSNRPSTCGASSAAAASSLPVNVPDWSKILREEHRDNRRRSIVDDDGDWLDASGGRLPPHEFLAKTRMASFSVHEGLGRTLKGRDLSRVRNAIFEKIGFQD

SEQ ID NO: 2546 - protein, 160 aa, Medicago truncatula
  misc_feature (1)..(160): useful for making plants with increased heat tolerance as described in USSN 12/515,707
  misc_feature (1)..(160): Public GI no. 87240942
  misc_feature (1)..(160): Functional Homolog of  Ceres ANNOT ID no. 864102
  misc_feature (29)..(160): Pfam Name: DUF584 Pfam Description: DUF584
  misc_feature (1)..(160): Score of 266.9 for HMM of FIGURE 3 of USSN 12/515,707.
MASSRKSFLSRTSYIFPETNFNQKSSQGKELEFDEADVWNMSYSNSNTNIEPKKGVPGLKRVSRKMEANNKVNPLASSSLPMNIPDWSKILKEEYKKKKESSDDEDEGDYDGVVQLPPHEYLARTRGASLSVHEGKGRTLKGRDLRSVRNAIWKKVGFED

SEQ ID NO: 2547 - protein, 180 aa, Triticum aestivum
  misc_feature (1)..(180): useful for making plants with increased heat tolerance as described in USSN 12/515,707
  misc_feature (1)..(180): Ceres CLONE ID no. 575949
  misc_feature (1)..(180): Functional Homolog of  Ceres ANNOT ID no. 864102
  misc_feature (31)..(180): Pfam Name: DUF584 Pfam Description: DUF584
  misc_feature (1)..(180): Score of 311.5 for HMM of FIGURE 3 of USSN 12/515,707.
MGKGRSCRYGSERLLYPVQASGHHVAGAADHLADLDEEDVWSVLAAPAPDSNRSTSSGRQPEQVRRGRWTAGGLSLAFEATASAPAGRHHHHVASSAPVRVPEWPAARFPPGSGEHGYGVSCREEDGEWMAPHEYLQAQARSSGRGTAAPSVFEGVGRTLKGRDLSRVRDAVWSNTGFFG

SEQ ID NO: 2548 - protein, 142 aa, Glycine max
  misc_feature (1)..(142): useful for making plants with increased heat tolerance as described in USSN 12/515,707
  misc_feature (1)..(142): Ceres CLONE ID no. 1027534
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 342.9 for HMM of FIGURE 2 of USSN 12/515,707.
MAGIGPIRQDWEPIVARKKAQNAADKKDEKAVNAARRSGAEIDTTKKYNAGTNKAASSGTSLNTKRLDDDTENLSHERVSSDLKKNLMQARLDKKMTQAQLAQMINEKPQVIQEYESGKAIPNNQIIGKLERALGAKLRSKK

SEQ ID NO: 2549 - protein, 142 aa, Triticum aestivum
  misc_feature (1)..(142): useful for making plants with increased heat tolerance as described in USSN 12/515,707
  misc_feature (1)..(142): Ceres CLONE ID no. 1031619
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 342.5 for HMM of FIGURE 2 of USSN 12/515,707.
MSRTGPIAQDWEPVVVRKKLPNAAAKKDEKAVNAARRAGVDIDIAKKHNAGTNKAAHSTTSLNTKRLDDDTENLAHERVPSDLKKSIMQARTDKKLTQAQLAQLINEKPQVIQEYESGKAIPNQQIIGKLERALGTKLRGKK

SEQ ID NO: 2550 - protein, 142 aa, Glycine max
  misc_feature (1)..(142): useful for making plants with increased heat tolerance as described in USSN 12/515,707
  misc_feature (1)..(142): Ceres CLONE ID no. 1075173
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 339.3 for HMM of FIGURE 2 of USSN 12/515,707.
MSRTGPIAQDWEPVVVRKKLPNAAAKKDEKAVNAARRAGVDIDIAKKHNAGTNKAAHTTTSLNTKRLDDDTENLAHERVPSDLKKSIMQARTDKKLTQAQLAQLINEKPQVIQEYESGKAIPNQQIIGKLERALGTKLRGKK

SEQ ID NO: 2551 - protein, 142 aa, Zea mays
  misc_feature (1)..(142): useful for making plants with increased heat tolerance as described in USSN 12/515,707
  misc_feature (1)..(142): Ceres CLONE ID no. 1217994
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 368.6 for HMM of FIGURE 2 of USSN 12/515,707.
MAGIGPITQDWEPVVIRKRAPNAAAKRDEKTVNAARRSGADIETVRKFNAGSNKAASSGTSLNTKKLDDDTENLSHDRVPTELKKAIMQARGEKKLTQSQLAHLINEKPQVIQEYESGKAIPNQQILSKLERALGAKLRGKK

SEQ ID NO: 2552 - protein, 142 aa, Triticum aestivum
  misc_feature (1)..(142): useful for making plants with increased heat tolerance as described in USSN 12/515,707
  misc_feature (1)..(142): Ceres CLONE ID no. 1330232
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 346.2 for HMM of FIGURE 2 of USSN 12/515,707.
MAGIGPIRQDWEPIVVRKKAQNAADKKDEKAVNAARRSGAEIDTTKKYNAGTNKAASSGTSLNTKRLDDDTENLSHERVSSDLKKNLMQARLDKKMTQAQLAQMINEKPQVIQEYESGKAIPNNQIIGKLERALGAKLRSKK

SEQ ID NO: 2553 - protein, 142 aa, Zea mays
  misc_feature (1)..(142): useful for making plants with increased heat tolerance as described in USSN 12/515,707
  misc_feature (1)..(142): Ceres CLONE ID no. 1386483
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 351.8 for HMM of FIGURE 2 of USSN 12/515,707.
MAGIGPIRQDWEPVVVRKKAPTAAAKKDEKAVNAARRAGAEIDTMKKYNAGTNKAASSGTSLNTKRLDDDTENLAHERVPSDLKKNLMQARLDKKLTQAQLAQMINEKPQVIQEYESGKAIPNQQIISKLERALGTKLRGKK

SEQ ID NO: 2554 - protein, 142 aa, Zea mays; identical to SEQ ID NO: 2553
  misc_feature (1)..(142): useful for making plants with increased heat tolerance as described in USSN 12/515,707
  misc_feature (1)..(142): Ceres CLONE ID no. 1592023
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 368.5 for HMM of FIGURE 2 of USSN 12/515,707.

SEQ ID NO: 2555 - DNA, 714 bp, Panicum virgatum
  misc_feature (1)..(714): useful for making plants with increased heat tolerance as described in USSN 12/515,707
  misc_feature (1)..(714): Ceres CLONE ID no.1761049
accacttcgcgttgtgctcttgcgtttccgtgttgagacttgagagagagggagagaggagctgccgtgtggggccggagagtagcgaccgcgagcgagagaaggcgatggcggggatcgggccgatcaggcaggactgggagccggtggtggtgcggaagaaggcgcccaccgccgccgccaagaaggatgagaaggccgtcaacgccgcgcgtcgctccggcgccgagatcgataccatgaagaagtacaacgctgggacgaacaaggccgcgtccagcggcacatccttcaacaccaagcggctcgacgacgacactgagaatctagcccatgagcgcgtcccaagtgacctgaagaaaaacctcatgcaagcaaggctggataagaagatgacccaggcacagcttgctcagatgatcaatgagaagccacaggtgatccaggagtatgagtcgggcaaggcgatccctaaccagcagataattagcaagcttgagagggcactcggaacaaagctgcgtgggaagaaataactttcaaacttgtgccccgtagcagcatgaagctgaaggagacaaggcagtctgtctgcttattatctatgcttggttttcaatgtcatgcagactgtttctgtgtttggtacatgagtgaataacagtgtcgtggtggaccttgtaatgccttgctgcttttatgtgtcatatgatc

SEQ ID NO: 2556 - protein, 142 aa, Panicum virgatum
  misc_feature (1)..(142): useful for making plants with increased heat tolerance as described in USSN 12/515,707
  misc_feature (1)..(142): Ceres CLONE ID no. 1761049
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 367.4 for HMM of FIGURE 2 of USSN 12/515,707.
MAGIGPIRQDWEPVVVRKKAPTAAAKKDEKAVNAARRSGAEIDTMKKYNAGTNKAASSGTSFNTKRLDDDTENLAHERVPSDLKKNLMQARLDKKMTQAQLAQMINEKPQVIQEYESGKAIPNQQIISKLERALGTKLRGKK

SEQ ID NO: 2557 - protein, 142 aa, Triticum aestivum; identical to SEQ ID NO: 2552
  misc_feature (1)..(142): useful for making plants with increased heat tolerance as described in USSN 12/515,707
  misc_feature (1)..(142): Ceres CLONE ID no. 638938
  misc_feature (1)..(142): Functional Homolog of  Ceres CLONE ID no. 41712
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Score of 346.2 for HMM of FIGURE 2 of USSN 12/515,707.

SEQ ID NO: 2558 - DNA, 1425 bp, Gossypium hirsutum
  misc_feature (1)..(1425): useful for making plants with increased heat tolerance as described in USSN 12/515,707
  misc_feature (1)..(1425): Ceres CLONE ID no. 1761049
  misc_feature (231)..(1425): Encodes the peptide sequence given in  SEQ ID NO: 118
ttttaactccgctctctctttcggccgttaagccgcccgttgtctgtttctaagttccttcctctctattttcttctcatatcaatcctcttttatatttcaaattccacaaatatctaatgccgcaaattaaccctgcctctaaaccctagagtccccccctttttcacttctcggttttattttatactttaattattattattatttctttgattttgtgacgtggaatggatggagtgagtagcagtagcaacaaccaaaccgatgcatcgacgagcggcggaggaacccaaacagcagcacaacctctgctaatgccccagtcagtggcggggcatagtgcaaacgggccaccgcctttccttagcaagacttacgatatggtagatgatcctgccaccgatgccatcgtttcttggagcccaaccaacaatagctttgttgtttggaacccgccggagtttgctcgggatcttttgcccaagtattttaagcacaacaacttctcgagctttgtcaggcaactaaacacctatggtttccgaaaggttgatccagaccgctgggaatttgcaaatgaggggtttttaagaggtcagaaacaccttcttcggaacattagccgtcgaaagcctgcccatggccatggacatcaacagacacaacaaccacatggacagagttcatctatgggtgcctgtgttgaggttgggaaatttgggcttgaggaagaggttgagaggctcaagagagacaaaaatgtccttatgcaggaacttgttaggttaaggcagcagcaacagactactgataaccagctgcagaacatggtgcaacgtcttcaggggatggagcagcggcagcagcagatgatgtcattcctggccaaggctgtgcagaaccccagcttttttgctcaatttgtgcatcagcaaaatgagagcaataggcgcataagtgaaaccaacaagaaaaggaggctaaagcaggatggcatcattggtgaagaccattcaactgcctctgatgggcggattgttaaatatcaacctttgatgaatgacgcaaaagcaatgctcatgcagatgatgaaaggggatgcttcacccagacgagactcctttaacaacagtaatgaacataccctgataggtgatggttcattgtcatctagtggattggatggtgggaacagttcaagccatgtatcaggggtgactcttcaagaggtctcaccaacttcaggtatctcggggcattgcccctcagctgccatttctgaaatacaatcttccccatgtacaacatcctctgaaaggattacaacagcagagcttccagatgtgagtgcactgattggagcagaaaaaccaccatccgtgtctgttacacagacagatataattatgcctgatcttagtc

SEQ ID NO: 2559 - DNA, 425 bp, Brassica napus
  misc_feature (1)..(425): useful for making plants with increased heat tolerance as described in USSN 12/515,707
  misc_feature (1)..(425): Ceres CLONE ID no.1081376
agaatctctctctctctctctcattatccacgaagaaggaagaaaccctagaaaggcggtttgaagaagaaggattagaagacatggcaggagtaggaccgatgactcaggactgggagcccgtggtgatccgtaagaagacccccaacgctgccgccaagcgcgacgagaagaccgtcaacgctgctcggagaagcggcgccgaaatcgaatccgtcagaaaacataatgctggaacgaacaaggcggcctcaagcggcacctccttgaacaccaagaggcttgatgatgacactgagaacttagctcatgaacgtgtgcctactgagttgaagaaagccatcatgcaagcccgtggggagaagaagctcacccagtcccagctcgctcaattgatcaatgagaagccgcaagtgatccaagag

SEQ ID NO: 2560 - protein, 114 aa, Brassica napus
  misc_feature (1)..(114): useful for making plants with increased heat tolerance as described in USSN 12/515,707
  misc_feature (1)..(114): Ceres CLONE ID no.1081376
  misc_feature (1)..(114): Score of 244.8 for HMM of FIGURE 2 of USSN 12/515,707.
  misc_feature (9)..(79): Pfam Name: MBF1 Pfam Description: Multiprotein bridging factor 1
  misc_feature (1)..(114): Functional Homolog Of Ceres SEEDLINE ID no. ME04448
MAGVGPMTQDWEPVVIRKKTPNAAAKRDEKTVNAARRSGAEIESVRKHNAGTNKAASSGTSLNTKRLDDDTENLAHERVPTELKKAIMQARGEKKLTQSQLAQLINEKPQVIQE

SEQ ID NO: 2561 - DNA, 1903 bp, Panicum virgatum
  misc_feature (1)..(1903): useful for making plants with increased heat tolerance as described in USSN 12/515,707
  misc_feature (1)..(1903): Ceres CLONE ID no.1844328
  misc_feature (461)..(1560): Encodes the peptide sequence given in  SEQ ID NO: 121
gcgccacatctagtaggccgccgccacctccacgcgcgcgctcgtgaccgccgccgcccgccgcgctcgggccgccaggaaaagaatccctccttggtggcgaccgcggaggctccccggcgcttctcgctctccccctggcgtggcgctttggtccccagtttgtcgactgtcttttctgcctgctgcgcttgcacagggtggggaagatgggtggggtggtcttgccaggataacaccttatcctgttccccatccccgtgctagatcgatgcgcccctgcgcgtgtgggtgcatcatgtatgtgtgtcgggcgtattagggggcagctgcttgttcttgtgcttggcctagaagggagcgtgcttactgacactgaccaactgaccgttccattccgggcgccagagtagagattctagtgttgtttcttggctcgctgggagggtaggatctggctatggacatggtgctgaacccggtgaaggaggagagccatggggatggcggtttgttgccgggcgcagcggctggggatgggccgtctgccgccgcgccgaagccgatggaggggctgcacgacgccgggccgccgccgttcctgaccaagacctatgacatggtcgatgacgcggccaccgatcccatcgtgtcgtggagcgccaccaacaacagcttcgtggtgtgggatccccatgctttcgccaccgtgctgctgcccaggcacttcaagcacaacaacttctccagcttcgtcaggcagctcaacacctatggtttcaggaaggtggatcctgatcggtgggaatttgcgaatgaggggtttttacggggacaaaggcacctcctgaagaacattaggcgtcgaaaacctcctgctcagaatgcctcaaaccagcagtctcttgggtcataccttgaggtgggacactttggatatgatgctgagattgaccggctgaagagggacaagcaattattgatggcagaagtggtgaagctaaggcaggagcagcagaacacaaatgcaaatctcaaagccatggaggataggctacaaggcactgatcagaagcagcagcagatgatggcgttcttggcacgcatcatgcggaaccctgaattcttgaagcacctggtttcccagaacgagatgagaaaggagctccaagatgctatttcaaagaaaagaaggcgccgcattgatcagggacctgaagttgatgacttggggaccagtagcagcctagagcaaggttcaccagttctatttgacccccaagactcggtcgaattccttgttgatgggattccaactgatcttgagagtacagctttcaatggcgaaggcctggttgagccacaggatattggtcttggtacctctgagcagcagcaagacatgccccaggaggacttgactgacaacttctgggagcaattgctgaatgaaggacttggcgaggagaatgacaaccctgttgtcgaggatgatatgaatgtgctttctgagaagatgggctatctcaactcagatggctcgacatccaggaaatagttttgtttcattgcatcacattgccatcaccttttgtaattttctcgtatccgcccgcagctttctgagttctactgtgtcagcaagatggcaattgttccggggctagtgttttcttatgcttgccgaactccttggcaagggagagcttgcttccatcaaaagcgccatggattctggggcgagcggcaagtttatctgatctgactgactgtagtgattgccggttgtctagacccttgtatgtctatcagaattcaggacgtgcagtgagtcgtgctgttgatccctgcatgtctcggtaggtggtgatggcatactttgttctgttgatattctaatgtt

SEQ ID NO: 2562 - protein, 365 aa, Panicum virgatum
  misc_feature (1)..(365): useful for making plants with increased heat tolerance as described in USSN 12/515,707
  misc_feature (1)..(365): Ceres CLONE ID no. 1844328
  misc_feature (1)..(365): Functional Homolog of  Ceres ANNOT. ID 886164
  misc_feature (45)..(213): Pfam Name: HSF_DNA-bind Pfam Description: HSF-type DNA-binding
  misc_feature (1)..(365): Score of 862.5 for HMM of FIGURE 1 of USSN 12/515,707.
MDMVLNPVKEESHGDGGLLPGAAAGDGPSAAAPKPMEGLHDAGPPPFLTKTYDMVDDAATDPIVSWSATNNSFVVWDPHAFATVLLPRHFKHNNFSSFVRQLNTYGFRKVDPDRWEFANEGFLRGQRHLLKNIRRRKPPAQNASNQQSLGSYLEVGHFGYDAEIDRLKRDKQLLMAEVVKLRQEQQNTNANLKAMEDRLQGTDQKQQQMMAFLARIMRNPEFLKHLVSQNEMRKELQDAISKKRRRRIDQGPEVDDLGTSSSLEQGSPVLFDPQDSVEFLVDGIPTDLESTAFNGEGLVEPQDIGLGTSEQQQDMPQEDLTDNFWEQLLNEGLGEENDNPVVEDDMNVLSEKMGYLNSDGSTSRK

SEQ ID NO: 2563 - protein, 375 aa, Zea mays
  misc_feature (1)..(375): useful for making plants with increased heat tolerance as described in USSN 12/515,707
  misc_feature (1)..(375): Ceres CLONE ID no.1571069
  misc_feature (1)..(375): Functional Homolog of  Ceres ANNOT. ID 886164
  misc_feature (50)..(218): Pfam Name: HSF_DNA-bind Pfam Description: HSF-type DNA-binding
  misc_feature (1)..(375): Score of 883.1 for HMM of FIGURE 1 of USSN 12/515,707.
MDSTLNQVKEESHGEGGDLMAGTVEAADGPSAAVAAAPKPMEGLHDPGPPPFLTKTYDMVDDSDTDLIVSWSATNNSFVVWDPHAFATVLLPRHFKHNNFSSFVRQLNTYGFRKVDPDRWEFANEGFLRGQRHLLKNIRRRKPPAQNATNQQSIGPYLEVGHFGYDAEIDMLKRDKQLLMAEVVKLRQEQQNTKANLKAMEDRLQGTEQKQQQMMAFLARVMRNPEFLKHLVSQNEMRKELQDAISKKRRRRIDQGPEADDLGASSSLEQGSPVLFNAQDPVEFLVDGIPADLESPAFDGHGLIGPHDIDIDIDIGSTSEQQQDMPQEDLNDNFWEQLLNEGLGEENDSPVIEDDMNVLSEKMGYLNSDGPTSSN

SEQ ID NO: 2564 - protein, 357 aa, Oryza sativa subsp. japonica
  misc_feature (1)..(357): useful for making plants with increased heat tolerance as described in USSN 12/515,707
  misc_feature (1)..(357): Public GI no. 50400035
  misc_feature (1)..(357): Functional Homolog of  Ceres ANNOT. ID 886164
  misc_feature (37)..(204): Pfam Name: HSF_DNA-bind Pfam Description: HSF-type DNA-binding
  misc_feature (1)..(357): Score of 814.7 for HMM of FIGURE 1 of USSN 12/515,707.
MNYRVVNPVKVESGPSTGVANGQPPRPMDGLADGGPPPFLTKTYDMVDDPTTDAVVSWSATNNSFVVWDPHLFGNVLLPRYFKHNNFSSFVRQLNTYGFRKVDPDKWEFANEGFLRGQKHLLKSIKRRKPPNSSPSQQSLGSFLEVGHFGYEGEIDQLKRDKHLLMAEVVKLRQEQQNTKSDLQAMEQKLQGTEQKQQHMMAFLSRVMHNPEFIRQLFSQSEMRKELEEFVSKKRRRRIDQGPELDSMGTGSSPEQVSQVMFEPHDPVDSLFNGVPSDLESSSVEANGGKAQQDVASSSSEHGKIKPSNGELNEDFWEDLLHEGGLDEDTRNPAIDDMNLLSQKMGYLNSSSTKSPQ

SEQ ID NO: 2565 - DNA, 630 bp, Arabidopsis thaliana; identical to SEQ ID NO: 2034
  misc_feature (1)..(630): useful for making plants with increased heat tolerance as described in USSN 12/515,707
  misc_feature (1)..(630): Genomic sequence of Ceres ANNOT. ID 886164
  misc_feature (1)..(79): exon
  misc_feature (80)..(178): intron
  misc_feature (179)..(630): exon

SEQ ID NO: 2566 - DNA, 766 bp, Gossypium hirsutum
  misc_feature (1)..(766): useful for making plants with increased heat tolerance as described in USSN 12/515,707
  misc_feature (1)..(766): Ceres CLONE ID no.1870154
gtgagcttagcagagatgttcaagtctcttctcaaggggactccatttcattttttattttatcttttttctttgttggaactcaatagtattgatttctttcatggcgaaaggccggcgactgtccaccagcagaagcgaacggtacctcgggagtttcggttacggtcacaaccaagtggaaaccgtcacggacgaaacggaactcggcgaggaagatgtctggtccatggttgataccgtctcagaccgacccgaccagggtgacggtaatccgcggagcgagtggactacacgcgtcgagcatgagagtaatgggaatgagcacctgggccgccgccgaatccctcgagatgagcgccacgtgggcgggttgtctttggctttcgaggattcttcttcgaccaagcctaggatcgtgcaccagtttcgcggccacgacaaggtggcagccgctgcttcgccacgtggacacaagatggccacttcagcgccagtgaacgtgcctgactggagtaagatttacagagtggactcggtggagtctatacatgactcggatgattgtgagtcggaggagatgatgccgccgcatgagtacttagcacgtgagtacgcccggagtaagaaatctggtggggcgtcggtatttgaaggcgttggtcgcacgctcaagggccgcgacttgaggcgggtcagggatgcagtttggagccaaaccgggtttgatggatagccccttaaataaaaaaaaaaaaaaaaaaaa

SEQ ID NO: 2567 - DNA, 1228 bp, Glycine max
  misc_feature (1)..(1228): useful for making plants with increased heat tolerance as described in USSN 12/515,707
  misc_feature (1)..(1228): Ceres CLONE ID no.642872
  misc_feature (645)..(645): r is g or a
acaagagcaatggactcgtaagagtagtaactaagaaaataaaggtttctaatttatttcgttcaattctccggcggcaccgcaaccgattccgccaccgcatatggcaaaaggtcgaaaactaacgaccagccggagcgagcgcttcttgggaacctatgcttacagccaaggctccgccgccgtgaacccgtcggagcttcgggaagaggatgtatggggcgccggagatgacgccggcgaacgcgagtgggatccacacttcgccgccatgagcaacggcggcggaagccggcgccggattccgcgtgacacggatgtgcaccggcgcgtgggtgggctgtctctggcttttgaagctccggcgagtggcgcgtcgccgaggatcgtgcaccagtttcgcgcgcgtgaagagatggcgtcgacgccgcgagtgcggcacatggcgacgtcggcgccgatgaacgtgccggactggagcaagatactccgagtcgactcggtcgattcgctgaacgacgattacaacgacgaagacgaatcggagatggtgccaccgcatgagtatttggcgcgtagccagacgatggtggctaactcggtgtttgaaggagtgggccgcacgttgaagggccgagacttgarccgggttcgtgatgccgtgtggagccagaccgggttcgacggttaacaccgggctcaggtttgggctttcatgggtttactgtaataaaaattattataatatatcaaatttagtttaatagaaatacagacaaatgaatgaacacagtagtgttcattatatatgtctgttatataaaggcgagacaaaacatagttttgtaagtaattttagttcagttttgtaattaaaattggagttttgttttgataatttacgtaataaaaagtttttattatgataaattattaaaataaaacttcaattttaatcaatgaacggtactaaacatgcttataaaactgaatttaagttttgtgtttattataattattgttgttaagcaggtggcaagtgatggttagttgaagacgattgttttggttttgttctgggcgatgattcggctgagtggactcggccgaagagagtccaactcagtggccagtgagcctgagccgcaataattgattagcatgtaatttaaatgataatttgtgaattatgattaagatattttccggccaaggccactttattttc

SEQ ID NO: 2568 - DNA, 547 bp, Zea mays
  misc_feature (1)..(547): useful for making plants with increased heat tolerance as described in USSN 12/515,707
  misc_feature (1)..(547): Ceres CLONE ID no.1448431
acaccaaaacaaaaacttaacaaaaatattaaatcacaaattcttaagatctcttcttcaatggcgacggggaaaagctactacgcacggccaagctaccgtttcctcggcaccgatcagtcgtactacgccgccaacgattcgggattcgagttcgacgaatccgatctctactcatccgattcccccgatttccgccggaaaatctctaaaccggtcagatcggtgaagaaatcgtctaaccgaccgtccacgtgcggcgcttcctccgccgcagcggcgtcgtctctcccggtgaacgtgccggactggtctaagattctccgggaggagcatcgcgataaccgtcggagaagcatcgtggatgacgacggagattggttggacgctagcggcgggaggttgccgccgcatgagtttctggcgaagacgaggatggcgtcgttctcggtgcacgaaggacttgggaggacattgaaaggaagggatctgagtagggttagaaatgcaatttttgagaaaattgggttccaggattaatattttg

SEQ ID NO: 2569 - DNA, 1218 bp, Triticum aestivum
  misc_feature (1)..(1218): useful for making plants with increased heat tolerance as described in USSN 12/515,707
  misc_feature (1)..(1218): Ceres CLONE ID no.575949
  misc_feature (1002)..(1002): k is g or t/u
  misc_feature (1083)..(1083): r is g or a
  misc_feature (1086)..(1086): w is a or t/u
  misc_feature (1212)..(1212): r is g or a
attgagtggagttcttcccatccacagggcctctcgtagccttgctctcgtttttttcttaacttttttgggggaaaagttggttttgtgtacacggcagacagtatagtaggctttgtgtgagttgattaaaaagcttcaatcattcgattcatcttagctagccagtagcaaagattcttcgtttcttttcttctgttttctttgcttgccatccatccattcatacatagggaaggagggagggagggagaggcactcgctagctagttgattccaatttcctgaggctagctagccagccagtgatatcgatccatggggaagggccgcagctgcaggtacggatcagagcggctgctctaccccgtccaggccagcggtcaccacgtcgccggcgccgccgatcacctcgccgacctcgacgaggaggacgtctggtcggtgctcgccgcgcctgcgcccgactccaaccgctccaccagcagcggcaggcaacctgagcaggtccgtcgcggccggtggaccgcaggggggctgtcgctggcgttcgaggcaacggcgtccgcgccggcagggcgccaccatcatcacgtggcgagctcggcgcctgtcagggtgcccgagtggccggcggccaggttcccgcctgggtctggcgagcacggctacggcgtgagctgccgtgaggaggacggggagtggatggcgccgcacgagtacctgcaggcccaggcacggagcagcgggcgcggcacggctgcgccgtcggtgttcgagggcgtggggaggacgctgaaaggtcgcgacctcagccgggtgcgcgacgccgtctggagcaacaccgggttcttcggctaagcaaagcaagcagtgtaccccatcatcgtctcgtgtcagccagctagctactcataagctcggagggcactttcctgttggatcattcgttataagatgcatgtactgttcttaatcagtatgaattaggatagggggtgkgggaaaatatgaagaagaaaaattaggtgattgattaattattagttaatctcctgcagtatggagcatgtagctgctgcrggwagagttttgggtctgtttcgattgtattgggttgtgtgctatccctagctagctagctacctgccgatatcgtcagtttgtcacaaaacttctccggaaaataataatccaatttgattattattragctcc

SEQ ID NO: 2570 - protein, 283 aa, Arabidopsis thaliana
  misc_feature (1)..(283): useful for making plants with increased heat tolerance as described in USSN 12/515,707
  misc_feature (1)..(283): Ceres SEEDLINE ID no.ME00016
  misc_feature (1)..(283): Score of  636.5 for HMM of FIGURE 3 of USSN 12/515,707.
  misc_feature (23)..(132): Pfam Name: DUF584 Pfam Description: DUF584
  misc_feature (1)..(283): Functional Homolog Of Ceres ANNOT ID no. 864102
MKSELNLPAGFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYFPADEKPRTTTMAEQSSSPFDTSDSTYPTLQEDDSSSSGGHGHVVSPDVLEVQSEPKWGELEDALEAFDTSMFGSSMELLQPDAFVPQFLYQSDYFTSFQDPPEQKPFLNWSFAPQG

SEQ ID NO: 2571 - DNA, 901 bp, Arabidopsis thaliana
  misc_feature (1)..(901): useful for making plants with increased heat tolerance as described in USSN 12/515,707
  misc_feature (1)..(901): Ceres CLONE ID no.124987
  misc_feature (296)..(296): m is a or c
  misc_feature (685)..(685): s is g or c
atagcgaaatctctaattacttaatctctgaatgcttaagataataactataatctaagagtaattaattaaacgataagtggttaaatttgttgaggttaaaagtgaagcttcaatggcaagaggtcgaaagctgacgatgagccagagcgagaggtacctaggaagcaactatagttacggtgacagtaacggaaactccgccaccgacgaatcagagctcacggaggaggacatctggtcacacgccgtcgatcacagcccggagatgctggaatctcatggagcgtggaacmcacgcgatgctgtggtgaggaatgggcgcgtgggtggtggtttgtcgctggcgtttgaggacgcgtcatcttcgccgaggatcgtgcaccagatacgtggcggaggagaaggaggaggaggtggtggaggaggaggaagagttgagaggcagttggcgtcgtcggctccggtgaacgtgccggattggagtaagatataccgagtcaactcggttgagtcgatacacgagtctgatgaagaggaggaggaagattccgggatgatgatgcccgccgcatgagtacttggcgaagagccaacagcgacggagcagaaaatctggcggcggtggctcggtgtttgaaggagttggaagaactcttaaaggacgagaattaaggcgcgttcsagacgcgatttggagccaaacagggttctacggctaagttagtaatataaaatttgaaagaaaaaaaaaacaatataaaacttcaacataaaaactttggaaaatattttgcttattttgtcagtttagagttaattttgcaactttcttgaatcccaagcttgagatgtataagatttatatattgcttcccatgcaaacgctttttcttttctt

SEQ ID NO: 2572 - protein, 145 aa, Arabidopsis thaliana
  misc_feature (1)..(145): useful for making plants with increased heat tolerance as described in USSN 12/515,707
  misc_feature (1)..(145): Ceres CLONE ID no.124987
  misc_feature (1)..(145): Score of 154.0 for HMM of FIGURE 3 of USSN 12/515,707.
  misc_feature (74)..(137): Pfam Name: DUF584 Pfam Description: DUF584
  misc_feature (1)..(145): Functional Homolog Of Ceres ANNOT ID no. 864102
  misc_feature (53)..(53): Xaa is any aa, unknown or other
MSQSERYLGSNYSYGDSNGNSATDESELTEEDIWSHAVDHSPEMLESHGAWNXRDAVVRNGRVGGGLSLAFEDASSSPRIVHQIRGGGEGGGGGGGGGRVERQLASSAPVNVPDWSKIYRVNSVESIHESDEEEEEDSGMMMPAA

SEQ ID NO: 2573 - protein, 203 aa, Arabidopsis thaliana
  misc_feature (1)..(203): useful for making plants with increased heat tolerance as described in USSN 12/515,707
  misc_feature (1)..(203): Public GI ID no.18407379
  misc_feature (1)..(203): Score of 275.8 for HMM of FIGURE 3 of USSN 12/515,707.
  misc_feature (95)..(203): Pfam Name: DUF584 Pfam Description: DUF584
  misc_feature (1)..(203): Functional Homolog Of Ceres ANNOT ID no. 864102
MAKGRKPTTMNRSDRYLGSYTYGDSHGNSVTDELELGEEDIWSPAVIHDDTTENEESYGTWNLRATLGKNGRVGGLSLAFEGSLVAPPSSSPMIVQKIHGGGGEGEEDRRKLASSAPVNVPDWSKIYRVDSVESIHELDDEDDEDEESGMMPPHEYLAKSQARRSRKIGGGGASVFDGVGRTLKGRELRRVRDAIWSQTGFYG

SEQ ID NO: 2574 - protein, 203 aa, Arabidopsis thaliana
  misc_feature (1)..(203): useful for making plants with increased heat tolerance as described in USSN 12/515,707
  misc_feature (1)..(203): Public GI ID no.21592602
  misc_feature (1)..(203): Score of 274.3 for HMM of FIGURE 3 of USSN 12/515,707.
  misc_feature (95)..(203): Pfam Name: DUF584 Pfam Description: DUF584
  misc_feature (1)..(203): Functional Homolog Of Ceres ANNOT ID no. 864102
MAKGRKPTTMNRSDRYLGSYTYGDSHGNSVTDELELGEEDIWSPAVIHDDTTENEESYGTWNLRATLGKNGRVGGLSLAFEGSLVAPPLSSPMIVQKIHGGGGEGEEDRRKLASSAPVNVPDWSKIYRVDSVESIHELDDEDDEDEESGMMPPHEYLAKSQARRSRKIGGGGASVFDGVGRTLKGRELRRVRDAIWSQTGFYG

SEQ ID NO: 2575 - DNA, 870 bp, Arabidopsis thaliana
  misc_feature (1)..(870): useful for making plants with increased heat tolerance as described in USSN 12/515,707
  misc_feature (1)..(870): Ceres CLONE ID no.30230
atagcaaaatctctaataattgattatatgaattaatggttaaattttatagtaattaaacttgaattaatcagtgattaatttagagattaaagaagagggtgaagttgttgttgcatggcaaaaggtcgaaagccgacgacaatgaaccggagcgatcgataccttggaagctacacttacggtgacagtcacggaaactccgttaccgacgaattagagctcggtgaggaagacatctggtcaccggccgtcattcacgacgacaccaccgagaatgaggaatcctacggcacgtggaacttacgcgctaccttgggaaaaaacgggcgcgtgggaggattgtcgctggctttcgagggctctttggttgctccgccgttgtcttcgccgatgatagtgcagaagattcacggcggaggaggtgagggagaggaagaccggagaaaattggcgtcttcggcgccggtaaacgtaccagactggagtaagatataccgagttgactcggttgagtcaatacacgagttagacgacgaggatgacgaggatgaggaatccgggatgatgccgccgcatgagtaccttgctaagagtcaagcacggcggagcagaaagatcggaggtggtggtgcgtcggtgtttgacggcgtcggaaggactctcaaaggcagagaactaaggcgcgttcgtgacgcgatttggagccaaacagggttctacggctaagtataattaacaaaactaaaaaaaaaaacattttagatttcaattaaaattacttgtttttgccagtatagaagtaatttttgtgattatgcaaatttttaattttgagttttattatgaacgagaccaaaatttcaagtt

SEQ ID NO: 2576 - protein, 203 aa, Arabidopsis thaliana; identical to SEQ ID NO: 2574
  misc_feature (1)..(203): useful for making plants with increased heat tolerance as described in USSN 12/515,707
  misc_feature (1)..(203): Ceres CLONE ID no.30230
  misc_feature (1)..(203): Score of 274.3 for HMM of FIGURE 3 of USSN 12/515,707.
  misc_feature (95)..(203): Pfam Name: DUF584 Pfam Description: DUF584
  misc_feature (1)..(203): Functional Homolog Of Ceres ANNOT ID no. 864102

SEQ ID NO: 2577 - DNA, 836 bp, Brassica napus
  misc_feature (1)..(836): useful for making plants with increased heat tolerance as described in USSN 12/515,707
  misc_feature (1)..(836): Ceres CLONE ID no.1091241
acttatagcaaaatctctaacatttaactccttaataataataattatattattattataagtaaccaaatttaattaagcgacaagaggctgtggctgagttgcatggcaagaggtcgaaatccgacgacgatgaaccggagcgatcgataccttggaagctacagttacggtgacagtcacggaacctccctcaccgacgaattagagctcgccgaggaagacatctggtcaccggcagtcattcacgacaccgagacagaagattcatacagcgggtggaacttaagtgctaactctatgaaaagtgggcgcgtgggactctcgcttactttcaagagctcctcaaacgcaccgtcgtcatctctgatgctcgtgcagcagatccacggcggagtaggcgaaggaggagaaatcatgcggaacttggcgtcctcagcgccggttaacgtgccggattggagtaagatatatcgagtcaacttggttgagtcaacacacgagcttgacggtgacgacgaggaggaaccggggatgatgccgccgcacgagtaccttgctaagagccaagcacggcggagcaggaaaatgggaggcggtggggcgtcgatgtttgagggtgtaggaaggactctcaaaggcagggaactaaggcgtgttcgtgatgcaatttggagccaaacagggttctacggctaagaaattaacaaataacaatattctagatttcagttaaaatatttgttttggcagaatagaagtaattttgtaattttcgaagtttttttttgcctttaacgagcctacaaattcaagttccaaaaaaaaaaaaaaaa

SEQ ID NO: 2578 - protein, 197 aa, Brassica napus
  misc_feature (1)..(197): useful for making plants with increased heat tolerance as described in USSN 12/515,707
  misc_feature (1)..(197): Ceres CLONE ID no.1091241
  misc_feature (1)..(197): Score of 227.5 for HMM of FIGURE 3 of USSN 12/515,707.
  misc_feature (109)..(197): Pfam Name: DUF584 Pfam Description: DUF584
  misc_feature (1)..(197): Functional Homolog Of Ceres ANNOT ID no. 864102
MARGRNPTTMNRSDRYLGSYSYGDSHGTSLTDELELAEEDIWSPAVIHDTETEDSYSGWNLSANSMKSGRVGLSLTFKSSSNAPSSSLMLVQQIHGGVGEGGEIMRNLASSAPVNVPDWSKIYRVNLVESTHELDGDDEEEPGMMPPHEYLAKSQARRSRKMGGGGASMFEGVGRTLKGRELRRVRDAIWSQTGFYG

SEQ ID NO: 2579 - DNA, 1154 bp, Gossypium hirsutum
  misc_feature (1)..(1154): useful for making plants with increased heat tolerance as described in USSN 12/515,707
  misc_feature (1)..(1154): Ceres CLONE ID no.1843171
atgtttgagtctcctctctaatggactccctttaatattcaccctccctcttttctccttccttttcttagtgtagatttttaattttcatttttcctttttttcttttttttcctttttcctttttcctttttcccatttccccattttctttttatttgtcgttgatctattggttttggttatttaatagtatttggttgtttgatggcgaaaggccggcggttgaccaccagcagaagcgaacggttgcttggaaattatggttacgggcacagccaaggggacagtgtcatcaatgaagaagccgagcttggtgaggaagatgtttggtcgatggttgataacgtcgcagaccgaggagacggcgggagtgtcgacaattctcggagccagtggagtccacacgctgatgcggagagtaacgggaatgggaacttcgacatgaggggggatcgtcgtctaattcctcggggcgaacgccacgttggtgggctgtccttggctttcgaggattctgcttcgacgaagcctaggatcgtgcatcagtttcgtggccatgacggcgtggcggccgctgcttcgccacgagggcaccatattgccacgtcagctccagtgaacgtgcctgactggagtaagatttaccgggttaactcggtggagtggatacgcgactcggacgatgggttggatgacgctgaatcggagatggtgccaccacacgaatacttggcgcgtgagtacgctcggattaagaaatctggcggggcttcggttttcgaaggcgtgggtcggaccctcaagggccgagacatgaggcgggtcagggatgcagtatggagccggaccgggttcgatggctaaccaatttgttagacaaaagcagcttgaatacgattgattaaaaggcaactacatcattattattatttttaattgggcaatgattcggctgagtcgacacaggtgagtcaacttagttgcgagggagctcaagcaggattttgtattgaggtatcttaaaaaagattttctgttattggattggaatttggaagttaaatgtgtattaccattttctcttaaattgatgaggaaaacataattggacaagattttccattttagagcaaaaaaaaaaaaaaaaaaaa

SEQ ID NO: 2580 - protein, 219 aa, Gossypium hirsutum
  misc_feature (1)..(219): useful for making plants with increased heat tolerance as described in USSN 12/515,707
  misc_feature (1)..(219): Ceres CLONE ID no.1843171
  misc_feature (1)..(219): Score of 374.1 for HMM of FIGURE 3 of USSN 12/515,707.
  misc_feature (128)..(219): Pfam Name: DUF584 Pfam Description: DUF584
  misc_feature (1)..(219): Functional Homolog Of Ceres ANNOT ID no. 864102
MAKGRRLTTSRSERLLGNYGYGHSQGDSVINEEAELGEEDVWSMVDNVADRGDGGSVDNSRSQWSPHADAESNGNGNFDMRGDRRLIPRGERHVGGLSLAFEDSASTKPRIVHQFRGHDGVAAAASPRGHHIATSAPVNVPDWSKIYRVNSVEWIRDSDDGLDDAESEMVPPHEYLAREYARIKKSGGASVFEGVGRTLKGRDMRRVRDAVWSRTGFDG

SEQ ID NO: 2581 - DNA, 654 bp, Populus balsamifera subsp. trichocarpa
  misc_feature (1)..(654): useful for making plants with increased heat tolerance as described in USSN 12/515,707
  misc_feature (1)..(654): Ceres ANNOT ID no.1448549
atggccaaaggtaggagactaactgcaagccgcagtgaaagattgctaggaagtagttatagctatggtagcggccatggaccgatggtgaatgacgtgtcggaactaggcgaggaagatgtgtggtcgatggtggatgacacggctgatcggaatgaccgtggtgttcataattccaactggagtccacgcactgatcttgaaaatagttttgacaacatgtctattagcagcggccgccgtaggatcccaagagatgaccgccacatgggtgggttatcattggcctttgaagattcttcttctggcaaaaacaaaatagcttcctcgagaattgtgcaccagtttcgtggaaatgacctggtggcatcgcaatctccccgcaacatggccacgtcagctcccgtgaacgtgcccgattggagcaagatttatcgagtcaactcggtcgaatcatgcaatgactccgatgatgggctggatgaccaggagtccgagatggttcccccgcatgagtacttggcacgtgagtatgcacagagtcaaaagatgggtggcgcctccgtggttgagggtgtgggccggacgcttaagggccgagacatgagtcgcgtgcgcgacgcggtgtggagccaaactgggttttatggctga

SEQ ID NO: 2582 - protein, 217 aa, Populus balsamifera subsp. trichocarpa
  misc_feature (1)..(217): useful for making plants with increased heat tolerance as described in USSN 12/515,707
  misc_feature (1)..(217): Ceres ANNOT ID no.1448549
  misc_feature (1)..(217): Score of 388.6 for HMM of FIGURE 3 of USSN 12/515,707.
  misc_feature (131)..(217): Pfam Name: DUF584 Pfam Description: DUF584
  misc_feature (1)..(217): Functional Homolog Of Ceres ANNOT ID no. 864102
MAKGRRLTASRSERLLGSSYSYGSGHGPMVNDVSELGEEDVWSMVDDTADRNDRGVHNSNWSPRTDLENSFDNMSISSGRRRIPRDDRHMGGLSLAFEDSSSGKNKIASSRIVHQFRGNDLVASQSPRNMATSAPVNVPDWSKIYRVNSVESCNDSDDGLDDQESEMVPPHEYLAREYAQSQKMGGASVVEGVGRTLKGRDMSRVRDAVWSQTGFYG

SEQ ID NO: 2583 - DNA, 887 bp, Glycine max
  misc_feature (1)..(887): useful for making plants with increased heat tolerance as described in USSN 12/515,707
  misc_feature (1)..(887): Ceres CLONE ID no.673051
  misc_feature (641)..(641): m is a or c
aatgccaaagcaaaaccagaagcgccaatggccaagggtcgcaaattccccaccacgaccggaagcgagcgcttcttgggattgggaatgggaacaacaacaacaacctactcctcccagggctccgccgccgccgaccggtcggagttctgggaagaggacgtgtggtccacggcggaacaccgtgacggagatgtgaatgcctgccccggcgagtgggaggcatgcgcgccgccgcggcgtcggaacaacagggagaactgcaacgtggggggtttgtcgctggcgttcgaggatgggtccggtggtggtacgaggatagtgcaccaccagtaccgcgcgcagcacgacgccgtttcgcgccaacgccaaatggccacgtcagcgcccgtgaacgtgcccgactggagcaagatcctccgggccgactcggtggaatcgctgcacgggatggacgacggcttcgacgagaacaacgagtcggagatggttcctccgcacgagtacttggcgcgcagccgcaagatggcggcgaactcggttttcgaaggggtgggtcgcacgttaaagggccgcgacatgagaagggttcgtgacgccgtttggagccagaccgggttcgacggctgacttcctcgctmcggttcgcaacttgtaattcaatcgataatcctttttaatttattatggttatggtggtggcggtggttaattaaaaattttggggaattttcaaaaaatgaaacaataggatttagtttgttattttttttttcttttggagtttgattttcccttttttgggttgttattaaaattggatgggtggactcgggttaagagagtccgagtctgtggccagtgagcctaagcatatatatattggg

SEQ ID NO: 2584 - protein, 200 aa, Glycine max
  misc_feature (1)..(200): useful for making plants with increased heat tolerance as described in USSN 12/515,707
  misc_feature (1)..(200): Ceres CLONE ID no.673051
  misc_feature (1)..(200): Score of 272.7 for HMM of FIGURE 3 of USSN 12/515,707.
  misc_feature (111)..(200): Pfam Name: DUF584 Pfam Description: DUF584
  misc_feature (1)..(200): Functional Homolog Of Ceres ANNOT ID no. 864102
MAKGRKFPTTTGSERFLGLGMGTTTTTYSSQGSAAADRSEFWEEDVWSTAEHRDGDVNACPGEWEACAPPRRRNNRENCNVGGLSLAFEDGSGGGTRIVHHQYRAQHDAVSRQRQMATSAPVNVPDWSKILRADSVESLHGMDDGFDENNESEMVPPHEYLARSRKMAANSVFEGVGRTLKGRDMRRVRDAVWSQTGFDG

SEQ ID NO: 2585 - protein, 183 aa, Arabidopsis thaliana
  misc_feature (1)..(183): useful for making plants with increased heat tolerance as described in USSN 12/515,707
  misc_feature (1)..(183): Public GI ID no.30685620
  misc_feature (1)..(183): Score of 179.6 for HMM of FIGURE 3 of USSN 12/515,707.
  misc_feature (33)..(183): Pfam Name: DUF584 Pfam Description: DUF584
  misc_feature (1)..(183): Functional Homolog Of Ceres ANNOT ID no. 864102
MGKGRSLPISRSERFLGSHQQSDDHHVDGETTFELELMEEDVWSVVEPDEPKELGAWNARSLEASGSEWRRKGGRVSDLTVPSDGQRKRHVATSAPVKVPDWSKILKVESVKSMHNNNNDNDNADVADCDWESAMVPPHEYVAARSRNGDGGSSVFLGVGRTLKGRDMRRVRDAVWSQTGFYG

SEQ ID NO: 2586 - protein, 193 aa, Arabidopsis thaliana
  misc_feature (1)..(193): useful for making plants with increased heat tolerance as described in USSN 12/515,707
  misc_feature (1)..(193): Public GI ID no.2894571
  misc_feature (1)..(193): Score of 179.6 for HMM of FIGURE 3 of USSN 12/515,707.
  misc_feature (43)..(193): Pfam Name: DUF584 Pfam Description: DUF584
  misc_feature (1)..(193): Functional Homolog Of Ceres ANNOT ID no. 864102
MVRRQVTKRDMGKGRSLPISRSERFLGSHQQSDDHHVDGETTFELELMEEDVWSVVEPDEPKELGAWNARSLEASGSEWRRKGGRVSDLTVPSDGQRKRHVATSAPVKVPDWSKILKVESVKSMHNNNNDNDNADVADCDWESAMVPPHEYVAARSRNGDGGSSVFLGVGRTLKGRDMRRVRDAVWSQTGFYG

SEQ ID NO: 2587 - protein, 167 aa, Vitis vinifera
  misc_feature (1)..(167): useful for making plants with increased heat tolerance as described in USSN 12/515,707
  misc_feature (1)..(167): Public GI ID no.147779554
  misc_feature (1)..(167): Score of 178.0 for HMM of FIGURE 3 of USSN 12/515,707.
  misc_feature (29)..(167): Pfam Name: DUF584 Pfam Description: DUF584
  misc_feature (1)..(167): Functional Homolog Of Ceres ANNOT ID no. 864102
MASGKSYYARPNYRFLSGDRDAPAITSEAVIELDETDIWSSSHSASPEFRNPVPSSRLAKKPSKRGESGDRSTATVGSLPVNIPDWSKILREDYRDNRRREADDDDDDEDDDGDSSSRVPPHEFLARQFARTRIASFSVYEGIGRTLKGRDLSRVRNAIWEKTGFQD

SEQ ID NO: 2588 - protein, 377 aa, Triticum aestivum
  misc_feature (1)..(377): useful for making plants with increased heat tolerance as described in USSN 12/515,707
  misc_feature (1)..(377): Ceres CLONE ID no. 835571
  misc_feature (1)..(377): Score of 851.1 for HMM of FIGURE 1 of USSN 12/515,707.
  misc_feature (64)..(240): Pfam Name: HSF_DNA-bind Pfam Description: HSF-type DNA-binding
  misc_feature (1)..(377): Functional Homolog Of Ceres SEEDLINE ID no. ME17524
MDPFHGIVKEEEFDFAGAAADGYSPSSWGSSPSSWGSSQSSWAGGGALAELPRPMDGLGEAGPTPFLNKTYEVVDDHSTDTIVSWGVAGNSFVVWDAHAFSMVLLPRYFKHCNFSSFVRQLNTYGFRKVDPDRWEFAAEGFLRGQKELLKTIRRRRPQSSPSGTPALLQQQQQGQQGACLEVGHFGPEGEVQRLQRDKGTLIAEVVKLRQEQQATRAQMQEMEARLAATEQKQQQMTVFLARAMKSPSFLQMLVQRQDQSRRKELAEALLSKKRGRPIEYLLPRNGETSSAASYSAAARGYGPGLADGSDGRRADGEDTESFWKELLSLGLEERHREAGGGGGEASGAEVDDDVDDEVDELVQSLYHLSPNRPHSHQ

SEQ ID NO: 2589 - protein, 202 aa, Arabidopsis thaliana
  misc_feature (1)..(202): useful for making plants with increased heat tolerance as described in USSN 12/515,707
  misc_feature (1)..(202): Public GI ID no.4773907
  misc_feature (1)..(202): Score of 60.0 for HMM of FIGURE 3 of USSN 12/515,707.
  misc_feature (23)..(168): Pfam Name: DUF584 Pfam Description: DUF584
  misc_feature (1)..(202): Functional Homolog Of Ceres ANNOT ID no. 864102
MDSLGSRRRTHNSRRVPSMGIEGDEEFQEEDVWSVLREGETSSPEMKIPKSHFSSSSSSSSSPWNIRRSKEVSGVKQSSAPMNVPDWSKVYGDSKSNRRSSHLHSHAADDDDEDDDGCMVPPHEWVARKLARTQISSFSMCEGVGRTLKGRDLSKVRNAVLSKTGFLEVDKYHSDDDDLSAPCMGPVLCSSVVFGFSLKVFL

SEQ ID NO: 2590 - DNA, 988 bp, Arabidopsis thaliana
  misc_feature (1)..(988): useful for making plants with increased heat tolerance as described in USSN 12/515,707
  misc_feature (1)..(988): Ceres CLONE ID no.118778
aaaacaacaacatcaacaacaaaactctttaaaaagcaagaaaactttcactagtagttgaagaatttctctcttcctctacttattattattatcaactggtgatttgatttctctctctctctctcacaatggattcattaggatcaagaagaaggacacataatagccgtagggttccttcaatgggaatagaaggggacgaagagtttcaagaagaagatgtgtggtcagttttacgagaaggagaaacttcaagtcctgaaatgaaaatacccaaaagtcatttctcttcctcatcatcttcttcctcttcaccatggaacattcgtagaagcaaggaggtctcaggagtgaaacaatcatcagcacctatgaatgtccctgattggtccaaggtttatggtgactcaaagagcaacagaaggagtagccatttgcattctcatgctgctgacgatgatgatgaagatgatgatggttgcatggttcctccacatgaatgggttgcaagaaagctagcaagaacacagatctcttctttctctatgtgtgaaggagttggaagaacacttaaaggaagagatctaagcaaagtgagaaatgctgtcttgtcaaaaactggtttcttggagtaagtaggataaaatatctcatcatcatcatcaccataattatcatccatgtgcatggaatatgaatcccataactcttgtttaacattatcatcatgaaaaactcaactttatggtatccacatcatcatcattatcaatgtcattgtcgtcatcatcatgtggggatcactataccaagagtctttttgttaagttttttttttctttattgttgttattatttttcaatgtgttatttagagtagataagtatcatagtgatgatgatgacttgtcagccccatgcatgggtcccgttttatgttcttctgttgtttttggtttctctttgaaggtttttttatgatctc

SEQ ID NO: 2591 - protein, 168 aa, Arabidopsis thaliana
  misc_feature (1)..(168): useful for making plants with increased heat tolerance as described in USSN 12/515,707
  misc_feature (1)..(168): Ceres CLONE ID no.118778
  misc_feature (1)..(168): Score of 60.0 for HMM of FIGURE 3 of USSN 12/515,707.
  misc_feature (23)..(168): Pfam Name: DUF584 Pfam Description: DUF584
  misc_feature (1)..(168): Functional Homolog Of Ceres ANNOT ID no. 864102
MDSLGSRRRTHNSRRVPSMGIEGDEEFQEEDVWSVLREGETSSPEMKIPKSHFSSSSSSSSSPWNIRRSKEVSGVKQSSAPMNVPDWSKVYGDSKSNRRSSHLHSHAADDDDEDDDGCMVPPHEWVARKLARTQISSFSMCEGVGRTLKGRDLSKVRNAVLSKTGFLE

SEQ ID NO: 2592 - protein, 219 aa, Oryza sativa subsp. japonica
  misc_feature (1)..(219): useful for making plants with increased heat tolerance as described in USSN 12/515,707
  misc_feature (1)..(219): Public GI ID no.115441209
  misc_feature (1)..(219): Score of 61.9 for HMM of FIGURE 3 of USSN 12/515,707.
  misc_feature (91)..(219): Pfam Name: DUF584 Pfam Description: DUF584
  misc_feature (1)..(219): Functional Homolog Of Ceres ANNOT ID no. 864102
MDRSRHKNSPSSERFLGSFLPSAAAGDQPGSAAFELDEDDLFASGAGSPERPQPSRRPLILSAVRAANPSPLPRLRRPPEGILDALPERRSPFSPPPSSSSNSSTTASPAAAAAAPPRLIPTIPRPAAALAPHIPQSAPVNVPVAQFRRLSVEALMDKAEDDDDDDEEMLPPHEMVARARARDSPMTTFSVLEGAGRTLKGRDLRQVRNAVWRKTGFLD

SEQ ID NO: 2593 - protein, 219 aa, Oryza sativa subsp. japonica
  misc_feature (1)..(219): useful for making plants with increased heat tolerance as described in USSN 12/515,707
  misc_feature (1)..(219): Public GI ID no.125572722
  misc_feature (1)..(219): Score of 61.2 for HMM of FIGURE 3 of USSN 12/515,707.
  misc_feature (91)..(219): Pfam Name: DUF584 Pfam Description: DUF584
  misc_feature (1)..(219): Functional Homolog Of Ceres ANNOT ID no. 864102
MDRSRHKNSPSSERFLGSFLPSAAAGDQPGSAAFELDEDDLFASGAGSPERPQPSRRPLILFAVRAANPSPLPRLRRPPEGILDALPERRSPFSPPPSSSSNSSTTASPAAAAAAPPRLIPTIPRPAAALAPHIPQSAPVNVPVAQFRRLSVEALMDKAEDDDDDDEEMLPPHEMVARARARDSPMTTFSVLEGAGRTLKGRDLRQVRNAVWRKTGFLD

SEQ ID NO: 2594 - protein, 168 aa, Arabidopsis thaliana
  misc_feature (1)..(168): useful for making plants with increased heat tolerance as described in USSN 12/515,707
  misc_feature (1)..(168): Public GI ID no.26452217
  misc_feature (1)..(168): Score of 58.2 for HMM of FIGURE 3 of USSN 12/515,707.
  misc_feature (23)..(168): Pfam Name: DUF584 Pfam Description: DUF584
  misc_feature (1)..(168): Functional Homolog Of Ceres ANNOT ID no. 864102
MDSLGSRRRTHNSRRVPSMGIEGDEEFQEEDVWSVLREGETSSPEIKIPKSHFSSSSSSSSSPWNIRRSKEVSGVKQSSAPMNVPDWSKVYGDSKSNRRSSHLHSHAADDDDEDDDGCMVPPHEWVARKLARTQISSFSMCEGVGRTLKGRDLSKVRNAVLSKTGFLE

SEQ ID NO: 2595 - DNA, 707 bp, Gossypium hirsutum
  misc_feature (1)..(707): useful for making plants with increased heat tolerance as described in USSN 12/515,707
  misc_feature (1)..(707): Ceres CLONE ID no.1923334
aaataaataaaaaagcaaggcgaaactaatagaaagccaagacggttccccagtatttcttcttcttgaaaacccatcaactgtttaccaaaaagattttatatattgccttgtttctttctttgtttttggggttttgcaaaaatggcaacaagtaggatcttttttggttcaaaaccaagatatatctacccaactatggaatttgatgatgggaatctcatcaacaacccttcgtttgatcatcgtcatcatcatctgctggagttcgatgaggtggatgtatggaacaattcaaatgatcaagcaacaaccaacttagaagccaaaaagccattgccaagttaccgagcttcctctaagaaagctttcaaaaagaaggagtttcagattagcgataataataaccataggagtgcccaaatgactgctgcttctgcttcattgccggtcaacatccctgactggtccaagattctcaaagcggagtacagggaacatgggaagaccgatgaagatgctgtcgacggcgatgacgacggtgatcgtgacggaagggttccaccgcatgagtacttggctaggagacgaggagcttccttttctgtccatgaaggaattggaaggactttgaaaggaagagatttgcgtcgtgttaggaatgctgtctggaaaaaaacaggttttgaagattaaccccacacatc

SEQ ID NO: 2596 - protein, 183 aa, Gossypium hirsutum
  misc_feature (1)..(183): useful for making plants with increased heat tolerance as described in USSN 12/515,707
  misc_feature (1)..(183): Ceres CLONE ID no.1923334
  misc_feature (1)..(183): Score of 152.8 for HMM of FIGURE 3 of USSN 12/515,707.
  misc_feature (38)..(183): Pfam Name: DUF584 Pfam Description: DUF584
  misc_feature (1)..(183): Functional Homolog Of Ceres ANNOT ID no. 864102
MATSRIFFGSKPRYIYPTMEFDDGNLINNPSFDHRHHHLLEFDEVDVWNNSNDQATTNLEAKKPLPSYRASSKKAFKKKEFQISDNNNHRSAQMTAASASLPVNIPDWSKILKAEYREHGKTDEDAVDGDDDGDRDGRVPPHEYLARRRGASFSVHEGIGRTLKGRDLRRVRNAVWKKTGFED

SEQ ID NO: 2597 - protein, 163 aa, Vitis vinifera
  misc_feature (1)..(163): useful for making plants with increased heat tolerance as described in USSN 12/515,707
  misc_feature (1)..(163): Public GI ID no.147835635
  misc_feature (1)..(163): Score of 162.0 for HMM of FIGURE 3 of USSN 12/515,707.
  misc_feature (32)..(163): Pfam Name: DUF584 Pfam Description: DUF584
  misc_feature (1)..(163): Functional Homolog Of Ceres ANNOT ID no. 864102
MATRRSYLTRPSYVYLAGEKSSSNNEEITDDIGLEFDESEVWNSGQVPSPDPFKKPIPSSRASKKPVSKKMGSVTATSLPVNIPDWSKILRDDYRLSQRKESDEDVDDVEEDDDHDSRIPPHEYLARTRVASFSVHEGIGRTLKGRDLSRVRNAIWKKVGFED

SEQ ID NO: 2598 - DNA, 681 bp, Populus balsamifera subsp. trichocarpa
  misc_feature (1)..(681): useful for making plants with increased heat tolerance as described in USSN 12/515,707
  misc_feature (1)..(681): Ceres ANNOT ID no.1528670
atggaccccgcctcccgttaccgtttcctcggcatcccctcctccacttcctcctcctcctccttggccgacggaaacggtgacagtaacggtaacggagatgagctcaacgaggatgatattctctggaccaacgattacaccgatcaaagcctaagcaattcctcctcctcctctccaacaaccacctccgccaacaacctccaaagtaaatctaaccacctcacagctttccctaagaactcgggcattctcgcggcgttaccagaaaccaaccacaacacggttctctaccgcaagccatcacttccatcatcatcatcatcatcttcttcgtcgtcgtctagagcaatcccattaattccaagatcacctcacgttgcggaatacgcgtcgcagtcggtaccgataaggaaattgaaccagtcggccccgatgaatgtgccggtgttgtcgattgcaatggcgaaacagaggaatagcaggtttaaggaggatgatgatggtgagtttgatggagacgaagagatgttgccgcctcatgagattgtggcacgagggtcgaggcggtcgccgaagacaacattttcggttctcgaaggggttgggaggacgttgaaaggaagggatctgagacaggttaggaatgctgtttggcgtcaaactgggtttcttgattga

SEQ ID NO: 2599 - protein, 226 aa, Populus balsamifera subsp. trichocarpa
  misc_feature (1)..(226): useful for making plants with increased heat tolerance as described in USSN 12/515,707
  misc_feature (1)..(226): Ceres ANNOT ID no.1528670
  misc_feature (1)..(226): Score of 48.2 for HMM of FIGURE 3 of USSN 12/515,707.
  misc_feature (142)..(226): Pfam Name: DUF584 Pfam Description: DUF584
  misc_feature (1)..(226): Functional Homolog Of Ceres ANNOT ID no. 864102
MDPASRYRFLGIPSSTSSSSSLADGNGDSNGNGDELNEDDILWTNDYTDQSLSNSSSSSPTTTSANNLQSKSNHLTAFPKNSGILAALPETNHNTVLYRKPSLPSSSSSSSSSSSRAIPLIPRSPHVAEYASQSVPIRKLNQSAPMNVPVLSIAMAKQRNSRFKEDDDGEFDGDEEMLPPHEIVARGSRRSPKTTFSVLEGVGRTLKGRDLRQVRNAVWRQTGFLD

SEQ ID NO: 2600 - DNA, 762 bp, Glycine max
  misc_feature (1)..(762): useful for making plants with increased heat tolerance as described in USSN 12/515,707
  misc_feature (1)..(762): Ceres CLONE ID no.746426
gagagcaattgagaacgttcaaactccacaactaacaaagattatccaaagtgcgattcgcatggccaccaacattcgtagagcaacctatcgctttctccctgccatggacacagattctttctccgattccaccttcgaattccacgaatccgatctctacaactccgcgcgcgctaactctcccgaacttgccaaatccgtacgctcctccagatttcacaactactcctcttcctctgccgcccgcgtcggtgctccggcgtcgcttccggtgaacgtgccggactggtcgaagattctcggcgatgagtacggacggaaccagaggaggaactacgacgacgacgacgaagcgcggagcgatgaggaagatggagttgggagagtgcctccgcacgagtttctggcgaggacgagaatcgcttcgttctcggtgcacgaaggagttgggaggactctcaaaggacgcgatctcagtagggttcgaaacgcgatttgggctaaaacgggattccaggactagacccttaccataggatgataggatcataacataagttaattaccgtattaatttactactgtattaccaattgaaacgacttttgttgagaggtcatttttagatttttcattttttcgatcagcatctatgtgtatcagatcggaatttgagattttaatttgcaccgagagctttttgttttacatattgtcattgttgtcgtttattattatctttcaaaaaaaaaaaaaaaa

SEQ ID NO: 2601 - protein, 154 aa, Glycine max
  misc_feature (1)..(154): useful for making plants with increased heat tolerance as described in USSN 12/515,707
  misc_feature (1)..(154): Ceres CLONE ID no.746426
  misc_feature (1)..(154): Score of 134.3 for HMM of FIGURE 3 of USSN 12/515,707.
  misc_feature (24)..(154): Pfam Name: DUF584 Pfam Description: DUF584
  misc_feature (1)..(154): Functional Homolog Of Ceres ANNOT ID no. 864102
MATNIRRATYRFLPAMDTDSFSDSTFEFHESDLYNSARANSPELAKSVRSSRFHNYSSSSAARVGAPASLPVNVPDWSKILGDEYGRNQRRNYDDDDEARSDEEDGVGRVPPHEFLARTRIASFSVHEGVGRTLKGRDLSRVRNAIWAKTGFQD

SEQ ID NO: 2602 - protein, 218 aa, Vitis vinifera
  misc_feature (1)..(218): useful for making plants with increased heat tolerance as described in USSN 12/515,707
  misc_feature (1)..(218): Public GI ID no.147859799
  misc_feature (1)..(218): Score of 48.9 for HMM of FIGURE 3 of USSN 12/515,707.
  misc_feature (134)..(218): Pfam Name: DUF584 Pfam Description: DUF584
  misc_feature (1)..(218): Functional Homolog Of Ceres ANNOT ID no. 864102
METKRSSNSSHRRSTTARLLGVPSGQSGPSTGDSSFSGGDFSEDDVFWTSDLVEPNHLRNNPFGAGKSNDHFRTPESHGILATLPDSDQNMTIETPPMLNRKTSFPSSIRAVPAIPKPPHISLENKHSQSVPIRRFHQSAPMNIPVLSKARSSSLAQADDEDDEAEDEMLPPHEIVARGSRRSPKTTSSVLEGVGRTLKGRDLRQVRNAVWRKTGFLD

SEQ ID NO: 2603 - DNA, 585 bp, Sorghum bicolor
  misc_feature (1)..(585): useful for making plants with increased heat tolerance as described in USSN 12/515,707
  misc_feature (1)..(585): Ceres ANNOT ID no.6032369
atggccaaggcgcgcaggccgccgttcgccgccgccgagcggttcctcggcttcccccgcggcgggccgtctccgggggccgtggcgccggcgcccgccgccgacttcgacgacctgccggacctcgccgaggccgacgtgtggtacacggccgccggcggcggcggcgacccggggagcccctgccccgcggcgtcccgccaggtggaggtggagggcaggagcgccggcgggcagcgcggggccccgcggcgcggcgtgcagggagggctgagccaggcgttcggggacgggcctggcgggcggcaagtggcggcgtcggcgcccgtcgaggttcccgcgtggcccgcccgcttcgccgtcccggacgcggagccggcgctgctgttcgagatggagatgggggacgacgacgacgagggcgacggcaagcggggcgccggcgggtgggtgccgccgcacgtgtacctggcgcggcggcaggcgcgggcgtccgtggtggagggcgccgggcggacgctcaagggccgcgacatgtcgcgggtgcgcgacgccgtctggagccggacgggcttcgacggataa

SEQ ID NO: 2604 - protein, 194 aa, Sorghum bicolor
  misc_feature (1)..(194): useful for making plants with increased heat tolerance as described in USSN 12/515,707
  misc_feature (1)..(194): Ceres ANNOT ID no.6032369
  misc_feature (1)..(194): Score of 99.3 for HMM of FIGURE 3 of USSN 12/515,707.
  misc_feature (88)..(194): Pfam Name: DUF584 Pfam Description: DUF584
  misc_feature (1)..(194): Functional Homolog Of Ceres ANNOT ID no. 864102
MAKARRPPFAAAERFLGFPRGGPSPGAVAPAPAADFDDLPDLAEADVWYTAAGGGGDPGSPCPAASRQVEVEGRSAGGQRGAPRRGVQGGLSQAFGDGPGGRQVAASAPVEVPAWPARFAVPDAEPALLFEMEMGDDDDEGDGKRGAGGWVPPHVYLARRQARASVVEGAGRTLKGRDMSRVRDAVWSRTGFDG

SEQ ID NO: 2605 - DNA, 525 bp, Populus balsamifera subsp. trichocarpa
  misc_feature (1)..(525): useful for making plants with increased heat tolerance as described in USSN 12/515,707
  misc_feature (1)..(525): Ceres ANNOT ID no.1538337
atggcatcaaggaaccttttcaatgcaagagctaacaacaactaccctactccagggagtggtaataatccaatcactggtcatgacgacgtttttgagctcgacgaggctgatgtttgggattctaacgttgctccattgttggagagcaagaaaacgataccaagctcacgttgttcaaagagagctcttaggaagtttgatcacatggccaaggacgggaccccggtgacatgtgcatcattgccggtcaacataccagactggtccaagatttataacgatcatcaaaagaaggaggatattgagggcagtgttcatccggttgatgatgatactgactatgataatgatggtgacgacgacgacgacgatcaagacggtagagtgcctccacatgaatatttagcgaggaggagaggggcttctttctctgttcatgaagggataggaaggaccttgaaagggagggacttgcgccaggtgagaaatgcgatttggaagagagttggatttgaagattag

SEQ ID NO: 2606 - protein, 174 aa, Populus balsamifera subsp. trichocarpa
  misc_feature (1)..(174): useful for making plants with increased heat tolerance as described in USSN 12/515,707
  misc_feature (1)..(174): Ceres ANNOT ID no.1538337
  misc_feature (1)..(174): Score of 123.2 for HMM of FIGURE 3 of USSN 12/515,707.
  misc_feature (30)..(174): Pfam Name: DUF584 Pfam Description: DUF584
  misc_feature (1)..(174): Functional Homolog Of Ceres ANNOT ID no. 864102
MASRNLFNARANNNYPTPGSGNNPITGHDDVFELDEADVWDSNVAPLLESKKTIPSSRCSKRALRKFDHMAKDGTPVTCASLPVNIPDWSKIYNDHQKKEDIEGSVHPVDDDTDYDNDGDDDDDDQDGRVPPHEYLARRRGASFSVHEGIGRTLKGRDLRQVRNAIWKRVGFED

SEQ ID NO: 2607 - protein, 194 aa, Oryza sativa subsp. indica
  misc_feature (1)..(194): useful for making plants with increased heat tolerance as described in USSN 12/515,707
  misc_feature (1)..(194): Public GI ID no.125558521
  misc_feature (1)..(194): Score of 65.2 for HMM of FIGURE 3 of USSN 12/515,707.
  misc_feature (104)..(194): Pfam Name: DUF584 Pfam Description: DUF584
  misc_feature (1)..(194): Functional Homolog Of Ceres ANNOT ID no. 864102
MAKARKQQPQGPFAGGAAAGERSFLGFQYHHHHRGGSVAPAYGDDDDLPDLAEADVWYAPSSEGGADHRGGGGGGGGGGGLEIGGGGWGGGKHKVGGLSRAFADGRQVAASAPVQVPAWPGRYADPNQAAFAEEEKRREEEDDAGDGDGWVPPHVYLARRQARSSVVEGVGRTLKGRDASRVRDAVWSRTGFDG

SEQ ID NO: 2608 - protein, 196 aa, Oryza sativa subsp. japonica
  misc_feature (1)..(196): useful for making plants with increased heat tolerance as described in USSN 12/515,707
  misc_feature (1)..(196): Public GI ID no.115472367
  misc_feature (1)..(196): Score of 67.3 for HMM of FIGURE 3 of USSN 12/515,707.
  misc_feature (104)..(196): Pfam Name: DUF584 Pfam Description: DUF584
  misc_feature (1)..(196): Functional Homolog Of Ceres ANNOT ID no. 864102
MAKARKQQPQGPFAGGAAAGERSFLGFQYHHHHRGGSVAPAYGDDDDLPDLAEADVWYAPSSEGGADHRGGGGGGGGGGGLEIGGGGWGGGKHKVGGLSRAFADGRQVAASAPVQVPAWPGRYADPDQAAFAEEEKRREEEDDAGDGDGDGWVPPHVYLARRQARSSVVEGVGRTLKGRDASRVRDAVWSRTGFDG

SEQ ID NO: 2609 - protein, 163 aa, Arabidopsis thaliana
  misc_feature (1)..(163): useful for making plants with increased heat tolerance as described in USSN 12/515,707
  misc_feature (1)..(163): Public GI ID no.15239410
  misc_feature (1)..(163): Score of 230.7 for HMM of FIGURE 3 of USSN 12/515,707.
  misc_feature (29)..(163): Pfam Name: DUF584 Pfam Description: DUF584
  misc_feature (1)..(163): Functional Homolog Of Ceres ANNOT ID no. 864102
MATGKSYYARPSYRFLGTDQPSYFTASDSGLEFDESDLFNPIHSDSPDFCRKISSSVRSGKKSSNRPSAASSAAAASSLPVNVPDWSKILRGEYRDNRRRSIEDNDDDDDDNEDGGDWLPPHEFLAKTRMASFSVHEGVGRTLKGRDLSRVRNAIFEKFGFQD

SEQ ID NO: 2610 - DNA, 725 bp, Zea mays
  misc_feature (1)..(725): useful for making plants with increased heat tolerance as described in USSN 12/515,707
  misc_feature (1)..(725): Ceres CLONE ID no.1377080
atattaatcatcccattcccagctatctatctcctagaaaaacaatctgattcttttcgcctaatattagctggagacgaaaccctagattttgtcaagctcgaagaagaagaaatcatggcaggagttggaccgatgacgcaagattgggagccggtggtgatccgaaagagagcccctaactccgccgccaagcgcgacgagaaaaccgtcaacgccgctcgtcgatccggcgccgatatcgaatccgtcagaaaatacaatgctggaaccaacaaggcagcctcaagtggcacatctctcaacactaaaaggcttgatgacgacactgagaacctcgctcatgagcgtgtgcctactgagcttaagaaagccattatgcaagctcgaactgacaagaagcttacccagtcccaacttgctcaaatcatcaatgagaagccacaagtgatccaagagtatgagtctggtaaagcgatccccaaccagcagatcctttctaagcttgagagagctcttggagctaaacttcgtggtaagaagtgatcatcatcaattcctgaagatgaacatcacttaattgcagtttcactattcttaatgactctgtggtaacaacaatcagtgctttgatgtaatgtcgtaacttttctaaagaacaatcttttctcatgtaagaaagatagaaccgtttgaatgtttggttgataaaaaaaaaaaaaaaa

SEQ ID NO: 2611 - DNA, 733 bp, Zea mays
  misc_feature (1)..(733): useful for making plants with increased heat tolerance as described in USSN 12/515,707
  misc_feature (1)..(733): Ceres CLONE ID no.1217994
agtttatcttcttgtctctctctcatttcttgttattatccacgaacgaagaaaaacctagaaaacagttgaagaaagaaaatcacaagagaagccatggccggaattggaccgattactcaggattgggaaccagttgtgatccgcaagagagctcctaacgctgcagctaagcgcgacgagaagactgtcaacgccgctcgtcgaagcggcgccgatattgagaccgttcgaaaattcaatgctggatcgaacaaggctgcatcaagcggcacctccttgaacacaaagaagctagatgatgatactgagaacttatctcatgatcgtgtgcccactgaattgaagaaagccatcatgcaagctagaggggagaagaagctgactcagtcccaacttgcccatctgatcaatgagaagccacaagtgatccaagaatacgagtcggggaaagcaattccgaatcaacagatcctttcaaagctggagagggcacttggtgctaaactccgtggaaagaagtagaagtttagaacaaagctcttaaaggtaacaacaaaagctgatcgcagtttctctccagtccacatgctttaccatatcctaaaaactatatctatgtatggtttggtttaatggcgtagtagtttgttgcgaggaatctttcatgatgtaagaaaaacaaagctgtttggaaccttttgtcattataaataatctcttctctttcaag

SEQ ID NO: 2612 - DNA, 656 bp, Glycine max
  misc_feature (1)..(656): useful for making plants with increased heat tolerance as described in USSN 12/515,707
  misc_feature (1)..(656): Ceres CLONE ID no.1057375
gaacgaaaggaaaccctaagattgcacaaaggagacgaaagcatggcaggaactggaccgatgactcaggactgggagcccgtggtgatccgcaagagagcccctaactccgccgccaagcgcgacgagaaaactgtcaacgccgctcgtcgcgccggcgccgatatcgaaaccgtccgaaaatataatgctggaacgaacaaggcagcatcaagcagcacttctctcaacacaaagacgcttgatgacgacactgagaaccttactcatgagcgtgtgcctactgagctaaagaaagctattatgcaagcccgcactgagaagaagctaacccagtcccaacttgctcaactcatcaatgagaagccacaagtgatccaagagtacgagtctggtaaagctatccccaaccagcagatcctttctaagctcgagagagctcttggtgctaaactccgtggaaagaagtgatgaatgatcaagtcctcatgaagattaacaaaaatcttaatcgctctttcacttttcttaatgactatgtggtaaacaacaatctgtgctttcatgtaatgtcgtcaactctttgccaagagtaaccgtttgaaagtttcgtttatgttttcactcttataatctttgggagtattgttataagc

SEQ ID NO: 2613 - DNA, 680 bp, Triticum aestivum
  misc_feature (1)..(680): useful for making plants with increased heat tolerance as described in USSN 12/515,707
  misc_feature (1)..(680): Ceres CLONE ID no.897172
attattttcttgtcgttgagaagcttcgcgaacaaaagcaaagaaccctagacagtcacagaaccattccatagaaatgtcaggtgttggccctctttctcaagattgggaacccgtcgtcctccgcaagaaggctcccactgccgccgccaagaaggatgagaaagccgtcaacgccgcccgccgctccggcgccgaaatcgaaaccctaaaaaaatataatgctgggacaaataaagcagcatctagcagcacttcattgaacactaagaggctggatgatgatactgagagtctagctcatgagaaggtaccaactgaacttaagaaggccataatgcaagctaggatggacaagaaacttactcagtctcagcttgctcaactgatcaatgagaagcctcaagtgatccaggagtacgagtcaggaaaggccattccaaaccagcagataattggcaagttggaaagagcccttggagctaaattgcgtggcaagaaataaggaacttaatgtcatgttgcgcgtttattttgctatgcatgtcactatgggagtgttttgtgtttgttagctaattgtgtatatttaagacagttaaaatggttgtgttgacatgtgcctttctcctgttcggataaataaagttgcattttcagtaataaaaaaaaaaaaaaaa

SEQ ID NO: 2614 - DNA, 681 bp, Zea mays
  misc_feature (1)..(681): useful for making plants with increased heat tolerance as described in USSN 12/515,707
  misc_feature (1)..(681): Ceres CLONE ID no.1592023
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
aagcgttcccttcgttgcgtcttgaaaggggagagagagagagagaagagagagagaagagagagagagagagaggagtgggagacccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataatagggggaagannnggcaagctgtctgcttatttgtctatgtttggtatctcaagtcctgcggactgtttct

SEQ ID NO: 2615 - DNA, 816 bp, Triticum aestivum
  misc_feature (1)..(816): useful for making plants with increased heat tolerance as described in USSN 12/515,707
  misc_feature (1)..(816): Ceres CLONE ID no.638938
gagaaccaccgattgcgactcgagaacctttcgttcatctccaaaaatatcttcctcctctttcctgcgcctccattatcccttgcgtggttttagtctgtgaactcgagagaccgagcgaggaaagttgccgtgtgagacctgagagttaggagatatggctgggattggtcctatcaggcaggactgggagccgatagtggtgcggaagaaggcgcagaacgccgccgacaagaaggacgaaaaggccgtcaacgctgcccgccgctccggcgccgagatcgacaccaccaagaagtacaacgctggaacgaacaaggctgcatctagcggaacttccctcaacaccaagcggctcgacgacgacaccgagaacctttcccatgagcgtgtttcaagtgacctcaagaaaaaccttatgcaagcaaggctggataagaagatgacccaggcacaacttgctcagatgatcaatgagaagccacaggtgatccaggagtacgagtcgggcaaagcgattccgaacaatcagataattggaaagcttgagagggcacttggagctaagctgcgtagcaagaagtaatgccttgaagtagcccaaaagctcttgtaggctgttgctgttggttgatactgaataactatgccacagaacgactttatgtatcattatattctcgtgctctaaaatgtgtttgtcatatgtcccagtgtaagagctgcattgaacatgcagactgacatgataacctgcgtggtttatgcgtggtgtttgtcactggcttttgctaatacaagtttctattgtgagcc

SEQ ID NO: 2616 - DNA, 684 bp, Triticum aestivum
  misc_feature (1)..(684): useful for making plants with increased heat tolerance as described in USSN 12/515,707
  misc_feature (1)..(684): Ceres CLONE ID no.1330232
gagaacctttcgttcatctccaaaaatatcttcctcctctttcctgcgcctccattatcccttgcgtggttttagtctgtgaactcgagagaccgagcgaggaaagttgccgtgtgagacctgagagttaggagatatggctgggattggtcctatcaggcaggactgggagccgatagtggtgcggaagaaggcgcagaacgccgccgacaagaaggacgaaaaggccgtcaacgctgcccgccgctccggcgccgagatcgacaccaccaagaagtacaacgctggaacgaacaaggctgcatctagcggaacttccctcaacaccaagcggctcgacgacgacaccgagaacctttcccatgagcgtgtttcaagtgacctcaagaaaaaccttatgcaagcaaggctggataagaagatgacccaggcacaacttgctcagatgatcaatgagaagccacaggtgatccaggagtacgagtcgggcaaagcgattccgaacaatcagataattggaaagcttgagagggcacttggagctaagctgcgtagcaagaagtaatgccttgaagtagcccaaaagctcttgtaggctgttgctgttggttgatactgaataactatgccacagaacgactttatgtatcattatattctcgtgctctaaaaaaaaaaaaaaaa

SEQ ID NO: 2617 - DNA, 804 bp, Glycine max
  misc_feature (1)..(804): useful for making plants with increased heat tolerance as described in USSN 12/515,707
  misc_feature (1)..(804): Ceres CLONE ID no.1027534
accgattgcgactcgagaacctttcgttcatctccaaaatatcttcctcctctgttctgcgcctccagccctccactatcccttgcgtggttttagtctgtgaactcgagagaccgagcgaggaaagttgccgtgtgagacctgaaagttagggagatatggctgggattggtcctatcaggcaggactgggagccgatagtggcgcggaagaaggcgcagaacgccgccgacaagaaggacgaaaaggccgtcaacgctgcccgccgctccggcgccgagatcgacaccaccaagaagtacaacgctggaacgaacaaggctgcatctagcggaacttccctcaacaccaagcggctcgacgacgacacggagaacctttcccatgagcgtgtttcaagtgacctgaagaaaaaccttatgcaagcaagactggataagaagatgacccaggcacaacttgctcagatgatcaatgagaagccacaggtgatccaggagtacgagtcgggcaaggcgattccgaacaatcagataattggaaagctcgagagggcacttggagctaagctgcgtagcaagaagtaatgccttgaaggccaagccctgtctatttgccttacactgcatttgctaggtcctaaaagctcttacaggctgtttctgttggttgatactgaataactatgccacagaacgactttatgtatcattatattcccgtgttctaaaatgtgtcgtcatatgacccagtgtaagagctgcattgagcatgcagattgacatggcaaaaaaaaaaaaaaaa

SEQ ID NO: 2618 - DNA, 890 bp, Zea mays
  misc_feature (1)..(890): useful for making plants with increased heat tolerance as described in USSN 12/515,707
  misc_feature (1)..(890): Ceres CLONE ID no.1386483
aaacaaggtaatctgagtcgagaaagcttagctagcccagcggcccagccctatccagaagctgccccttccgcggttccgcctctatttcttgtcctccgcctccatttcgcgttccctgcgttgcgtcttgagagggagagagagaggagtgggagacccgcgagaggctgccgtgtagggaccaccgtagactcagcgtctcagctactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaaacgcctcgacgacgacaccgagaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataatagggggaagacaaggcaagctgtctgcttatttgtctatgtttggtatctcaagtcctgcggactgtttctgttggcacaagagggaataaatgtgttcacggacctgtaatgcttgctccttgtcatatgaccttgctctaaacatttgtgatgaagctgtcaaggtaatatattttctctaaatatttagcct

SEQ ID NO: 2619 - DNA, 803 bp, Triticum aestivum
  misc_feature (1)..(803): useful for making plants with increased heat tolerance as described in USSN 12/515,707
  misc_feature (1)..(803): Ceres CLONE ID no.1031619
cccgatcattcgcaccgaccacatcctcatcgtctccaacctcggcgaaaccctagcctagccccgccgaatcgcgagtccccccgaagccggagcaagccgagatgtcccgcaccggaccgatcgcccaggactgggagccggtggtcgtgcgcaagaagctgcccaacgccgccgccaagaaggacgagaaggccgtcaacgccgcccgccgcgccggcgtcgacatcgacatcgccaagaagcataatgctgggacaaacaaagctgctcatagcaccacatcgctcaatacaaagaggcttgatgatgatacagagaatcttgctcatgagcgtgtgccgtcagacctgaagaagagcattatgcaggctagaacggacaagaagctcacacaggcacagcttgcacagctgatcaatgagaagccacaagtcatccaggagtacgagtcaggcaaggctatcccaaaccaacagatcatcggcaagctggaaagggctcttggcacaaagctgcgaggcaagaagtgaagctgcgtgtgcatctgacaggagtcgaggctttcaagagagcttggctgggcaagtttaccgctaaataaagcttgtctactaaatcatgcgacttaagaaaaccccggagtttggtatttcgctcaggtttgggtgaatgtaattattagcttctgtgaacaactctgtatctgggtttcgtttcgtcagcgtgtcttcgtgaatgtgaactgttctgaatgcctgaacctttatataacttgtctctgttgaaaaaaaaaaaaaaaa

SEQ ID NO: 2620 - DNA, 808 bp, Glycine max
  misc_feature (1)..(808): useful for making plants with increased heat tolerance as described in USSN 12/515,707
  misc_feature (1)..(808): Ceres CLONE ID no.1075173
aaccccgatcattcgcaccgaccacatcctcatcgtctccaacctcggcgaaaccctagcctagccccgccgaatcgcgagtccccccgaagccggagcaagccgagatgtcccgcaccggaccgatcgcccaggactgggagccggtggtcgtgcgcaagaagctgcccaacgccgccgccaagaaggacgagaaggccgtcaacgccgcccgccgcgccggcgtcgacatcgacatcgccaagaagcataatgctgggacaaacaaagctgctcataccaccacatcgctcaatacaaagaggcttgatgatgatacagagaatcttgctcatgagcgtgtgccgtcagacctgaagaagagcattatgcaggctagaacggacaagaagctcacacaggcacagcttgcacagctgatcaatgagaagccacaagtcatccaggagtacgagtcaggcaaggctatcccaaaccaacagatcatcggcaagctggaaagggctcttggcacaaagctgcgaggcaagaagtgaagctgcgtgtgcatctgacaggagtcgaggctttcaagagagcttggctgggcaagtttaccgctaaataaagcttgtctactaaatcatgcgacttaagaaaaccccggagtttggtatttcgctcaggtttgggtgaatgtaattattagcttctgtgaacaactctgtatctgggtttcgtttcgtcagcgtgtcttcgtgaatgtgaactgttctgaatgcctgaacctttatataacttgtctctgttgccaaaaaaaaaaaaaaaa

SEQ ID NO: 2621 - DNA, 654 bp, Parthenium argentatum
  misc_feature (1)..(654): useful for making plants with increased heat tolerance as described in USSN 12/515,707
  misc_feature (1)..(654): Ceres CLONE ID no.1609842
atccatccacttaactccttcctgttcctaatcaccaaaaatgtcaggttttgcacaggactgggagccggtggtcatccgtaagaaagctccgacctccgccgctcgtaaggacgagaaagccgtcaacgccgcccgccgcgccggtgccgagatcgagaccgttaaaaaagctgctgcgggttcaaacaaggctgcctctagcagtacttctctgaacactagaaagcttgatgaagagactgaaaatctctcccatgataaggtaccaactgaattgaagaaagctatcatccagggtcgcaccgagaagaagcttactcaagctcaacttgctcagctgattaatgagaagccccagatcatacaggagtatgaatctggaaaggctataccaaatcaacagataataaccaaactggaaagggctcttggtgtgaaacttaggggtaagaaatagaacagtagcagctggccgctctgtggaggtcccgttctactaaaaatgaaaaaaataaaggagttggggtgcacaaaaccttctgtttctatttgaccacttcttttctggagatggattctgttattgtggattttatgtttgggtgttgacaagtcttgagatgctctgatgtgtttatcataaatgccaca

SEQ ID NO: 2622 - DNA, 682 bp, Zea mays
  misc_feature (1)..(682): useful for making plants with increased heat tolerance as described in USSN 12/515,707
  misc_feature (1)..(682): Ceres CLONE ID no.1159254
aacttgtcacctgcagagaaagaaagaagccctagattttgtcaaaaggcggttgcagaacaaaaaaccatggccggaattggaccgataactcaggattgggagccggtggtgatccgtaagaaacccgctaacgccgctgccaagcgcgacgagaaaactgtcaacgccgctcgtcgatccggcgccgatatcgagaccgtcagaaaattcaatgctggaaccaacaaggcggcatcaagcggcacatctctgaacacaaaaatgcttgatgatgacactgagaaccttactcatgaacgtgtgcctactgagctaaagaaagccattatgcaagccaggacagacaagaagctaacccagtcccaacttgctcaaatcatcaatgagaagccacaagtgattcaagagtatgagtctggcaaagctatacccaaccagcaaatcctttctaagctggagagagcgcttggagctaagcttcgtggaaagaagtgagccaagttctactgatgtagcaagtaacaagaatcaatgctttcgtctaatgccgtaactttgccaagaagaatattttctgattgtaagaaagcaaaaccgtttgaatgtttgtttcgttgatggaatctctatctcataaactcatatcaatataataacttgggtcttttcatcacataag

SEQ ID NO: 2623 - protein, 142 aa, Zea mays; identical to SEQ ID NO: 2523
  misc_feature (1)..(142): useful for making plants with increased heat tolerance as described in USSN 12/515,707
  misc_feature (1)..(142): Ceres CLONE ID no.1159254
  misc_feature (1)..(142): Score of 371.9 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448

SEQ ID NO: 2624 - protein, 142 aa, Arabidopsis thaliana; identical to SEQ ID NO: 2551
  misc_feature (1)..(142): useful for making plants with increased heat tolerance as described in USSN 12/515,707
  misc_feature (1)..(142): Public GI ID no.15231105
  misc_feature (1)..(142): Score of 368.6 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448

SEQ ID NO: 2625 - DNA, 629 bp, Brassica napus
  misc_feature (1)..(629): useful for making plants with increased heat tolerance as described in USSN 12/515,707
  misc_feature (1)..(629): Ceres CLONE ID no.1085665
gaaaggaaaccctaagattgcacaaaggagacgaaagcatggcaggaactggaccgatgactcaggactgggagcccgtggtgatccgcaagagagcccctaactccgccgccaagcgcgacgagaaaactgtcaacgccgctcgtcgcgccggcgccgatatcgaaaccgtccgaaaatataatgctggaacgaacaaggcagcatcaagcagcacttctctcaacacaaagacgcttgatgacgacactgagaaccttactcatgagcgtgtgcctactgagctaaagaaagctattatgcaagcccgcactgagaagaagctaacccagtcccaacttgctcaactcatcaatgagaagccacaagtgatccaagagtacgagtctggtaaagctatccccaaccagcagatcctttctaagctcgagagagctcttggtgctaaactccgtggaaagaagtgatgaatgatcaagtcctcatgaagattaacaaaaatcttaatcgctctttcacttttcttaatgactatgtggtaaacaacaatctgtgctttcatgtaatgtcgtcaactctttgccaagagtaaccgtttgaaagttaaaaaaagaaaaaaaaaaaaaaaa

SEQ ID NO: 2626 - protein, 142 aa, Brassica napus; identical to SEQ ID NO: 2525
  misc_feature (1)..(142): useful for making plants with increased heat tolerance as described in USSN 12/515,707
  misc_feature (1)..(142): Ceres CLONE ID no.1085665
  misc_feature (1)..(142): Score of 373.7 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448

SEQ ID NO: 2627 - DNA, 653 bp, Brassica napus
  misc_feature (1)..(653): useful for making plants with increased heat tolerance as described in USSN 12/515,707
  misc_feature (1)..(653): Ceres CLONE ID no.1123572
aacgaaaggaaccctaagattgagtttgattgcacaaaggagaacgaaagcatggcaggaactggaccgatgactcaggactgggagcccgtggtgatccgcaagagagcccctaactccgccgccaagcgcgacgagaaaactgtcaacgccgctcgtcgcgccggcgccgatatcgaaaccgtccgaaaatataatgctggaacgaacaaggcagcatcaagcagcacttctctcaacacaaagacgctcgatgacgacactgagaaccttactcatgagcgtgtgcctactgagctaaagaaagctattatgcaagcccgcactgagaagaagctaacccagtcccaacttgctcaactcatcaatgagaagccacaagtgatccaagagtacgagtctggtaaagctatccccaaccagcagatcctttctaagctcgagagagctcttggtgctaaactccgtggtaagaagtgatgatcatcaagtcctcatgaagattaacaaaaatcttaatcgctctttcacttttcttaatgactatgtggtaaacaacaatctgtgctttcatgtaatgtcgtcaactctttgccaagagtaaccgtttgaaagtttcgtttatgttttcactcttaaaaaaaaaaaaaaaa

SEQ ID NO: 2628 - protein, 142 aa, Brassica napus; identical to SEQ ID NO: 2525
  misc_feature (1)..(142): useful for making plants with increased heat tolerance as described in USSN 12/515,707
  misc_feature (1)..(142): Ceres CLONE ID no.1123572
  misc_feature (1)..(142): Score of 373.7 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448

SEQ ID NO: 2629 - DNA, 605 bp, Triticum aestivum
  misc_feature (1)..(605): useful for making plants with increased heat tolerance as described in USSN 12/515,707
  misc_feature (1)..(605): Ceres CLONE ID no.1030587
gaaaggaaaccctaagattgcacaaaggagacgaaagcatggcaggaactggaccgatgactcaggactgggagcccgtggtgatccgcaagagagcccctaactccgccgccaagcgcgacgagaaaactgtcaacgccgctcgtcgcgccggcgccgatatcgaaaccgtccgaaaatataatgctggaacgaacaaggcagcatcaagcagcacttctctcaacacaaagacgcttgatgacgacactgagaaccttactcatgagcgtgtgcctactgagctaaagaaagctattatgcaagcccgcactgagaagaagctaacccagtcccaacttgctcaactcatcaatgagaagccacaagtgatccaagagtacgagtctggtaaagctatccccaaccagcagatcctttctaagctcgagagagctcttggtgctaaactccgtggaaagaagtgatgaatgatcaagtcctcatgaagattaacaaaaatcttaatcgctctttcacttttcttaatgactatgtggtaaacaacaatctgtgctttcatgtaatgtcgtcaactctttgccaagagtaaccgtttgaaagtt

SEQ ID NO: 2630 - protein, 142 aa, Triticum aestivum; identical to SEQ ID NO: 2525
  misc_feature (1)..(142): useful for making plants with increased heat tolerance as described in USSN 12/515,707
  misc_feature (1)..(142): Ceres CLONE ID no.1030587
  misc_feature (1)..(142): Score of 373.7 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448

SEQ ID NO: 2631 - protein, 142 aa, Vitis vinifera
  misc_feature (1)..(142): useful for making plants with increased heat tolerance as described in USSN 12/515,707
  misc_feature (1)..(142): Public GI ID no.147865629
  misc_feature (1)..(142): Score of 367.0 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448
MAGVGPLTQDWEPVVIRKKPLNAAAKKDEKAVNAARRSGAEIETLRKSHAGTNKAASSSTSLNTRKLDEETENLAHDRVPTELKKSIMQARMDKKLTQSQLAQMINEKPQIIQEYESGKAIPNQQIIVKLERALGVKLRGKK

SEQ ID NO: 2632 - protein, 142 aa, Vitis vinifera
  misc_feature (1)..(142): useful for making plants with increased heat tolerance as described in USSN 12/515,707
  misc_feature (1)..(142): Public GI ID no.147777777
  misc_feature (1)..(142): Score of 361.8 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448
MAGTGPLTQDWEPVVIRKKPLNAAAKKDEKAVNAARRMGAEIETVKKSSAGTNRAASSSTSLNTRKLDEETENLTHERVPTELKKSIMQARLDKKLTQAQLAQMINEKPQVIQEYESGKAIPNQQIITKLERALGVKLRGKK

SEQ ID NO: 2633 - DNA, 732 bp, Zea mays
  misc_feature (1)..(732): useful for making plants with increased heat tolerance as described in USSN 12/515,707
  misc_feature (1)..(732): Ceres CLONE ID no.418216
gttcccttcgttgcgtcttgaaaggggagagagagagagagaagagagagagaagaggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataatagggggaagacaaggcaagctgtctgcttatttgtctatgtttggtatctcaagtcctgcggactgtttctgttggcacaagagggaataaatgtgttcacggacctgtaatgcttgctccttgtcatatgaccttgctctaaacatttgtgatgaagctgtcaaggtaaatatattttctctaaatatttagcctaaaaaaaaaaaaaa

SEQ ID NO: 2634 - protein, 142 aa, Zea mays; identical to SEQ ID NO: 2553
  misc_feature (1)..(142): useful for making plants with increased heat tolerance as described in USSN 12/515,707
  misc_feature (1)..(142): Ceres CLONE ID no.418216
  misc_feature (1)..(142): Score of 368.5 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448

SEQ ID NO: 2635 - DNA, 786 bp, Panicum virgatum
  misc_feature (1)..(786): useful for making plants with increased heat tolerance as described in USSN 12/515,707
  misc_feature (1)..(786): Ceres CLONE ID no.1764141
acttcgcgtgctcttacgtttccgtgttgagagagagacagagaggacacgcgagaggctgccgtgtgggggccggagagtcagcgacagcgagggggagagaaggcgatggcggggatcgggccgatcaggcaggactgggagccggtggtggtgcggaagaaggcgcccaccgccgccgccaagaaggatgagaaggccgtcaacgccgcgcgccgctccggcgccgagatcgagaccatgaagaagtacaacgctgggacgaacaaggccacgtccagcggcacatcgctcaacaccaagcgactcgatgacgacactgagaatctagcccatgagcgtgtcccaagtgacctgaagaaaaacctcatgcaagcaaggctggataagaagatgacccaggcacagcttgctcagatgatcaatgagaagccacaggtgatccaggagtatgagtcgggcaaggcgatccctaaccagcagattattagcaagcttgagagggcactgggaacaaagctgcgcgggaagaaataactttaaaacttgtgccccggagcagcatgaagctgaagaagacaaggcagtctgtctgcttgttatctatgcttggtttttaatgtcatgcagactgtttctgtgtttagtacatgagtgaataacagtgtcgtggtggaccttgtaatgccttgctgcttttatgtgtcatatgactcctggtctgtgggctcctgcggatatgcttgtaggaatgtttttctctctcaaaaaaaaaaaaaaaaaaaa

SEQ ID NO: 2636 - protein, 142 aa, Panicum virgatum
  misc_feature (1)..(142): useful for making plants with increased heat tolerance as described in USSN 12/515,707
  misc_feature (1)..(142): Ceres CLONE ID no.1764141
  misc_feature (1)..(142): Score of 368.7 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448
MAGIGPIRQDWEPVVVRKKAPTAAAKKDEKAVNAARRSGAEIETMKKYNAGTNKATSSGTSLNTKRLDDDTENLAHERVPSDLKKNLMQARLDKKMTQAQLAQMINEKPQVIQEYESGKAIPNQQIISKLERALGTKLRGKK

SEQ ID NO: 2637 - DNA, 429 bp, Sorghum bicolor
  misc_feature (1)..(429): useful for making plants with increased heat tolerance as described in USSN 12/515,707
  misc_feature (1)..(429): Ceres ANNOT ID no.6080640
atggccgggatcgggccgatcaggcaggactgggagccggtggtggtgcggaagaaggcacccaccgcagccgccaagaaggatgagaaggccgtcaacgccgcgcgccgcgccggcgccgagatcgagaccatgaagaagtacaacgctggcacgaacaaggcggcgtccagcggcacatccctcaacaccaagcgcctcgacgacgacactgaaaacctcgcccatgagcgagttccaagtgacctgaagaaaaatctcatgcaagcaaggctcgataagaagatgacccaggcacagcttgctcagatgatcaatgagaagccacaggtgatccaggagtatgagtcgggcaaggcaatccccaaccagcagatcattggcaagctcgagagggccctgggaacgaagctgcgtggcaagaaatag

SEQ ID NO: 2638 - protein, 142 aa, Sorghum bicolor
  misc_feature (1)..(142): useful for making plants with increased heat tolerance as described in USSN 12/515,707
  misc_feature (1)..(142): Ceres ANNOT ID no.6080640
  misc_feature (1)..(142): Score of 370.1 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448
MAGIGPIRQDWEPVVVRKKAPTAAAKKDEKAVNAARRAGAEIETMKKYNAGTNKAASSGTSLNTKRLDDDTENLAHERVPSDLKKNLMQARLDKKMTQAQLAQMINEKPQVIQEYESGKAIPNQQIIGKLERALGTKLRGKK

SEQ ID NO: 2639 - DNA, 706 bp, Gossypium hirsutum
  misc_feature (1)..(706): useful for making plants with increased heat tolerance as described in USSN 12/515,707
  misc_feature (1)..(706): Ceres CLONE ID no.1896466
aatccatttattattaccaacttctcaaaaatatcttttctctctttcatccaaaatacccaaaagtcaagagtagattaaactaatggccggaatcggacctttgactcaagattgggagcccgttgttattcgtaaaaaagcccctaccgccgccgccaagaaggatgagaaagtcgttaacgccgcccgccgtgccggtgccgagatcgagtccataaaaaaatcaaatgctgggacgaatagggcggcatcaagtagtacttctttgaacacaaggaagctcgatgaagacactgagaatcttgctcatgaccgagtgccaactgagctaaagaaagccatcatgcaagctcgaatggataagaaacttacccaggctcaacttgctcagatgatcaatgagaagcctcagattatacaggagtatgaatccggaaaagccatccctaaccaacaaataattggtaaactggagagggctcttggtgcgaagctgcgagggaagaagtgagtgagtaggagtctcgtagaaagaacaaacagaacttgaatatcgcccagaatcttgagtcctaaaacttggtgatgtaaatgaatgttttatgccgttatgggtcgcttgtaagaacactgtttttgactttgtgtgatgacttatgtctgcgactgcttatgaaatgaagtttgtgtgtgttcttgactg

SEQ ID NO: 2640 - protein, 142 aa, Gossypium hirsutum
  misc_feature (1)..(142): useful for making plants with increased heat tolerance as described in USSN 12/515,707
  misc_feature (1)..(142): Ceres CLONE ID no.1896466
  misc_feature (1)..(142): Score of 376.0 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448
MAGIGPLTQDWEPVVIRKKAPTAAAKKDEKVVNAARRAGAEIESIKKSNAGTNRAASSSTSLNTRKLDEDTENLAHDRVPTELKKAIMQARMDKKLTQAQLAQMINEKPQIIQEYESGKAIPNQQIIGKLERALGAKLRGKK

SEQ ID NO: 2641 - protein, 142 aa, Zea mays
  misc_feature (1)..(142): useful for making plants with increased heat tolerance as described in USSN 12/515,707
  misc_feature (1)..(142): Ceres Clone ID no.101115570
  misc_feature (1)..(142): Score of 368.8 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448
MAGIGPIRQDWEPVVVRKKAPTAAAKKDEKAVNAARRSGAEIETMKKYNAGMNKAASSGTSLNTKRLDDDTENLAHERVPSDLKKNLMQARLDKKLTQAQLAQMINEKPQVIQEYESGKAIPNQQIIGKLERALGTKLRGKK

SEQ ID NO: 2642 - protein, 142 aa, Oryza sativa subsp. japonica; identical to SEQ ID NO: 2535
  misc_feature (1)..(142): useful for making plants with increased heat tolerance as described in USSN 12/515,707
  misc_feature (1)..(142): Public GI ID no.115476102
  misc_feature (1)..(142): Score of 366.5 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448

SEQ ID NO: 2643 - DNA, 580 bp, Gossypium hirsutum
  misc_feature (1)..(580): useful for making plants with increased heat tolerance as described in USSN 12/515,707
  misc_feature (1)..(580): Ceres CLONE ID no.1833747
aaaaaacctcacctttttcatttgacaaacaatggccggaatcggacctttaacccaagactgggaacccgttgttattcgtaaaaaagccccaaccgccgccgccaagaaggatgagaaagtcgtaaacgccgctcgtcgtgctggtgccgagatcgaatccgtcaaaaaatcaaatgctgggacgaacagggccgcatcaagtagtacatctctgaacacaaggaagcttgatgaagaaactgaaaatcttgctcatgatcgagtgccaaccgaactgaagaaagccatcatgcatgctcgaatggaaaagaaacttacccaagcacaacttgctcagttgatcaatgagaaacctcagatcatacaagagtacgaatctggaaaagccattcctaaccaacagataatcggtaaactcgagagggctcttggtgcaaagctgcgaggtaagaagtaaggcgagagttgggtcttttttccttttgtggtgtaaatgaatgttctctaccattatggttttgcttgtaagaacagtgttttggactttgtggtgaccatgaaatgaagtgtgttcttt

SEQ ID NO: 2644 - protein, 142 aa, Gossypium hirsutum
  misc_feature (1)..(142): useful for making plants with increased heat tolerance as described in USSN 12/515,707
  misc_feature (1)..(142): Ceres CLONE ID no.1833747
  misc_feature (1)..(142): Score of 373.1 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448
MAGIGPLTQDWEPVVIRKKAPTAAAKKDEKVVNAARRAGAEIESVKKSNAGTNRAASSSTSLNTRKLDEETENLAHDRVPTELKKAIMHARMEKKLTQAQLAQLINEKPQIIQEYESGKAIPNQQIIGKLERALGAKLRGKK

SEQ ID NO: 2645 - DNA, 566 bp, Zea mays
  misc_feature (1)..(566): useful for making plants with increased heat tolerance as described in USSN 12/515,707
  misc_feature (1)..(566): Ceres CLONE ID no.1431041
aggaaagttgccgtgtgagacctgagagtcagggagatatggctgggattggtcctatcaggcaggactgggagccgatagtggtgcggaagaaggcgcagaacgccgccgacaagaaggacgaaaaggccgtcaacgctgcccgccgctccggcgccgagatcgacaccaccaagaagtacaacgctggaacgaacaaggctgcatctagcggaacttccctcaacaccaagcggctcgacgacgacaccgagaacctttcccatgagcgtgtttcaagtgacctgaagaaaaaccttatgcaagcaaggctggataagaagatgacccaggcacaacttgctcagatgatcaatgagaagccacaggtgatccaggagtacgagtcgggcaaggcgattccgaacaatcagataattggaaagctcgagagggcacttggagctaagctgcgtagcaagaagtaatgccttgaagtagccaagccctgtttacttgccttgcattacatttgctaggtcctaaaagcttttacaggctgttcctgttggttgatactgaataac

SEQ ID NO: 2646 - protein, 142 aa, Zea mays; identical to SEQ ID NO: 2552
  misc_feature (1)..(142): useful for making plants with increased heat tolerance as described in USSN 12/515,707
  misc_feature (1)..(142): Ceres CLONE ID no.1431041
  misc_feature (1)..(142): Score of 346.2 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448

SEQ ID NO: 2647 - DNA, 693 bp, Musa acuminata
  misc_feature (1)..(693): useful for making plants with increased heat tolerance as described in USSN 12/515,707
  misc_feature (1)..(693): Ceres CLONE ID no.1732715
aacctctcgttcctccgctggtcgcaaaaatctcgcctttgaaaccctaacctcgatccgagaggcgacgtcgatggccgggactggtccgatcgcgcaggactgggagcccgttgtgctccgcaagaaggcgcccaccgccgccgccaagaaggacgagaaggccgtcaacgccgcccgccgcagcggggccgacatcgagaccgtcaagaagtctaatgccggcacgaacaaggctgcttcaagcagcacgaccctgaatacaaggaagctggatgaggaaaccgagaacctttctcatgggcgagtgccgtctgaactgaagaaaaatctcatgcaagctcggctggacaagaagctaacccaggctcaacttgcacagcaaatcaatgagaagccccaagtgattcaagaatacgagtcagggaaggccattccaaatcaacagataattaccaaactggaaagggtgctcggggtgaagcttcgaggtaaaaagtagggagcaccacaccgccgtactaaaacgactatgataaggagatttcatatgcagggtctggctctgctccgcatgattgtggtttggcaccatgcatatttctctagtaataataagggcatgtttaactctttctatgtggttgctttgtctgtgacttgatatcagtttgagatcccatgtttgagtat

SEQ ID NO: 2648 - protein, 142 aa, Musa acuminata
  misc_feature (1)..(142): useful for making plants with increased heat tolerance as described in USSN 12/515,707
  misc_feature (1)..(142): Ceres CLONE ID no.1732715
  misc_feature (1)..(142): Score of 356.5 for HMM of FIGURE 2 of USSN 12/515,707.
  misc_feature (87)..(141): Pfam Name: HTH_3 Pfam Description: Helix-turn-helix
  misc_feature (9)..(79): Pfam Name: MBF1 Pfam Description: Multiprotein bridging factor 1
  misc_feature (1)..(142): Functional Homolog Of Ceres SEEDLINE ID no. ME04448
MAGTGPIAQDWEPVVLRKKAPTAAAKKDEKAVNAARRSGADIETVKKSNAGTNKAASSSTTLNTRKLDEETENLSHGRVPSELKKNLMQARLDKKLTQAQLAQQINEKPQVIQEYESGKAIPNQQIITKLERVLGVKLRGKK

SEQ ID NO: 2649 - protein, 139 aa, Solanum lycopersicum
  misc_feature (1)..(139): useful for making plants with increased heat tolerance as described in USSN 12/515,707
  misc_feature (1)..(139): Public GI ID no.117574665
  misc_feature (1)..(139): Score of 358.3 for HMM of FIGURE 2 of USSN 12/515,707.
  misc_feature (6)..(76): Pfam Name: MBF1 Pfam Description: Multiprotein bridging factor 1
  misc_feature (84)..(138): Pfam Name: HTH_3 Pfam Description: Helix-turn-helix
  misc_feature (1)..(139): Functional Homolog Of Ceres SEEDLINE ID no. ME04448
MSGISQDWEPVVIRKKAPTSAARKNEKAVNAARRSGAEIETVKKSNAGSNRAASSSTSLNTRKLDEDTENLSHEKVPTELKKAIMQARQDKKLTQSQLAQLINEKPQIIQEYESGKAIPNQQIISKLERALGAKLRGKK

SEQ ID NO: 2650 - protein, 140 aa, Solanum lycopersicum
  misc_feature (1)..(140): useful for making plants with increased heat tolerance as described in USSN 12/515,707
  misc_feature (1)..(140): Public GI ID no.109288142
  misc_feature (1)..(140): Score of 358.2 for HMM of FIGURE 2 of USSN 12/515,707.
  misc_feature (7)..(77): Pfam Name: MBF1 Pfam Description: Multiprotein bridging factor 1
  misc_feature (85)..(139): Pfam Name: HTH_3 Pfam Description: Helix-turn-helix
  misc_feature (1)..(140): Functional Homolog Of Ceres SEEDLINE ID no. ME04448
MSGGLSQDWEPVVIRKKAPTAAARKDEKAVNAARRSGAEIETIRKSTAGSNRAASSSTTLNTRKLDEDTENLAHQKVPTELKKAIMQARQDKKLTQSQLAQLINEKPQIIQEYESGKAIPNQQIISKLERALGAKLRGKK

SEQ ID NO: 2651 - protein, 139 aa, Solanum lycopersicum
  misc_feature (1)..(139): useful for making plants with increased heat tolerance as described in USSN 12/515,707
  misc_feature (1)..(139): Public GI ID no.109288140
  misc_feature (1)..(139): Score of 355.1 for HMM of FIGURE 2 of USSN 12/515,707.
  misc_feature (6)..(76): Pfam Name: MBF1 Pfam Description: Multiprotein bridging factor 1
  misc_feature (84)..(138): Pfam Name: HTH_3 Pfam Description: Helix-turn-helix
  misc_feature (1)..(139): Functional Homolog Of Ceres SEEDLINE ID no. ME04448
MAGLSQDWEPVVIRKKAPTAAARKDEKAVNAARRAGAEIETVRKATAGSNKAASSSTTLNTRKLDEDTENLSHQKVPTELKKAIMQARQDKKLTQSQLAQLINEKPQIIQEYESGKAIPNQQIISKLERALGAKLRGKK

SEQ ID NO: 2652 - DNA, 450 bp, Brassica napus
  misc_feature (1)..(450): useful for making plants with increased heat tolerance as described in USSN 12/515,707
  misc_feature (1)..(450): Ceres CLONE ID no.1103325
ctagaaaaacaatctgattcttttcgcctaatattagctggagacgaaaccctagattttgtcaagctcgaagaagaagaaatcatggcaggagttggaccgatgacgcaagattgggagccggtggtgatccgaaagagagcccctaactccgccgccaagcgcgacgagaaaaccgtcaacgccgctcgtcgatccggcgccgatatcgaatccgtcagaaaatacaatgctggaaccaacaaggcagcctcaagtggcacatctctcaacactaaaaggcttgatgacgacactgagaacctcgctcatgagcgtgtgcctactgagcttaagaaagccattatgcaagctcgaactgacaagaagcttacccagtcccaacttgctcaaatcatcaatgagaagccacaagtgatccaagagtatgagtctggtaaagcgatcccc

SEQ ID NO: 2653 - protein, 122 aa, Brassica napus
  misc_feature (1)..(122): useful for making plants with increased heat tolerance as described in USSN 12/515,707
  misc_feature (1)..(122): Ceres CLONE ID no.1103325
  misc_feature (1)..(122): Score of 288.0 for HMM of FIGURE 2 of USSN 12/515,707.
  misc_feature (87)..(122): Pfam Name: HTH_3 Pfam Description: Helix-turn-helix
  misc_feature (9)..(79): Pfam Name: MBF1 Pfam Description: Multiprotein bridging factor 1
  misc_feature (1)..(122): Functional Homolog Of Ceres SEEDLINE ID no. ME04448
MAGVGPMTQDWEPVVIRKRAPNSAAKRDEKTVNAARRSGADIESVRKYNAGTNKAASSGTSLNTKRLDDDTENLAHERVPTELKKAIMQARTDKKLTQSQLAQIINEKPQVIQEYESGKAIP

SEQ ID NO: 2654 - DNA, 456 bp, Populus balsamifera subsp. trichocarpa
  misc_feature (1)..(456): useful for making plants with increased heat tolerance as described in USSN 12/515,707
  misc_feature (1)..(456): Ceres ANNOT ID no.1519958
atgtcaggaccaatctcacaggactgggagccggtggtgatccgtaagaaagctcccaacgccgccgccaagaaggatgagaaggccgtcaacgccgcccgccgcgctggtgctgagatcgaaaccgtcaaaaaatcaactgctggtacaaacaaggccgcttctagcagcacttctttgaacacaaggaagctcgatgacgaaacagagaaccttactcaaaaactttctaaaacattctggtctcccacagatgaccgagtgccaactgaactgaagaaagcaattatgcaggctagaatggacaagaaacttacccaggctcaacttgcacaggtgatcaatgagaagccccagataattcaggagtatgaatctggaaaagccattcctaatcagcagattataggaaaactggagagggctcttggtgtgaagctacggggaaagaagtag

SEQ ID NO: 2655 - protein, 151 aa, Populus balsamifera subsp. trichocarpa
  misc_feature (1)..(151): useful for making plants with increased heat tolerance as described in USSN 12/515,707
  misc_feature (1)..(151): Ceres ANNOT ID no.1519958
  misc_feature (1)..(151): Score of 344.8 for HMM of FIGURE 2 of USSN 12/515,707.
  misc_feature (7)..(73): Pfam Name: MBF1 Pfam Description: Multiprotein bridging factor 1
  misc_feature (96)..(150): Pfam Name: HTH_3 Pfam Description: Helix-turn-helix
  misc_feature (1)..(151): Functional Homolog Of Ceres SEEDLINE ID no. ME04448
MSGPISQDWEPVVIRKKAPNAAAKKDEKAVNAARRAGAEIETVKKSTAGTNKAASSSTSLNTRKLDDETENLTQKLSKTFWSPTDDRVPTELKKAIMQARMDKKLTQAQLAQVINEKPQIIQEYESGKAIPNQQIIGKLERALGVKLRGKK

SEQ ID NO: 2656 - DNA, 621 bp, Populus balsamifera subsp. trichocarpa
  misc_feature (1)..(621): useful for making plants with increased heat tolerance as described in USSN 12/515,707
  misc_feature (1)..(621): Ceres ANNOT ID no.1466623
atgtcaggaccaatctcacaggactgggagccggtggtgatccgtaagaaagctcccaacgccgccgccaagaaggatgagaaggccgtcaacgccgcccgccgcgctggtgctgagatcgaaaccgtcaaaaaatcaactgctggtacaaacaaggccgcttctagcagcacttctttgaacacaaggaagctcgatgacgaaacagagaaccttactcaaaaactttctaaaacattctggtctcccacagatgaccgagtgccaactgaactgaagaaagcaattatgcaggctagaatggacaagaaacttacccaggctcaacttgcacaggtgatcaatgagaagccccagataattcaggagtatgaatctggaaaagccattcctaatcagcagattataggaaaactggagagggctcttggtgtgaagctacggggaaagaaattgacccggtcgatctggtggctggaccagaccgggtttactaaaagaccggctggggcaacagcccggttaaaccccgggcgacccggcgggtcgatccatgacccgggcgaaacaggacgagacctgatttttttttcttcaaatgtgagatttgaaacccattag

SEQ ID NO: 2657 - protein, 206 aa, Populus balsamifera subsp. trichocarpa
  misc_feature (1)..(206): useful for making plants with increased heat tolerance as described in USSN 12/515,707
  misc_feature (1)..(206): Ceres ANNOT ID no.1466623
  misc_feature (1)..(206): Score of 344.8 for HMM of FIGURE 2 of USSN 12/515,707.
  misc_feature (7)..(73): Pfam Name: MBF1 Pfam Description: Multiprotein bridging factor 1
  misc_feature (96)..(150): Pfam Name: HTH_3 Pfam Description: Helix-turn-helix
  misc_feature (1)..(206): Functional Homolog Of Ceres SEEDLINE ID no. ME04448
MSGPISQDWEPVVIRKKAPNAAAKKDEKAVNAARRAGAEIETVKKSTAGTNKAASSSTSLNTRKLDDETENLTQKLSKTFWSPTDDRVPTELKKAIMQARMDKKLTQAQLAQVINEKPQIIQEYESGKAIPNQQIIGKLERALGVKLRGKKLTRSIWWLDQTGFTKRPAGATARLNPGRPGGSIHDPGETGRDLIFFSSNVRFETH

SEQ ID NO: 2658 - DNA, 626 bp, Papaver somniferum
  misc_feature (1)..(626): useful for making plants with increased heat tolerance as described in USSN 12/515,707
  misc_feature (1)..(626): Ceres CLONE ID no.1628154
agaacaaaagctctctctgctaaaacaaaacgaagaaaccctagatacaaactctcaaagaagaagaaagatgtcaggattcacacaagattgggaaccagttgtgatccgtaagaaagcaccaacatccgctgctaagaaagatgagaaagctgtgaacgctgccagacgtgccggtgcagagattgaaactgttaagaaatctactgcgggaacaaataaagctgcctccagcggaacttcattgaacacgaggaaacttgatgaagaaacagacgttcttgcgcatgaaagagtaccatctgaactaaagaaaaacatcatgcaggctcgtttggacaagaaaatgactcaatctcaacttgcacagctgatcaatgagaagccacaaattgtccaggagtatgaatctgggaaggccataccaaaccaacagataattacaaagctggaaagggttcttggtgtgaagctccgaggaaagaagtaaaacaaaatccgcagtgaagaaggatactgaaagtcttcagtagggttctctgttgctattattactaatatgaaacgaatttagttttcagtatccatgaatttgaaaaaacccctaaaaagtggggcgatgatgt

SEQ ID NO: 2659 - protein, 139 aa, Papaver somniferum
  misc_feature (1)..(139): useful for making plants with increased heat tolerance as described in USSN 12/515,707
  misc_feature (1)..(139): Ceres CLONE ID no.1628154
  misc_feature (1)..(139): Score of 345.8 for HMM of FIGURE 2 of USSN 12/515,707.
  misc_feature (6)..(76): Pfam Name: MBF1 Pfam Description: Multiprotein bridging factor 1
  misc_feature (84)..(138): Pfam Name: HTH_3 Pfam Description: Helix-turn-helix
  misc_feature (1)..(139): Functional Homolog Of Ceres SEEDLINE ID no. ME04448
MSGFTQDWEPVVIRKKAPTSAAKKDEKAVNAARRAGAEIETVKKSTAGTNKAASSGTSLNTRKLDEETDVLAHERVPSELKKNIMQARLDKKMTQSQLAQLINEKPQIVQEYESGKAIPNQQIITKLERVLGVKLRGKK

SEQ ID NO: 2660 - DNA, 472 bp, Brassica napus
  misc_feature (1)..(472): useful for making plants with increased heat tolerance as described in USSN 12/515,707
  misc_feature (1)..(472): Ceres CLONE ID no.1090158
  misc_feature (458)..(458): y is t/u or c
atcccttgcgtggttttagtctgtgaactcgagagaccgagcgaggaaagttgccgtgtgagacctgagagtcagggagatatggctgggattggtcctatcaggcaggactgggagccgatagtggtgcggaagaaggcgcagaacgccgccgacaagaaggacgaaaaggccgtcaacgctgcccgccgctccggcgccgagatcgacaccaccaagaagtacaacgctggaacgaacaaggctgcatctagcggaacttccctcaacaccaagcggctcgacgacgacaccgagaacctttcccatgagcgtgtttcaagtgacctgaagaaaaaccttatgcaagcaaggctggataagaagatgacccaggcacaacttgctcagatgatcaatgagaagccacaggtgatccaggagtacgagtcgggcaaggcgattccgaacaatcagayaattggaaagctcg

SEQ ID NO: 2661 - protein, 130 aa, Brassica napus
  misc_feature (1)..(130): useful for making plants with increased heat tolerance as described in USSN 12/515,707
  misc_feature (1)..(130): Ceres CLONE ID no.1090158
  misc_feature (1)..(130): Score of 291.7 for HMM of FIGURE 2 of USSN 12/515,707.
  misc_feature (87)..(130): Pfam Name: HTH_3 Pfam Description: Helix-turn-helix
  misc_feature (9)..(79): Pfam Name: MBF1 Pfam Description: Multiprotein bridging factor 1
  misc_feature (1)..(130): Functional Homolog Of Ceres SEEDLINE ID no. ME04448
  misc_feature (126)..(126): Xaa is any aa, unknown or other
MAGIGPIRQDWEPIVVRKKAQNAADKKDEKAVNAARRSGAEIDTTKKYNAGTNKAASSGTSLNTKRLDDDTENLSHERVSSDLKKNLMQARLDKKMTQAQLAQMINEKPQVIQEYESGKAIPNNQXIGKL

SEQ ID NO: 2662 - DNA, 409 bp, Brassica napus
  misc_feature (1)..(409): useful for making plants with increased heat tolerance as described in USSN 12/515,707
  misc_feature (1)..(409): Ceres CLONE ID no.1080456
  misc_feature (382)..(382): m is a or c
  misc_feature (388)..(388): w is a or t/u
aagattgattgattgatttttgattggagaaggagacgaaaagcatggcaggaactggaccgatgactcaggactgggagcccgtggtgatccgtaagagagcccctaactccgccgccaagcgcgacgagaaaactgtcaacgccgctcgtcgcgccggcgccgatatcgaaaccgtcagaaaacataatgctggaaccaacaaggcagcatcaagcagcacttccctcaacacaaagacgcttgatgacgacactgagaaccttactcatgagcgtgtgcctacagagctaaagaaaactattatgcaagcccgcactgagaagaagctaacccagtcccaacttgctcaactcatcaatgagaagccacaagtgatccmagagtwcgagtctggtaaagctatccc

SEQ ID NO: 2663 - protein, 121 aa, Brassica napus
  misc_feature (1)..(121): useful for making plants with increased heat tolerance as described in USSN 12/515,707
  misc_feature (1)..(121): Ceres CLONE ID no.1080456
  misc_feature (1)..(121): Score of 266.3 for HMM of FIGURE 2 of USSN 12/515,707.
  misc_feature (87)..(121): Pfam Name: HTH_3 Pfam Description: Helix-turn-helix
  misc_feature (9)..(79): Pfam Name: MBF1 Pfam Description: Multiprotein bridging factor 1
  misc_feature (1)..(121): Functional Homolog Of Ceres SEEDLINE ID no. ME04448
  misc_feature (113)..(113): Xaa is any aa, unknown or other
  misc_feature (115)..(115): Xaa is any aa, unknown or other
MAGTGPMTQDWEPVVIRKRAPNSAAKRDEKTVNAARRAGADIETVRKHNAGTNKAASSSTSLNTKTLDDDTENLTHERVPTELKKTIMQARTEKKLTQSQLAQLINEKPQVIXEXESGKAI

SEQ ID NO: 2664 - DNA, 368 bp, Brassica napus
  misc_feature (1)..(368): useful for making plants with increased heat tolerance as described in USSN 12/515,707
  misc_feature (1)..(368): Ceres CLONE ID no.1067429
agacaacacaatctcaagagaagccatggcaggagtaggacctatgactcaggactgggagcccgtggtgatccgtaagaaagctcccaactctgccgctaagcgcgacgagaagactgtcaacgccgctcgaagaagcggcgccgatattgaatccgtcagaaaatacaatgctggaaccaacaaggcggcttcaagcggcacctccttgaacacgaagaggcttgatgatgacactgagaacttagctcatgaacgtgtgcctactgagttgaagaaagccatcatgcaagcccgatgcgagaagaagctgacccagtcccaacttgctcaactgatcaacgagaagccgcaagtgatccaagaat

SEQ ID NO: 2665 - protein, 114 aa, Brassica napus
  misc_feature (1)..(114): useful for making plants with increased heat tolerance as described in USSN 12/515,707
  misc_feature (1)..(114): Ceres CLONE ID no.1067429
  misc_feature (1)..(114): Score of 250.6 for HMM of FIGURE 2 of USSN 12/515,707.
  misc_feature (87)..(113): Pfam Name: HTH_3 Pfam Description: Helix-turn-helix
  misc_feature (9)..(79): Pfam Name: MBF1 Pfam Description: Multiprotein bridging factor 1
  misc_feature (1)..(114): Functional Homolog Of Ceres SEEDLINE ID no. ME04448
MAGVGPMTQDWEPVVIRKKAPNSAAKRDEKTVNAARRSGADIESVRKYNAGTNKAASSGTSLNTKRLDDDTENLAHERVPTELKKAIMQARCEKKLTQSQLAQLINEKPQVIQE

SEQ ID NO: 2666 - DNA, 1425 bp, Gossypium hirsutum; identical to SEQ ID NO: 2558
  misc_feature (1)..(1425): useful for making plants with increased heat tolerance as described in USSN 12/515,707
  misc_feature (1)..(1425): Ceres CLONE ID no.1947534

SEQ ID NO: 2667 - DNA, 1720 bp, Triticum aestivum
  misc_feature (1)..(1720): useful for making plants with increased heat tolerance as described in USSN 12/515,707
  misc_feature (1)..(1720): Ceres CLONE ID no. 835571
gagctcgctcaagcgcctcaagtacgaagcctagagggatagtactgtactttcctctcccttcttctccgtctgcggtctgctgcttctgggcgtcaatggggagctctgccattttaggagaagcggagatcccctgaattggtcaatcagcattagtttgtttggtcgtttgatcatggatccctttcacggcattgtgaaagaggaggaattcgacttcgccggagctgcagcggatggctactcgccgtcttcctggggctcatccccgtcttcctggggctcttcccaatcttcctgggccggcggcggcgccttggcagagctgccgcggccgatggacggcctcggcgaggcgggccccacgcccttcctgaacaagacgtacgaggtggtggacgaccacagcacggacaccatcgtgtcgtggggcgtcgccgggaacagcttcgtggtgtgggacgcccacgccttctccatggtgctcctcccccgctacttcaagcactgcaacttctccagcttcgtccgccagctcaacacctatgggttcaggaaggttgatccggacaggtgggagttcgcggcggaggggttcctgcggggccagaaggagctgctgaagacgatcaggcgccggcggcctcagtcgtcgccgtctggcacgccggcgctgctgcagcagcagcagcagggccagcagggggcgtgcctggaggtggggcatttcgggcccgagggcgaggtgcagcggctgcagcgcgacaagggcaccctgatcgcggaggtggtgaagctgcggcaggagcagcaggcgacgcgagcgcagatgcaggagatggaggcgcgcctcgccgccacggagcagaagcagcagcagatgacggtgttcctggcgcgcgccatgaagagccccagcttcctccagatgctggtgcagcggcaggaccagagccggcggaaggagctcgcggaggcgctcctctccaagaagcgcggccgccccatcgagtacctcctcccccgcaacggcgagaccagcagcgccgcaagctacagcgccgcggcgcgaggctacggccctggtctcgccgacggcagtgacggcaggcgcgcggacggcgaggacacggagagcttctggaaggagctgctgagcctgggcctggaggagaggcatcgggaggctggcgggggcggcggggaggcgagcggcgccgaggtggacgacgacgtggacgatgaggtggacgagctggtgcagagcctctaccacctcagcccgaaccggccccacagccaccagtgaaggaagaacagaagacagaaggttctagagcgagaaatatctgctgccgcttggagaacaacgtagggccgcagcctgacaagtgacaaccccagcagtgagcgaaagaagataagaaggttctagaacaagaagtttccgctggagaacgtcgaacgtcgtggggtagaccgtaggcgtagtggtggtggtggtagcggtagtgctgcctccatgcccccatgggcgttgggggctggtctgctttgttcattttctattgctagttgtagtacctgacatgttgtcggggccccgcggcctgcatgcgcaagttgcccgaaacagaaaggggccagcgccttttgcctggcgtggtggaataatgctccgaggctttaccggattaagtactccaagttggacgtg

SEQ ID NO: 2668 - DNA, 1654 bp, Arabidopsis thaliana
  misc_feature (1)..(1654): useful for making plants with increased nitrogen use efficiency as described in USSN 12/615,920
  misc_feature (1)..(496): Sequence obtained in planta using Ceres clone 15650 and Ceres cDNA 12422368
attatagaatatctaataatgaagaatcggtttcaaaattaataatgactgattataattacattgacaacatgcagggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacgcagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcacgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaattctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttccaagaaatcgatggaatgatttaatagactatccttagggacaacaagaagattgtcgatgttgtttgaataattactatgacaatgtatgtatcataatatgtaagaactagaatatataataaatttttaccttcc

SEQ ID NO: 2669 - protein, 496 aa, Arabidopsis thaliana
  misc_feature (1)..(496): useful for making plants with increased nitrogen use efficiency as described in USSN 12/615,920
MTDYNYIDNMQGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFTIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSME

SEQ ID NO: 2670 - DNA, 519 bp, Arabidopsis thaliana
  misc_feature (1)..(519): useful for making plants with increased nitrogen use efficiency as described in USSN 12/615,920
  misc_feature (1)..(519): Ceres cloen 121073 and Ceres cDNA ID 12578718
aacaactttaaatctttaatagaaaaaaaataagcaactaacaaaaaaaatggaggccgagaaaacaccaccgacgacgacaacaacgacggagaagaaaacggagcaagtgaaagacaacgacttgccgaccgatagcccttacatggctacgggtactttggaagattacaaattgaaagcttatggagccgaaggtcaccaagagcctactcctggtcttggaggtggctccaccgatgctcctactccttctggcgacgcacccgccgccactaccaccgatgcgaaagctccgtgaaaaaaagaaagactataataatgaacaggttttgtggatcgtcggaaaacaaacccataattgtagtatgttcaataactgatccagcttcgtttcttaacgtttttatggtttaattaaaaatgtatttgcgtctaatgctgaatgctaaagttcgagtttcgtatcaaatgaagttgtaacgatttaataattaatgtgaagcttatttctttttg

SEQ ID NO: 2671 - protein, 83 aa, Arabidopsis thaliana
  misc_feature (1)..(83): useful for making plants with increased nitrogen use efficiency as described in USSN 12/615,920
MEAEKTPPTTTTTTEKKTEQVKDNDLPTDSPYMATGTLEDYKLKAYGAEGHQEPTPGLGGGSTDAPTPSGDAPAATTTDAKAP

SEQ ID NO: 2672 - DNA, 989 bp, Arabidopsis thaliana
  misc_feature (1)..(989): useful for making plants with increased nitrogen use efficiency as described in USSN 12/615,920
  misc_feature (1)..(989): Ceres clone 6288 and Ceres cDNA ID 12335951
tccctgaagaaaattgaaaggagcttaataaacagaagccgttctccttcactttcgttcctctcacttccatacaacatttgaaacctcagctatgcctaaatcaaagcgagatagaccagtgactttgtctaagacgaagaagaaaggaagagagcataaggagtgtattgtgaatggaattagggaggctgttgaaaaatattcctctgtctatgttttctcttttgaaaacatgagaaatatcaaattcaaggagtttaggcagcagtttaggcacaatggaaagttcttcctaggttcgaacaaagtgatgcaggttgctcttggtcgttctgcagaagatgaactccgttctggtatctacaaagtctccaagctgcttcgtggtgatactggacttcttgttactgatatgccaaaggaagaagtcgaaagcttatttaacgcttatgaggattccgacttttcaaggaccggaagcattgcagtagaaacggttgaactgaaggaaggtcctctagaacagttcacacatgagatggaaccacttcttcggaagcttgaaatgcctgtacgactaaacaaaggtactgtggagttggtcgctgactttgtagtttgtgaagaaggaaaacaactttcgccaaaatcagcccacattttgcgtctattgcgaatgaagatggctactttcaagctgaacttgctctgcagatggagccctagtgactttgagctttacagagaagatctgtcagagctttaccgagaagatctctcagacgttgaaacctcttaggaagccaagattttgactccaccctttaaatttttcttaatatcatcactatcacatggattttatattgtggcacatggtttgcattcaaatgttttaagtcaaagttttgcttgctttacatattttgtagaatatcaacttatcttcaagaaccccctatcctaatattggcaaatcaatcttg

SEQ ID NO: 2673 - protein, 235 aa, Arabidopsis thaliana
  misc_feature (1)..(235): useful for making plants with increased nitrogen use efficiency as described in USSN 12/615,920
MPKSKRDRPVTLSKTKKKGREHKECIVNGIREAVEKYSSVYVFSFENMRNIKFKEFRQQFRHNGKFFLGSNKVMQVALGRSAEDELRSGIYKVSKLLRGDTGLLVTDMPKEEVESLFNAYEDSDFSRTGSIAVETVELKEGPLEQFTHEMEPLLRKLEMPVRLNKGTVELVADFVVCEEGKQLSPKSAHILRLLRMKMATFKLNLLCRWSPSDFELYREDLSELYREDLSDVETS

SEQ ID NO: 2674 - DNA, 1195 bp, Arabidopsis thaliana
  misc_feature (1)..(1195): useful for making plants with increased nitrogen use efficiency as described in USSN 12/615,920
  misc_feature (1)..(1195): Ceres clone 38286 and Ceres cDNA ID 13487831
cttcccctcttaccttttcagagagagaaacaatatttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgattgatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcaattggacttgctccgagagcaatggagaagtactgcaagaacagatcttgaattaataaaaaaaaaaagaagcatcaatgatcaacaatatgacgggttcttgattttttatgtatttttatgattgtatgtggctatcacctatatatgtgtgttgtaattttaaatacttgatgggtatatagggcagtattttaccagtaagatgtggacaaacttgtaatgtgaccaaaagagaggaaacttcaatatctctgtgtttgtgtcatatttattgcccaacatgtgtctgtcggtttgatgatcaatcacaacttgatatgtgcatacatataaatgtgtgtatgtaggtgtgtgtacatgtacatgtgttttgatccctactctgctacttgtcgtttcttgtgtgtgttatctaatagttttttcccaaaatgaataattcgttgttatgttt

SEQ ID NO: 2675 - protein, 243 aa, Arabidopsis thaliana
  misc_feature (1)..(243): useful for making plants with increased nitrogen use efficiency as described in USSN 12/615,920
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAIGLAPRAMEKYCKNRS

SEQ ID NO: 2676 - DNA, 1638 bp, Arabidopsis thaliana
  misc_feature (1)..(1638): useful for making plants with increased nitrogen use efficiency as described in USSN 12/615,920
  CDS (1)..(1638): Ceres cDNA ID 2702830
atggcttccattgatgaagaaaggtcacttcttgaagttgaagaatctcttatacaggaagaagtaaaattatatgctgaagatggttcaatagatattcatggaaacccaccattgaagcagacaacaggaaactggaaagcttgtccattcatttttgcaaacgaatgctgcgaacggttggcttattatggaattgccaagaatctcatcacgtacttcacaaatgaattgcatgagactaatgtttctgctgctagacacgtcatgacatggcaaggaacatgttacatcactcctcttattggagctttaatagctgatgcttactggggaagatattggactattgcttgtttctctgccatttatttcaccggaatggttgcattgacactctcagcttcagttccgggtcttaagccagcggaatgcattggctctctatgtccaccagcaacaatggttcagtctacggttttattttcagggctttaccttatcgctcttggcactggaggaatcaaaccatgtgtctcatcctttggtgctgatcagtttgataagaccgatccaagcgaacgagtcagaaaagcttctttctttaactggttttacttcactatcaacattggtgcttttgtttcatctactgttctagtttggattcaagagaattatggatgggaattaggattcttgatacctaccgtgttcatgggacttgctactatgagtttcttctttggcacgccgctttatagatttcagaaaccgagaggtagcccgattactagcgtctgccaagttcttgtagccgcataccgtaaatcgaatctcaaggtccctgaagactccacggacgaaggagatgcaaacactaacccgtggaagctatgtaccgtgactcaagtcgaagaagttaagattctgttacgtttggtccccatttgggcctcaggaatcatcttctcagttctccattcacagatttacactctctttgttcaacaaggacggtgcatgaaacgaaccatcggcttattcgaaatccctcccgcaactctcgggatgttcgacactgcaagtgttctcatatctgtcccaatctatgaccgcgtcatcgttcccttagtgagacggttcacaggcttagctaaaggattcaccgagctacaaagaatggggattggtctttttgtctctgttttgagcttgacatttgcagctatcgttgagacggttcggttacagttagctagagatcttgatctagtggaaagtggagacattgttccattaaacatcttttggcaaatccctcagtactttttaatgggcactgctggagttttcttctttgttgggaggattgagtttttctatgagcaatctccagattcaatgagaagcttgtgtagtgcttgggctcttctcactactacactaggaaactacttgagctcgttgatcattacccttgtggcgtatttgagcggaaaagattgttggattccttcagacaacattaacaatggacatcttgattacttcttctggcttttggtcagtcttggatctgttaacatacctgtttttgtcttcttctctgtgaaatatactcatatgaaggtttga

SEQ ID NO: 2677 - protein, 545 aa, Arabidopsis thaliana
  misc_feature (1)..(545): useful for making plants with increased nitrogen use efficiency as described in USSN 12/615,920
MASIDEERSLLEVEESLIQEEVKLYAEDGSIDIHGNPPLKQTTGNWKACPFIFANECCERLAYYGIAKNLITYFTNELHETNVSAARHVMTWQGTCYITPLIGALIADAYWGRYWTIACFSAIYFTGMVALTLSASVPGLKPAECIGSLCPPATMVQSTVLFSGLYLIALGTGGIKPCVSSFGADQFDKTDPSERVRKASFFNWFYFTINIGAFVSSTVLVWIQENYGWELGFLIPTVFMGLATMSFFFGTPLYRFQKPRGSPITSVCQVLVAAYRKSNLKVPEDSTDEGDANTNPWKLCTVTQVEEVKILLRLVPIWASGIIFSVLHSQIYTLFVQQGRCMKRTIGLFEIPPATLGMFDTASVLISVPIYDRVIVPLVRRFTGLAKGFTELQRMGIGLFVSVLSLTFAAIVETVRLQLARDLDLVESGDIVPLNIFWQIPQYFLMGTAGVFFFVGRIEFFYEQSPDSMRSLCSAWALLTTTLGNYLSSLIITLVAYLSGKDCWIPSDNINNGHLDYFFWLLVSLGSVNIPVFVFFSVKYTHMKV

SEQ ID NO: 2678 - protein, 545 aa, Arabidopsis thaliana; identical to SEQ ID NO: 2677
  misc_feature (1)..(545): useful for making plants with increased nitrogen use efficiency as described in USSN 12/615,920

SEQ ID NO: 2679 - protein, 590 aa, Arabidopsis thaliana
  misc_feature (1)..(590): useful for making plants with increased nitrogen use efficiency as described in USSN 12/615,920
MVNSNEEDERRILDVEESLLTQEEVNNHLTGLSSTAEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDGYKFLDKAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 2680 - protein, 585 aa, Arabidopsis thaliana
  misc_feature (1)..(585): useful for making plants with increased nitrogen use efficiency as described in USSN 12/615,920
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 2681 - protein, 585 aa, Arabidopsis thaliana; identical to SEQ ID NO: 2680
  misc_feature (1)..(585): useful for making plants with increased nitrogen use efficiency as described in USSN 12/615,920

SEQ ID NO: 2682 - protein, 586 aa, Arabidopsis thaliana
  misc_feature (1)..(586): useful for making plants with increased nitrogen use efficiency as described in USSN 12/615,920
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWEDLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 2683 - protein, 568 aa, Arabidopsis thaliana
  misc_feature (1)..(568): useful for making plants with increased nitrogen use efficiency as described in USSN 12/615,920
MFKILTTKIQSFFCLNISGGTEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 2684 - protein, 159 aa, Brassica napus
  misc_feature (1)..(159): useful for making plants with increased nitrogen use efficiency as described in USSN 12/615,920
MGSIEEESPLIEEGLISQEPKLYAQDGSVDLHGNPPLKEKTGNWKACPFILGNECCERLAYYGIAGNLITYLTTKLHQGNVSAARNVTTWQGTCYLTPLIGAVLADAYWGRYWTIACFSGIYFIGMSALTLSASVPALKPAECIGGFCPSATPAQYAMF

SEQ ID NO: 2685 - protein, 559 aa, Prunus dulcis
  misc_feature (1)..(559): useful for making plants with increased nitrogen use efficiency as described in USSN 12/615,920
  misc_feature (46)..(46): Xaa can be any naturally occurring amino acid
MGSLEEERSLLEDGLIQDETNGLYTGDGSVDITGKPVLKQSTGNWXACPFILGTECCERLAFYGISTNLVTYLTHKLHEGNVSAARNVTTWSGTCYLTPLIGAVLADAYWGRYWTIAIFSTIYFIGMCTLTISASVPALKPPQCVDSVCPSASPAQYGVFFFGLYLIALRTGGIKPCVSSFGADQFDDTDSRERVKKGSFFNWFYFSINIGALVSSTLIVWVQDNAGWGLGFGIPALFMGIAIVSFFSGTPLYRFQKPGGSPLTRMCQVLVASFRKWNLDVPRDSSLLYETQDKGSAIKGSRKLEHSDELNCLDKAAVISETETKTGDFSNPWRICTVTQVEELKILIRMFPIWATGIVFSAVYAQMATMFVEQGMMMDTSVGSFTIPPASLSSFDVISVIFWVPIYDRFIVPIARKFTGKERGFSELQRMGIGLFLSVLCMSAAAVVEMKRLQLATELGLVDKEVAVPLSIFWQIPQYFLLGAAEIFTFIGQLEFFYDQSSDAMRSLCSALSASDDFIGKLSELFDSDIVTYFTTQGGKAGWIPDNLNDGHLDYFSGS

SEQ ID NO: 2686 - protein, 235 aa, Glycine max
  misc_feature (1)..(235): useful for making plants with increased nitrogen use efficiency as described in USSN 12/615,920
MFPIWATGIIFAAVYAQMSTLFVEQGTMMNTCIGSFKLPPASLSIFDVISVVLWVPLYDRIIVPILRKFTGKERGLSMLQRMGIGLFISVLCMLAAAVVEIMRLQLARELDLVDKPVDVPLSVLWQIPQYFFLGAAEVFTFVGQLEFLYDQSPYGMKTLGTALTLLNFSLGNYLSSFILTMVTYFTTLDGKPGWIPDNLNKGHLDYFFLLLAGLSFLNMSLYIVAAKRYKQKKAC

SEQ ID NO: 2687 - protein, 213 aa, Glycine max
  misc_feature (1)..(213): useful for making plants with increased nitrogen use efficiency as described in USSN 12/615,920
  misc_feature (205)..(205): Xaa can be any naturally occurring amino acid
  misc_feature (212)..(212): Xaa can be any naturally occurring amino acid
VEQGTMMNTNFGSFRIPPASLSSFDVISVIFWVPVYDRIIVPIARKFTGKERGFSELQRMGIGLFISVLCMSAAAIVEIVRLKVAKEHGLVDEPVPVPLNIFWQIPQYFLLGAAEVFTFVGQLEFFYDQSPDAMRSLCSALSLLTTSLGNYLSSFILTVVTYFTTQGGNPGWIPDNLNKGHLDYFFWLLAGLSFLNTFVYIVAAXRYKQKKXA

SEQ ID NO: 2688 - protein, 584 aa, Vicia faba
  misc_feature (1)..(584): useful for making plants with increased nitrogen use efficiency as described in USSN 12/615,920
MGSVEDDSSRLEEALIQDEESKLYTGDGSVDFKGRPVLKKNTGNWKACPFILGNECCERLAYYGIATNLVKPILLAKLHEGNVSAARNVTTWQGTCYLAPLIGAVLADSYWGRYWTIAIFSMIYFIGMGTLTLSASIPALKPAECLGAVCPPATPAQYAVFFIGLYLIALGTGGIKPCVSSFGADQFDDTDSRERVKKGSFFNWFYFSINIGALISSSFIVWIQENAGWGLGFGIPALFMGLAIGSFFLGTPLYRFQKPGGSPLTRMCQVVAASFRKRNLTVPEDSSLLYETPDKSSAIEGSRKLQHSDELRCLDRAAVISDDERKRGDYSNLWRLCTVTQVEELKILIRMFPVWATGIVFSAVYAQMSTMFVEQGTMMDTSVGSFKIPAASLSTFDVISVIFWVPVYDRFIVPIARKFTGKERGFSELQRMGIGLFISVLCMSAAAIVEIKRLQLAKELDLVDKAVPVPLTIFLQIPQYFLLGAAEVFTFVGQLEFFYDQSPDAMRSLCSALSLLTTSLGNYLSSFILTVVLYFTTRGGNPGWIPDNLNKGHLDYFSGLAGLSFLNMFLYIVAAKRYKSKKAS

SEQ ID NO: 2689 - protein, 580 aa, Lycopersicon esculentum
  misc_feature (1)..(580): useful for making plants with increased nitrogen use efficiency as described in USSN 12/615,920
MKYLFSKNGGLLEDENSGLYTRDGSVDIKGNPVLKSETGNWRACPFILGNECCERLAYYGIAANLVTYLTKKLHEGNVSAARNVTTWQGTCYITPLIGAVLADAYWGRYWTIATFSTIYFIGMCTLTLSASVPAFKPPQCVGSVCPSASPAQYAIFFFGLYLIALGTGGIKPCVSSFGADQFDDTDPKERVKKGSFFNWFYFSINIGALISSSLIVWIQENAGWGLGFGIPAVFMGIAIASFFFGTPLYRFQKPGGSPLTRMCQVLVAVFHKWNLSVPDDSTLLYETPDKSSAIEGSRKLLHTDELRCLDKAAVVSDNELTTGDYSNAWRLCTVTQVEELKILIRMFPIWATGIVFSAVYAQMSTMFVEQGMVMDTAVGSFKIPAASLSTFDTISVIVWVPVYDKILVPIARRFTGIERGFSELQRMGIGLFLSMLCMSAAAIVEIRRLQLARDLGLVDEAVSVPLSIFWQIPQYFILGAAEIFTFIGQLEFFYDQSPDAMRSLCSALSLLTTALGNYLSSFILTVVTSITTRGGKPGWIPNNLNGGHLDYFFWLLAALSFFNLVIYVFLCQMYKSKKAS

SEQ ID NO: 2690 - protein, 297 aa, Nepenthes alata
  misc_feature (1)..(297): useful for making plants with increased nitrogen use efficiency as described in USSN 12/615,920
DQFDDTDPREKIKKGSFFNWFYFSVNIGALISSSLIVWVQENLGWALGFGIPAISMGIAIASFFSGTALYRLQKPGGSPLTRMCQVLVASFRKSKLALPEDSNLLYETSDENSVIEGGRKLEHTNDLKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKSTGKQRGFSELQRMGIGLFISILSMAAAALVEMKRLQLAKELGLVDEDVAVPLSIFWQIPPYF

SEQ ID NO: 2691 - protein, 584 aa, Oryza sativa
  misc_feature (1)..(584): useful for making plants with increased nitrogen use efficiency as described in USSN 12/615,920
MDSSYQHDKPLLDEENSSQVTLEYTGDGSVCIRGHPALRKHTGNWKGSSLAIVFSFCSYLAFTSIVKNLVSYLTKVLHETNVAAARDVATWSGTSYLAPLVGAFLADSYLGKYCTILIFCTIFIIGLMMLLLSAAVPLISTGPHSWIIWTDPVSSQNIIFFVGLYMVALGYGAQCPCISSFGADQFDDTDENERTKKSSFFNWTYFVANAGSLISGTVIVWVQDHKGWIWGFTISALFVYLGFGTFIFGSSMYDFRNLEEAPLARICQVVVAAIHKRDKDLPCDSSVLYEFLGQSSAIEGSRKLEHTTGLKFFDRAAMVTPSDFESDGLLNTWKICTVTQVEELKILIRMFPVWATMILFAAVLDNMFSTFIEQGMVMEKHIGSFEIPAASFQSIDVIAVLILVPVYERVLVPVFRKFTGRANGITPLQRMGIGLFFSMLSMVSAALVESNRLRIAQDEGLVHRKVAVPMSILWQGPQYFLIGVGEVFSNIGLTEFFYQESPDAMRSLCLAFSLANVSAGSYLSSFIVSLVPVFTAREGSPGWIPDNLNEGHLDRFFWMMAGLCFLNMLAFVFCAMRYKCKKAS

SEQ ID NO: 2692 - protein, 156 aa, Triticum aestivum
  misc_feature (1)..(156): useful for making plants with increased nitrogen use efficiency as described in USSN 12/615,920
IYFIGMSVLTLSASVPMLMPPSCEGAICPEASPLQYTVFFLGLYLIALGTGGIKPCVSSFGADQFDDTDPAERIQKGSFFNWFYFSINIGALISSSFLVWVQDNLGWGLGFGIPTVFMGLAIISFFAGTSLYRFQKPGGSPITRVCQVVAATLRKW

SEQ ID NO: 2693 - protein, 147 aa, Triticum aestivum
  misc_feature (1)..(147): useful for making plants with increased nitrogen use efficiency as described in USSN 12/615,920
MDAAEETRLLLQEDGDQDASLYTGDGSVDIKGRPATRRDTGNWRACVFILGNECCERLAYYGIAKNLVTYLKIKLHQGNLEAARNVTTWQGTCYLSPLIGAILADSYWGKYWTIAVFSSIYFIGLAVLTLSASLPALQPPSCLGTVC

SEQ ID NO: 2694 - protein, 151 aa, Triticum aestivum
  misc_feature (1)..(151): useful for making plants with increased nitrogen use efficiency as described in USSN 12/615,920
  misc_feature (114)..(115): Xaa can be any naturally occurring amino acid
  misc_feature (131)..(131): Xaa can be any naturally occurring amino acid
KILVRMFPVWATTIVFSAVYAQMSTMFVEQGMVLDPTIGSFKIPPASLSTFDVVSVIIWVPIYDSILVPIARRFTGKERGFSELQRMGIGLVISILAMSAAAVLEIKRLAIARXXHLVDQNVPVPLSILWXIPQYFLVGASEVFTFIGAPE

SEQ ID NO: 2695 - protein, 592 aa, Zea mays
  misc_feature (1)..(592): useful for making plants with increased nitrogen use efficiency as described in USSN 12/615,920
MDEAAGLLLQEEGGGGDQEALLLPLPQDVGLYTGDGSVDVKGRPALKGTTGNWKACFFILGNECCERLAYYGIAKNLVTYLKVKLHLGNLEAARHVTTWQGTCYLTPLVGGILADSRWGKYWTIAVFSSVYFIGLAILTLSASVPALQPPSCLRTVCPEASLLQYGIFFGGLYMIALGTGGIKPCVSSFGADQFDDTDQAERAKKGSFFNWFYFCINIVSFISGTMIVWIQDNTGWGIGFAIPTIFMALAISFFFSASNKYRFQKPGGSPLTRVCQVVIAAFRKWHIEVPHDTSLLYEVDGQTSAIEGSRKLEHTNELEFLDRAAVISSADLKSESFTDPWKLCTVTQVEELKILIRMFPIWATTIIFSAVYAQNSSMFIEQGMVLDKRIGSFNIPPASLSTFDVISVIMWVPLYDRILVPLARKFTGREKGFSELQRMGIGLVLSILAMLSAALVELKRLEIARSEGLIHEKAAVPMSILWQIPQYFLVGAAEVFTCIGQVEFFYDQAPDAMRSLCSALALITVSLGNYISSIILTLVSYITTQGGDPGWIPDNLNEGHLDRFFWLIAGISFVNLIVYMGCAVRYRYKKAS

SEQ ID NO: 2696 - protein, 574 aa, Zea mays
  misc_feature (1)..(574): useful for making plants with increased nitrogen use efficiency as described in USSN 12/615,920
MEAAADEERPLIQYLAPEDDEASSRYTSDGTLDINNQRALKKSTGNWRACFMILGTEFAECLAFYATAKNLVTYLTAELGESNIDAATNVSTSIGSCYLTPLIGAFLADTYWGRYKTMIVFLLLYIVGMLTLTASAWLPLAMEDDSPNNSGLRRATAYLGLYLVSLGTGGIKPCTAALGADQFDGGDAAERVTKASFFNWYYFCTNIGSLLSGTVLVWVQENIGWGVGFTVQTVFMLFGLAVFVAGRKVYRYKKLGGSPLTRVAQVVVAAVRNCHLVLPDDTSALYHDKLLPTEPNFRIESARQFRFFDKAAIITGEKGAAAPTSPWRLCTVSQVEELKMLLRLLPVWASMVLFFAVSAQTVTTFIEQARVMDNRIGPFIIPPASIATFDVISVMVCVPVYDAVLVPLARRATGNDRGLSQLHRLSIGIALSVVVMVYAALLEGRRLALARANMPAMNIAWQAPMFAVHGAAAVFATVGVLEFFYDQSPDGMKSLGNALALLSMAAGSYFNSLALSTVGVITASGGERGWLPDDLNKGHMDYFFWMMAALGTLNLLHFLHYCNRRYTGNNNTTS

SEQ ID NO: 2697 - protein, 381 aa, Zea mays
  misc_feature (1)..(381): useful for making plants with increased nitrogen use efficiency as described in USSN 12/615,920
MAGAERAEAVALEQGLLDPEESNQVVYTGDGSVDFSGNPVVKERTGRWKACPFILGNECCERLAYYGISTNLVTYLTKKLHAGNASAASSVTTWSGTCYLTPLIGAILADAYWGRYWTIATFSTVYFIGMTLLTLSASVPMLMPPSCEGSFCPAASPFQYTVFFLGLYLIALGTGGIKPCVSSFGADQFDDTDPAERIQKGSFFNWFYFSINIGALISSSFLVWVQDNVGWGLGFGIPTVFMGLAIISFFSGTSLYRFQKPGGSPITRVCQVIVASLRKWNVPVPEDSSLLYELPNGVSTIEGSRQIEHTDELRCLDKAATVTEVDVKTADFNNPWRICTVTQVEELKILVRMFPVWATTIVFSAVYAQMSTMFVETRDGA

SEQ ID NO: 2698 - protein, 570 aa, Zea mays
  misc_feature (1)..(570): useful for making plants with increased nitrogen use efficiency as described in USSN 12/615,920
MEEGGEHTSLLVKDDASCHGEETQSLLEANLGPQLKSKCSDWRAPALILGLECLESMAFNGIATNLVVYLRSVLHGGIASSAATVSLWYGTSFFVPILGAAIADTCLGNYKTILISLIMYLFGIVLITVATFMPSTSVLCDVSSCLSSNGTQTMIFFAGLYLTAVGCGGVRSALLPFGANQFNNENSLDIKKRRNFFSLFYICVIFGVITSGTIIVWVQENVSWAIGYGVATTCIGLALIGFLVGTPIFQEDEPCGSPVKSIFQVIVASFRNMSLEVPADSCLLYEVGSNHIQRTKLAHSDDFRFLDKAAVISDPSLVYGGCRSSWSICTVTEVEELKILIRLLPIWVTGIFFGAAISQMHTTFIQQGTVMDTKIGSLSIPPASLYSFEVICVTLWVLAVNKVLVPAIRTYFANGVELTQLQRIGIGRFLMIFAMAMAALLETKRLHIVQEGELLSIVWQLPQYFVIAGAECFGIITQLEFFHGQAPDSMKSILTAFALLTTALGNYLSSAIITLIAGVTRVWHSPGWIPDDLNKGHLDYYYWCLTTLSLVNFVVYLYFASKYKLKKVVC

SEQ ID NO: 2699 - protein, 455 aa, Zea mays
  misc_feature (1)..(455): useful for making plants with increased nitrogen use efficiency as described in USSN 12/615,920
MTVLTASALLPLLMGASYSRSAHRLSAYLGLYLAALGTGGIKPCVCALGADQFDASDPVERRAKGSFFNWYYFSINIGSLLSATVVVWVQDNVGWGVGFAIPTLLMLSGLVLFVAGRKVYRYQRVGGSPLTRASQVVVAAVRNYRLVLPEPDDSSAALLHQAPPGTTEGNYSTMQHTSQFRFLDKAAIVAASSGEKGATASPWRLCTVSQVEELKTVLRMFPVWVSMVLFFAATAQMSSTFIEQGETIDNRVGPFTVPPASLSTFDVISVMVCIPIYDKALVPLARRATGKERGLSQLQRLGVGLALSVAGMVYAALLEARRLSLARAAAGGRPPMSIMWQAPAFAVLGAGEVFATIGILEFFYDQSPDGMKSLGTALAQLAVAAGNYFNSAVLAAVAAVTTRNGEAGWIPDDLDKGHLDYFFWFMAVLGVVNLLHFLHCSVRYRGSSNNSTYSS

SEQ ID NO: 2700 - protein, 593 aa, Oryza sativa
  misc_feature (1)..(593): useful for making plants with increased nitrogen use efficiency as described in USSN 12/615,920
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 2701 - protein, 576 aa, Oryza sativa
  misc_feature (1)..(576): useful for making plants with increased nitrogen use efficiency as described in USSN 12/615,920
MAAIEEERPLLPLQSQDVGSEYTRDGSVDINKEPALKHSTGNWRACFLILGVEFCENMTYFVISRNLVTFLTTVLHESKVDAARNVSAWVGACFLTPVVGAFLADTYWGRYWTIVVFLPVYITGMLIVTVSASLPMFLTSSEHGNVHRSVVYLGLYLAALGSGAMKPCTSSFGADQFDSTDLEELPKKASFFSWSFYMTTVSTLLSSTVLVWLQDNVGWGVGCAIPTVFMIISFPVFIAGSRVYRFRNLGFSPLKSLCQVIVAAVRKCHLQLPENKSLLYEPSNSSSTTEASHKIQPTNQFRFLDKAAIVLPPSDETCIKPMSSWSLCTVTQVEELKMLLRMFPTWASFVIFFAVNGQMSSTFIEQGMAMDNHVGSFAIPPASLTIIAVLSVLVLVPVYEIISVPLVKHFTGQDKGFSHAQRIGIGLSLSMIMMVYAALLEMKRLAIVQSSGLADHNVAAPMSILWQTPAYFLQGVSEIFSCIGMSQFFYDQAPDSMKSVCAALGQLAIASGAYFNTFVLGAVAVITTSSGAPGWIPDNLNEGHLDYFFWMMATLSLLNLAMFVYSSTRHRENTAS

SEQ ID NO: 2702 - protein, 578 aa, Oryza sativa
  misc_feature (1)..(578): useful for making plants with increased nitrogen use efficiency as described in USSN 12/615,920
MEAADEERAPLLQPQPQPSRGDADSEYTGDGSVDVNNQPALKRSTGNWRACFMILGVEFSENLAYYGISKNLVTYLTKILHESKVNAARNSSAWSGACYLTPLFGAFLADTYWGKYRTVLTFLPIYILGLLTLMASTSLPSSMTSSDAGHQLHSVAVYLGLYLVAFGNGGVKPCTSAFGADQFDGGDAAELRRKGSFFNWYTFMINSGSLLASTVLVWLQDNVGWGISFVIVVVVMAFFLAVFFAGSRVYRYRPVRGSPLTGVCQVVVAAVRKWHLELPDDSSLLYEAQVADHRIKHTDQFRFLDKAAIVVTPSSLSGEKGNVAAAAAPVSRWRQCTVTQVEEVKMLVRMCPIWACLVLFFSVSSQMSSTLVEQGTAMDNRVGPFTIPPASLATFHSIGVLLWIPVYDVALVPLARRATGKPKGITQLQRIGVGLAVAALIMAYSALVEERRLAAARAGAARTSILWQVPAQLMHGMAVVFTSIGKSEFFYDQAPRSMRSMCTALGQLAIAAGNYLSAFLLAVVASATTRGGDPGWIPDDLNKGHLDYFFWLMAALLLLDLLLFVFCAMRYKGSTAAS

SEQ ID NO: 2703 - protein, 566 aa, Oryza sativa
  misc_feature (1)..(566): useful for making plants with increased nitrogen use efficiency as described in USSN 12/615,920
MEAGAADEETPLIQQLPPEEQCSQYTCDGTVNSDKKPALKQSTGHWRACFFILGAQFAETLCFFMVSKNLVMYLTSALHESNIDAAQSVSIWIGTSFFTPLIGAFLADTYWGRYWTTVISLFIIIIGMLIVTVSSSPLFLNSSYYNWNICRATVYTGLYLTAVGSGCMKPCIPAFGADQFDSADPVERLAKGSFFNWYYFSMNVGSLLSTTLLVWVVANIGWSVGFAIPMLLSGFGLALFFAGRKVYRYKKQGGSPLTRVSQVVVAAVRNHRLKLPDDSSLLHEVSKVTEDDYRTQLTTQFRFFDKAAILSDEISPAQWSPWRLCTVSQVEELKILLRMFPVWVSMVVFFVVTAQITSTLIEQGMAMDGRVGPFTLPAASIATFDVISVLVWVPVYDTVLVPLARRVTGKDRGISHLQRIGVGLALAAVAMAYSAVVEARRLGTAPAPVSIMWQAPSYLVLGVAEAFSVIGMMEFFYEQSPESMKSLCTALGQLAIAVANYLNSGVLVVVAAATTRGGGAGWIPDNLDEGHLDYFFWMMAVVSVLNLLHFLHCSIRYRANNNTLSS

SEQ ID NO: 2704 - protein, 601 aa, Oryza sativa
  misc_feature (1)..(601): useful for making plants with increased nitrogen use efficiency as described in USSN 12/615,920
MANEEQRQWMDGEFGCQPVANIFFDFLDLPGEIHHCNFFSFYDLFCSSDEEEGPYTGNGSVDVKGNPASKTHTGKWKACYSILGGEFCGALAYYAVGTNLVSYLTKVQGQSNVTAASNIAAWQGNCYLTTILGAFLADSYWGRHRTIVVSLTTFTFGMVLLTLSAVVPPNMHRSMATFPQEALSSLGLYMTALGLGGIWPCVPTFGADQFDDTDVSEKAQKELFYNWYYFAVNGGFFVASTVIVWVQDNCGWGLGFGIPTLFSVIGVVGFLASMRFYRYQKPGGSALTRICQVVVAAFRKVHVDVPSDSSLLYEMPGKESAIVGSRKLMHTDGLRFFDRAATITASDEASASRPWKLCTVTQVEELKIFARMLPIFLTGVIFNTAEACFPLFVEQGGAMDNHVAAAFALPPASLTTFTCVCILVLAPTYDRVLMPAVSRLTGVKRGLSELHRIGVGMVFAVLALAAAAAVETARLRSVEADAPAVSILWQAPQYVLVGVAKVFGVVGYIEFAYEQSPDAMRSLCQACSLIMVTPGSYLLSAMLTIISSVTGGGGGHGGWIPENLNEGHLDRFFWLMAALQLINLIAFVCCAATYKRKLPTT

SEQ ID NO: 2705 - protein, 591 aa, Oryza sativa
  misc_feature (1)..(591): useful for making plants with increased nitrogen use efficiency as described in USSN 12/615,920
MRGNLREQKVYHMEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRVGPFTVPPASLATFNVVAVLIWVPVYDAVLVPLARRATGNDRGLSHLQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVRSDWASAAGQTGGDLMPQESIAGDGSGVNLEIR

SEQ ID NO: 2706 - protein, 551 aa, Oryza sativa
  misc_feature (1)..(551): useful for making plants with increased nitrogen use efficiency as described in USSN 12/615,920
MEASDEDRPLIHHLPPQEQCSKYTCDGTVNIDSVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVGFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVVAVLALIPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 2707 - protein, 569 aa, Oryza sativa
  misc_feature (1)..(569): useful for making plants with increased nitrogen use efficiency as described in USSN 12/615,920
MGMESGDAQLPLLHHQASASNQHYTKPPFNWKAPALILAFEFLESIAYAGISLNLVVYLGTVLHGTTASNAANVDTWNGTTFLTPVLGAFLADTYWGKYKTIAISTVFYLIGLLVITASAVIPSLQPAPCNGSSCPPATGFQYFVFFTALYLISVGTGGVKSALLPFGADQYNDSNLEESKKKQSFFSLFFIAINLGVFISGTVVVWIQQNVAWSLGFGISSICLVVATVAFLAGTPVYKVQLPSGSPLKSVVMVFVASFKKRKLEVPADNALLYEGDDADLSNGQSVKLAHTDGFRWLDKAAVVFEEVEEINKDEGGGGGWLQCSVTQVEEVKILLRMLPIWVTSVLYAASLGQTATTFVQQGNAMNTKIGSFSVPAASLNSAEVIFMMIWVVFQDTVVVPIARRYTGNPAGLTQLQRMGVGRLLAVPALAVAAVLETWRLRSVRDGGNLSIAWQLPQFVILACSDVFCGIAQLEFFYSEAPVSMRSLCSAFSFLALSLGYYVNSLVVSIVAVVTTTSNKGWLPADLNDGHLDYYFWLWTGISAINFVVYAAFAKNYTVKRLAVPHSH

SEQ ID NO: 2708 - protein, 556 aa, Oryza sativa
  misc_feature (1)..(556): useful for making plants with increased nitrogen use efficiency as described in USSN 12/615,920
MAAAAAAAAAEDEEKRPLLLRPNGGGGKEEEDKGGGGGWRACVLILGTELSDCLAFAGIARNLVSYLTGVVGESNVAAARDVSAWTGTCFLTPLVGAFIADSFLGRRTTILLFLSIYSMGMITLTVSASFATPHLDASSDGVLRATVFLGLYLVALGVGGIKPCASPLGADQFDDDDAAPAARASFFNWYYFCINVGSLLAATVLVWVQERAGWWLGFAIPAAVMTAALAAFLFCSTLCGLRAFHTPPGSPLTRLCQVVVAAVRNRGVELPGDSSLLHQLPDGDYRIIEHTNQFAFLDKAAVVASPPAVAMASPWMLCTVTQVEEVKMLLRLSTVWPTVVFFFAATAQMSSTFVEQGKAMDTRVGPLDVPPATLSTFEVVSILLCVPAYDAALMPLARRVTGDRRGLSQLQRLGVGLALSALAMAYSALLEASRRRRAATSIVWQAPSYMALGAAEVFTSVGLLEFFYDQAPDTIKSLCTAVSLVAVAAGSYLNSAIVAVVAWATAPEKGGGGGWIPDDLNRGRLDCFFWLMFGLSCVNLLAFVYSSTRYSYRVAN

SEQ ID NO: 2709 - protein, 516 aa, Oryza sativa
  misc_feature (1)..(516): useful for making plants with increased nitrogen use efficiency as described in USSN 12/615,920
MNRHEEFTEWHVGTECLGQLAFFGVQYSLVTFLTTQLRQGNAEAARNFSMWQGTCYIAPLAGAIVADSCLGRYRTILAFFSIYIIGMGTMALSGASPAVISRSTQPAVFSLGLYLMAIGAGCIKSCVGPFGADQFDGGDAMERPKKSSYFNWFYFAMYVGALVSGSAVVWLQDNFGWLLGFGVPALCTVLAMASFLLGSAMYRYHQPRGSQVVRACQVVVAAVRKRNVVLPHDGFVLYDGPAEEGRRMAHTDQFSFLDKAAVAVAVPSSAAAQPWRLCTVTQVEELKAIVRMLPVWATGIVYCMVLVQQPLFPVQGRAMRRRLGVAFAVPAASLNSVYAAAMLVLVPLYDAAVVPAARRLTGSERGLTELQRIGAGMALSVAAMAAAATVEGRRLAAAGEVSIAWQVPQYVLLGASAVLAHIGQLEFFYNQAPDSMRSLCSALGHMTCSLGSYLSSVVVTVVSHATARGGSPGWIADDIDDGHLDRFFWLVAGLSSINLVVFICCAKRYKYKDSIN

SEQ ID NO: 2710 - protein, 574 aa, Oryza sativa
  misc_feature (1)..(574): useful for making plants with increased nitrogen use efficiency as described in USSN 12/615,920
MDAGDAMESGQRAALLPESHGPKTEDDSLQVPLLKDKKRGGSKAPAIVLGFECLESTAFNGISTNLVVYLETVLHGSNLASASNVTTWYGTSYLTPIFGAIVADTFLGNYNTILISLAVYLLGMMLVTFSAFLPATAALCAAGATCGTGAAAAQTVAFVGLYLVAVGSGGVRSSLLPFGAEQFDDDSAADRERKAAFFSWFYLCVDFGLIVSGVLLVWIQQNVSWGLGFGIATACIAVAFAAFVLATPMYKRRLPTGTPLKSLAQVVVAAFRKVGMKLPADAELLYEVSDKVDSQPKIAHTSEFTFLDKAAVVSESDLEERPEAASSWKLCTVTQVEELKILLRLLPIWATSIIVSAAYSQMSTTFIQQGSAMDMHIFSVPVPAASLSSFQVLCVLTWVILYSKVIVPALRGFSSSGAAGEPSQLQRMGAGRLLMALAMAVAALVETKRLNAAASGEAINIAWQMPQYFFLAGAEVFCYIAQLEFFFGEAPDTMKSTCTSLALLTIALGSYLSSLIYAVVEAFTATAGGHGWISDDLNQGHLDYFFWMLAAMCTLNFVVYSGFAKNYKLKTVLS

SEQ ID NO: 2711 - protein, 577 aa, Oryza sativa
  misc_feature (1)..(577): useful for making plants with increased nitrogen use efficiency as described in USSN 12/615,920
MDEAAAGQRASPLLAKNDGSSYGEESQSLLEEQEPQVKTKQSGWRAPSIILGLECLESMAFNGIATNLVVYIRSVLHGGIASSASTSSLWYGTSFFVPILGATIADTYWGNYKTVLISFIMYLLGTVFITVGAFLPSAPALCNTESCSSMNGTQHLVYFSGLYLTAIGCGGVRSALLPLGADQFNNDSSLDIQKRRNFFSLFYICVIFGVITSGTIVVWIQENVSWAIGYGVATACIALALIGFLVGTPIFRRHEPHGSPVRSVFQVIVASFRNLALELPADSSLLYEVRRKNTQKSEPKLAHTDDFRFLDKAAIMSDLSLDQDSCTSPWRICTVTQVEELKILIRLLPIWATGIFFCVGISQMHTTFIQQGTVMNTKIGSLSIPAASLYSFEVICVTFWVFLVNKVIIPVTRACFANGAEMTQLQRIGIGRFLMIFAMAIAAFLEMKRLESVQGGDQPLSIAWQLPQYFVIAGAECFTIITQLEFFHGQAPDSMKSMLTAFALLTTALGNYFSSAIITLIARVTGTWHSPGWIPDDLNKGHLDYYYWCLAAISAVNFVVYIYFASKYKLKKAVIQV

SEQ ID NO: 2712 - protein, 593 aa, Oryza sativa
  misc_feature (1)..(593): useful for making plants with increased nitrogen use efficiency as described in USSN 12/615,920
MDAGEIIVAQPSPRLYKSLTFRRIATKERTIPQDEEMKIRSPRFQDESLTAPFILDKKARSKAPTVVLGFECLESTAFNGIATNLVVYLETLLHGSNLASASNVTTWFGTSYLTPVFGAIIADTFWGNYNTILVSLVFYLLGMMLVTFSAFLPTTALCTVVGSSCQQPLLGAQTIAFLGLYLVAFGSGGVRAALLPFGADQFDDDNTADRERKMSFFSWFYICVDFGMIVSGLFIVWIQQNVSWGLGFGIATACIALAFGGFVLATPMYKRRMPTGTPIKSLAQVVVAACRKARLRVPADTTLLYEVHDKINQSKIAHTDQFGFLDKAAVVMESDLEEESNDVAADASWRICTVTQVEELKILLRLLPIWATSIVLSAAYAQLNTTFVQQGAAMNMRIMSFTIPPASMVSFEVLCVLAWVLMYSSVIVPMLNSLSLANGEPSQLQRMGAGRLLMAFAMAVAALVEMMRLDAAGRGESLSIAWQMPQYFALAGAEVFCYIAQLEFFYSEAPESMKSMCTSLALLTVALGSYMSSFIYAVVNAFTAVDGRPGWISDNLNEGHMDYFFWVMAALCTLNFVVYSAFARTYRVKLVVS

SEQ ID NO: 2713 - protein, 593 aa, Oryza sativa
  misc_feature (1)..(593): useful for making plants with increased nitrogen use efficiency as described in USSN 12/615,920
MDAGEIIVAQPSPRLYKSLTFRRIATKERTIPQDEEMKIRSPRFQDESLTAPFILDKKARSKAPTVVLGFEFLESTAFNGIATNLVVYLETLLHGSNLASASNVTTWFGTSYHTPVFGAIIADTFWGNYNTILVSLVFYLLGMMLVTFSAFLPTTALCTVVGSSCQQPLLGAQTIAFLGLYLVAFGSGGVRAALLPFGADQFDDDNTADRERKMSFFSWFYICVDFGMIVSGLFIVWIQQNVSWGLGFGIATACIALAFGGFVLATPMYKRRMPTGTPIKSLAQVVVAACRKARLRVPADTTLLHEAHDKINQSKIAHTDQFGFLDKAAVVMESDLEEESNDVAADASWRICTVTQIEELKILLRLLPIWATSIVLSAAYAQLNTTFVQQGAAMNMRIMSFTIPPASMVSFGVLCVLAWVLMYSSVIVPMLNSLSLANGEPSQLQRMGAGRLLMAFAMAVAALVEMMRLDAAGRGESLSIAWQMPQYFALAGAEVFCYIAQLEFFYSEAPESMKSMCTSLALLTVALGSYMSSFIYAVVNAFTAVDGRPGWISDNLNEGHMDYFFWVVAALCTLNFVVYSAFARTYRVKLVVS

SEQ ID NO: 2714 - protein, 575 aa, Oryza sativa
  misc_feature (1)..(575): useful for making plants with increased nitrogen use efficiency as described in USSN 12/615,920
MDAGDAMERGQQRLPESWNPKLQDDVSLTVPLIQDKKSGSKAPAVVLGFECLESTAFNGIATNLVVYLETVLHGSSLASASNVTTWFGTSYLTPVFGAIIADTFFGNYNTILVSLVFYLLGMVLVTFSAFLPTTALCAVAGSTSCQQPVFGAQTIAFVGLYLVAFGSGGVRAALLPFGAEQFDDDNAVDRERKMSFFSWFYMCVDFGMIVSGLFIVWIQQNVSWGLGFGIATVCVAIAFGGFVLATPMYKRSMPTGTPLKSLAQVVVAACRKVSLRVPADAALLYEVHDKIDQPKITHTDEFSFLDKAAVIVQSDLEEDSNDASAAAAGSWRLCTVTQVEELKILMRLLPIWATSIVLSAAYAQLNTTFVQQGAAMNMRIMSFTIPAASMVSFEVFCVLAWVLVYGSVIVPLLRSFSPANGEPSQLRRMGAGRLLIAVAMAIAALVEMVRLDAAARGESLSIAWQMPQYFMLAGGEVFCYIAQLEFFYSEAPESMKSICTSLALLTVALGSYMSSFIYAVVNAFTAVDGRPGWISDNLNEGHLDYFFWVMSALCTLNFVVYSAFARNYKVKTVVS

SEQ ID NO: 2715 - protein, 571 aa, Oryza sativa
  misc_feature (1)..(571): useful for making plants with increased nitrogen use efficiency as described in USSN 12/615,920
MSMNNMMGSPPSRSRGRDEKKKRWKWKLGPATILGFELLESIAFSGVALNLVVYLATVLHGTLAFNAAHVDTWNGTTFIVPVIGAFLADSYWGKYRTILASLLFYLAGLVLLTVSAAVPSLRPAPCTGVPCSPATGTQFSVFFLALYLTSIGTGGVKSALLPFGAEQYERDDHDTDQEGAPAPEKTKQSFFSWFFGAINLGIFVAGTLVSWVEQNVSWALGFGIATLCLLIASAAFLAATPCYRVRLPTGDTPIKAILRVLVAAFRNRTRTLPPDADGDGLYEVDDDKNKNGGDDEKLAHTEGLRWLDKAAVRVDGGGVWEVCTVSEVERVKVLARIVPIWVTCVLYAASLGQMTTTFIQQGMAMDTRVFGGRFRVPVASLVSVEVVFMLLWVLLHDVVVMPVARRWWRSGGLTQLQRMGVGRVLVVVAMATAALVERRRLRGEKRSMSILWQVPQFVVLAGSDVFSGIAQLEFFYGEAPGSMRSICSAFSFLALSLGFYVNSLVVTIVAAVTKRSDGSGGWLAPDLDTAHLDYYFWLWALISLANLALYLLLAARYKSKKPSPPHSSSHP

SEQ ID NO: 2716 - protein, 617 aa, Oryza sativa
  misc_feature (1)..(617): useful for making plants with increased nitrogen use efficiency as described in USSN 12/615,920
MDADHERRRPEQGALRRPLLADDETCGHRTAECRGVFPFIDFCSAEDCEASSSNQSLVSQEDRGQEVAEVQKVESCSNKALIIILSLQFLEITAFYGVYLNLIVYLQDVLHGDSASNVATVSSWVGTAYLMPILGAAVADSCWGKYTTVLAGFSIALVGMVTITASATLPSLRPPSCGQSAYCVPATLSQKLVFFTGIYLCALGIGGAKAVLIAFGPEQLDDDDGGGKNERVRERKASYFSWYYAVANVGMLTAGTMLVWFEDNVSWGFGYGLCASFVAVAVVVLAATAPMYRILPPAGSPLKSVIQVLVAFSHKAKLTLPDDPTELYEDDGVKNSLQHPVHERLEHTNQFRCLDKAAIVSDEDLEDGDRWRLCTVSQVEEVKILLRLIPIWLTSAVYFIANTQAQTTFVQQGTKTDGRIARGAFSVPAASLSSFQMAFVAVFVTLYNRAVMPAARRCLGRAVAFTPLQLMGFGHATAVVAVGVAACTEARRLHAARAGAPAMGIAWLLPQYLVMAASDASLTVGQLEFFYDQSPETMRSASTAFYFLAISLGNLLNSQLVTLVAKVTAVWGNAGWFPLDLDDGHLDYFFLLIVAITAVNFAVYVALAKNYTPKKVR

SEQ ID NO: 2717 - DNA, 1857 bp, Arabidopsis thaliana
  misc_feature (1)..(1857): useful for making plants with increased nitrogen use efficiency as described in USSN 12/615,920
  misc_feature (1)..(1857): Ceres clone 3086056 and Ceres cDNA ID 13575971
gcctcataacacataaaacacagtggacgtaactcctctgtttcctctgttctctgtcatggctagtttagtctctggtgataaagaagctcaaatctctggcgatccaggcagcaagcgcggtggatggatcactttcccgttcatgctcgctactttgttaggcctttccgtgacttctttcggatgggtaatgaatttgatcgtcttcctaatcgaagagttcaacatcaagagcatcgctgctgctcagatttcaaatgttgccaatggatgtctcagcatgttgcctgttgttgcagccattctagctgattctttctttggaaacattccggtcatcgcggcctcttctttcatttctctgcttggaatcgttctcttgacgcttattgcatctttggactacttgagacctcggccgtgtgaagcagggtcagtcctatgcacaccgccgtcaaaactccacctcgggatcttgtacacagccttagctttagtgaccactggagcaggtgggacacggttcaccatggcatccgcgggtgcaaaccaatatgagaaacctaaagaacaaggaagcttcttcaactggtacttcctcacactatacgctggagctattactggtgcaacagcaattgtatatatacaagacaatgctagctggaaactagggtttggtctctgcgcggctgctaatttgatcagtttcatagtttttgtctctgggaagagatactacaagcatgacaaaccaatgggaagtcccttcacgagtctaatccgcgttgtagtctctgctacagtaaaaaggaaggctgtaatatcatgcaacgaagaagactatcatcactatggtctcgaaaaggaggtcaagacttctgctgcaatgccatccaagagcttcaggttcttgaaccgcgccgctttgatgaccaaagatgatttaaatcagaaagaaggatcagttaacaacatctggaggctatgctctgtacaagaagtagaagatttcaaagccattctccgagtttttcctctatggttatcaatcatcttcgtgagtactcctatggtgatgcaaacaagcttgattgtactccaagctctagtcacggaccgcggacttggtcctaatttcaaagtcccggccggttccctccaagtaataataatcatcactgcatgcattgttatcatcatgaacaactggcttgtctttccaatgtacaagaagctaactcataagttgctgacaccgcttcaaaaagtcggtataggccaggttctcaccattctaagcatggcactctccgcggtggtagaagcaaagaggctgaaaacagttgaaaatggtcatcccatgtcagtgttatggttgtttcctccccttgtgatagtaggtataggcgaagccttccagtttccggccaatattgaattattttatggcgaattccccgagtctctgaggaacaccgcgacttcattgacctcggtggtgattggaatctctttctatttgagcacagctctcattgatcttatccagaggaccacagcgtggttaccaaatgacattaaccacggaagagtggacaatgtttactggcttttagtcattggaggaatcttgaatttcggctacttccttgtgtgttcttgggtctacaaatatagaaacctcaaggataatgatcaagaacaagatccaaaagatggtacaatgtaaagacacaacatgtttctattctagttctctttacattaattctctcctgttagcttttgtgttttcgtatgttttaccacttcacatatggaactacatttagaaaataatactttcaaact

SEQ ID NO: 2718 - protein, 120 aa, Arabidopsis thaliana
  misc_feature (1)..(120): useful for making plants with increased nitrogen use efficiency as described in USSN 12/615,920
VMASLVSGDKEAQISGDPGSKRGGWITFPFMLATLLGLSVTSFGWVMNLIVFLIEEFNIKSIAAAQISNVANGCLSMLPVVAAILADSFFGNIPVIAASSFISLLGIVLLTLIASLDYLR

SEQ ID NO: 2719 - DNA, 1677 bp, Arabidopsis thaliana
  misc_feature (1)..(1677): useful for making plants with increased nitrogen use efficiency as described in USSN 12/615,920
  CDS (1)..(1677): Ceres in planta sequence from 60.1NB42-35S
atggctagtttagtctctggtgataaagaagctcaaatctctggcgatccaggcagcaagcgcggtggatggatcactttcccgttcatgctcgctactttgttaggcctttccgtgacttctttcggatgggtaatgaatttgatcgtcttcctaatcgaagagttcaacatcaagagcatcgctgctgctcagatttcaaatgttgccaatgcatgtctcagcatgttgcctgttgttgcagccattctagctgattctttctttggaaacattccggtcatcgcggcctcttctttcatttctctgcttggaatcgttctcttgacgcttattgcatctttggactacttgagacctcggccgtgtgaagcagggtcagtcctatgcacaccgccgtcaaaactccacctcgggatcttgtacacagccttagctttagtgaccactggagcaggtgggacacggttcaccatggcatccgcgggtgcaaaccaatatgagaaacctaaagaacaaggaagcttcttcaactggtacttcctcacactatacgctggagctattactggtgcaacagcaattgtatatatacaagacaatgctagctggaaactagggtttggtctctgcgcggctgctaatttgatcagtttcatagtttttgtctctgggaagagacgctacaagcatgacaaaccaatgggaagtcccttcacgagtctaatccgcgttgtagtctctgctacagtaaaagggaaggctgtaatttcatgcaacgaagaagactatcatcactatggtctcgaaaaggaggtcaagacttctgctgcaatgccatccaagagcttcaggttcttgaaccgcgccgctttgatgaccaaagatgatttaaatcagaaagaaggatcagttaacaacatctggaggctatgctctgtacaagaagtagaagatttcaaagccattctccgagtttttcctctatggttatcaatcatcttcgtgagtactcctatggtgatgcaaacaagcttgattgtactccaagctctagtcacggaccgcggacttggtcctaatttcaaagtcccggccggttccctccaagtaataataatcatcactgcatgcattgttatcatcatgaacaactggcctgtctttccaatgtacaagaagctaactcataagttgctgacaccgcttcaaaaagtcggtataggccaggttctcaccattctaagcatggcactctccgcggtggtagaagcaaagaggctgaaaacagttgaaaatggtcatcccatgtcagtgttatggttgtttcctccccttgtgatagtaggtataggcgaagccttccagtttccggccaatattgaattattttatggcgaattccccgagtctctgaggaacaccgcgacttcattgacctcggtggtgattggaatctctttctatttgagcacagctctcattgatcttatccagaggaccacagcgtggttaccaaatgacattaaccacggaagagtggacaatgtttactggcttttagtcattggaggaatcttgaatttcggctacttccttgtgtgttcttgggtctacaaatatagaaacctcaaggataatgatcaagaacaagatccaaaagatggtacaatgtaa

SEQ ID NO: 2720 - protein, 558 aa, Arabidopsis thaliana
  misc_feature (1)..(558): useful for making plants with increased nitrogen use efficiency as described in USSN 12/615,920
MASLVSGDKEAQISGDPGSKRGGWITFPFMLATLLGLSVTSFGWVMNLIVFLIEEFNIKSIAAAQISNVANACLSMLPVVAAILADSFFGNIPVIAASSFISLLGIVLLTLIASLDYLRPRPCEAGSVLCTPPSKLHLGILYTALALVTTGAGGTRFTMASAGANQYEKPKEQGSFFNWYFLTLYAGAITGATAIVYIQDNASWKLGFGLCAAANLISFIVFVSGKRRYKHDKPMGSPFTSLIRVVVSATVKGKAVISCNEEDYHHYGLEKEVKTSAAMPSKSFRFLNRAALMTKDDLNQKEGSVNNIWRLCSVQEVEDFKAILRVFPLWLSIIFVSTPMVMQTSLIVLQALVTDRGLGPNFKVPAGSLQVIIIITACIVIIMNNWPVFPMYKKLTHKLLTPLQKVGIGQVLTILSMALSAVVEAKRLKTVENGHPMSVLWLFPPLVIVGIGEAFQFPANIELFYGEFPESLRNTATSLTSVVIGISFYLSTALIDLIQRTTAWLPNDINHGRVDNVYWLLVIGGILNFGYFLVCSWVYKYRNLKDNDQEQDPKDGTM

SEQ ID NO: 2721 - protein, 558 aa, Arabidopsis thaliana
  misc_feature (1)..(558): useful for making plants with increased nitrogen use efficiency as described in USSN 12/615,920
MASLVSGDKEAQISGDPGSKRGGWITFPFMLATLLGLSVTSFGWVMNLIVFLIEEFNIKSIAAAQISNVANGCLSMLPVVAAILADSFFGNIPVIAASSFISLLGIVLLTLIASLDYLRPRPCEAGSVLCTPPSKLHLGILYTALALVTTGAGGTRFTMASAGANQYEKPKEQGSFFNWYFLTLYAGAITGATAIVYIQDNASWKLGFGLCAAANLISFIVFVSGKRYYKHDKPMGSPFTSLIRVVVSATVKRKAVISCNEEDYHHYGLEKEVKTSAAMPSKSFRFLNRAALMTKDDLNQKEGSVNNIWRLCSVQEVEDFKAILRVFPLWLSIIFVSTPMVMQTSLIVLQALVTDRGLGPNFKVPAGSLQVIIIITACIVIIMNNWLVFPMYKKLTHKLLTPLQKVGIGQVLTILSMALSAVVEAKRLKTVENGHPMSVLWLFPPLVIVGIGEAFQFPANIELFYGEFPESLRNTATSLTSVVIGISFYLSTALIDLIQRTTAWLPNDINHGRVDNVYWLLVIGGILNFGYFLVCSWVYKYRNLKDNDQEQDPKDGTM

SEQ ID NO: 2722 - protein, 548 aa, Arabidopsis thaliana
  misc_feature (1)..(548): useful for making plants with increased nitrogen use efficiency as described in USSN 12/615,920
MANSDSGDKEAHRSSKHGGWITLPFMLVTLLGMSITYFGWVMNLIVFLIEEFNIKSIAAVQISNIVNGVVNMLPVVAAILADSFFGNIPVISASAFISLTGISLLTLIASLDYLRPRPCETGSILCQSPSKLQLGILYAALALVITGTAGTRFILASAGANQYKKPKEQGRFFNWYFFTLYGGAITGTTAIVYAQDNASWKLGFGLCVAANLISFIIFVAGKRLYEHDQPLGSPYTSLVRVLVAATMKRKAVISYKDEDYHHRELEKETKTYVAMPSKSFRFLNRAALKTEGDSNNNMWRLCSVQEVEDFKAVLRLVPLWTSVMFLSAPLAVQMSMTVLQAMVMDRKLGPHFKVSAGSMQVIALVSGCVFIILNNWTTYPMYQKLIRKPLTPLQKVGIGHVLTILSMAISAVVEAKRLKTVENSHLMSVLWLVPALVINGIGEAFHFPANIAIFYGEFPESLRNTATSLTSVVMGISFYLSTALIDVIQRTTKWLPNDINHGRVDNVYLVLVIIGVSNFGYFLVCSWFYKYRNLKNDDHEQDLKDVTN

SEQ ID NO: 2723 - protein, 548 aa, Arabidopsis thaliana
  misc_feature (1)..(548): useful for making plants with increased nitrogen use efficiency as described in USSN 12/615,920
MANSDSGDKDAHRSSKHGGWITLPFMLVTLLGMSITYFGWVMNLIVFLIEEFNIKSIAAVQISNIVNGVVNMLPVVAAILADSFFGNIPVISASAFISLTGISLLTLIASLDYLRPRPCETGSILCQSPSKLQLGILYAALALVITGTAGTRFILASAGANQYKKPKEQGRFFNWYFFTLYGGAITGTTAIVYAQDNASWKLGFGLCVAANLISFIIFVAGKRLYEHDQPLGSPYTSLVRVLVAATMKRKAVISYKDEDYHHRELEKETKTYVAMPSKSFRFLNRAALKTEGDSNNNMWRLCSVQEVEDFKAVLRLVPLWTSVMFLSVPLAVQMSMTVLQAMVMDRKLGPHFKVSAGSMQVIALVSGCVFIILNNWTTYPMYQKLIRKPLTPLQKVGIGHVLTILSMAISAVVEAKRLKTVENSHLMSVLWLVPALVINGIGEAFHFPANIAIFYGEFPESLRNTATSLTSVVMGISFYLSTALIDVIQRTTKWLPNDINHGRVDNVYLVLVIIGVSNFGYFLVCSWFYKYRNLKNDDHEQDLKDVTN

SEQ ID NO: 2724 - protein, 555 aa, Arabidopsis thaliana
  misc_feature (1)..(555): useful for making plants with increased nitrogen use efficiency as described in USSN 12/615,920
MAGLVLSNDTEAKISGDCKRGGCITFPFMIATLLGISVTSYGWVLNLIVFLIEEYNIKSIAAAQISNIVNGCLSMLPVVTAILADSFFGNIPVISASAFISLLGIFLLTLISSFENLRPRPCETGSILCQSPSKLHLGVLYAALALVTAGTSGTRVALASAGANQYDKPRDKGSFFNWYFLTVNTGAIISATAIVYTQENASWRLGFGLCAAANLISFIVFISGKRFYKHDKPMGSPFTSLIRVLVAAILKIKVVTSSKEEDYHREVEKESKTCIGMPSKSFRFLNRAALKSEKDLNQEDGLCHNPWRLCSVEEVEDFKSVLRVLPLWLAILFVGTSIGVQASMTVLQALVTDRGLDSKFKVPAGSLQVIVLISSCVFLVLNNWTIYPIYQKITHKQLTPLQQVGIGQVFNILSMAISAIVEAKRLKTVENEHPMSVLWLLPPLVIVGIGDAFHYMANVAVFYGEFPESMRNTATSVTSVAFGISFYLSTALINLIQRTTAWLPDDINHGRVDNVYWVLVIGGVLNLGYFFVCSWYFTYRKIQDDNRQDPKDVTN

SEQ ID NO: 2725 - protein, 516 aa, Arabidopsis thaliana
  misc_feature (1)..(516): useful for making plants with increased nitrogen use efficiency as described in USSN 12/615,920
MARSVDTEAMTTRDPSSKRGGWKTFPFMIATLLGLSIASFGWVMNLVVFLIKEFNIKSIAATQNSNIVNGCVSMLPVVAAILADSFFGNIPVISVSAFISLLGIILLTMITSLDHLRPPPCETGSILCESPSKLQLGILYIALALVIIGSAGTRFTLASAGANQYEKPKEQGSFFNWYFLTLYTGAITGATAIVYTQENASWKLGFGLCAVANLISFIVFVSGKRYYKHDKPMGSPFTNLIRVVVAATRKRKAVISSREEDYHHGLGREGKTSSAMPSKSFRFFNRAALKTEDDSVNNNWRLCSVQEVEDFKAVFRVLPLLLAIIFVSTPMVTQTSLIILQALVTDRGLGPHFKIPAGSLQVIVIITACIVILMNNCLVYPMYQKLAHKPLTPLQKVGIGHVFIILSMAISAIVEAKRLKTVTNGHSMSVLWLHRDFIASVVIGISFYLSTALITLIQKTTKWLPNDINHGRVDNVYWLLVIVGVLNYFLVCAWFYRYRNLNDDDDQEQDPKDDTT

SEQ ID NO: 2726 - protein, 558 aa, Arabidopsis thaliana
  misc_feature (1)..(558): useful for making plants with increased nitrogen use efficiency as described in USSN 12/615,920
MASSVTGDAETAISADSSTKRRGGGWITFPFMIATLLGLTIAAWGWLLNLIVYLIEEFNVKSIAAAQIANIVSGCICMVPAVAAIASDSFFGTIPVISVSAFISLMGVALLTLTASLDTLRPRPCETASILCQSPSKTQLGVLYTAITLASIGTGGTRFTLATAGANQYEKTKDQGSFFNWFFFTTYLAGAISATAIVYTEDNISWTLGFGLSVAANFFSFLVFVSGKRFYKHDKPLGSPFTSLLCVIFAALRKRKAVVSTNEKDYHNESITMPTKSFRFFNRAALKQEDEVKPDGTIRNPWRLCSVQQVEDFKAVIRIIPLALATIFLSTPIAMQLSLTVLQGLVMDRRLGPSFKIPAGSLQVITLLSTCLFIIVNDRVLYPFYQKLTGKHLTPLQRVGIGHAFNILSMAVTAIVEAKRLKIVQKGHFLGSSSVADMSVLWLFPPLVIVGIGEAFHFPGNVALCYQEFPESMRSTATSITSVVIGICFYTSTALIDLIQRTTAWLPDDINHGRVDNVYWILVIGGVLNLGYFLVCSWLYRYRNLKDDDHKQAANVSH

SEQ ID NO: 2727 - protein, 558 aa, Arabidopsis thaliana; identical to SEQ ID NO: 2726
  misc_feature (1)..(558): useful for making plants with increased nitrogen use efficiency as described in USSN 12/615,920

SEQ ID NO: 2728 - protein, 557 aa, Arabidopsis thaliana
  misc_feature (1)..(557): useful for making plants with increased nitrogen use efficiency as described in USSN 12/615,920
MSGSVSRDAEALKSADSSTRRSGGRITFPFMIVTLFGLTLATLGWLQNLIVYLIEEYNMKSIAAAKILNIFSGFTFMFPAIGAIAADSFFGTIPVILVSSFISLVGVVLLALTTLFDSLRPQACETASKLCQAPTNIQLGVLYTAITLGCVGAGGLRFTLATAGANQYEKTKDQGSFFNWFFFTWYLAASISATAIVYAEENISWSFGFGLCVAANLLGLIVFISGKKFYKHDKPLGSPFTSLLRVIFAAIRKRKAVVSTNEKDYHSESKKTPTKSFRFFNRAALKQDDEVNSDGTIHNQWRLCSVQQVEDFKAVIRIIPLVLAILFLSTPIAMQLGLTVLQGLVMDRRLGPHFKIPAGSLQVITLLSTCLFIIVNDRFLYPFYQKLTGKFPTPIQRVGIGHVFNILSMAVTAIVEAKRLKIVQKGHFLGSSSVADMSVLWLFPPLVIVGIGEAFHFPGNVALCYQEFPESMRSTATSITSVLIGICFYTSTALIDLIQKTTAWLPDDINHGRVDNVYWILVIGGVLNLGYFLVCSWFYKYRNLENADHEQDANVSH

SEQ ID NO: 2729 - protein, 543 aa, Oryza sativa
  misc_feature (1)..(543): useful for making plants with increased nitrogen use efficiency as described in USSN 12/615,920
MAMSATSSNLIVYLVHKYNVKAIHAAQISNVVRGCMQLAPVLAAALSDAFFGPYPIAVAGLVFSLLSFVLFTLTAALPSLLPPPCQRGAGGGGATATSCEPPNAAQSAVLYAALCLLAAGNGGTRYNMAALGADQFAGEGQPRRRRQGGGFFSCYFAFLYASYATGDTVLVYVQDGVSWALGFGVCVATTGLALAALLLGSRHYRRPVPKGSPFTAMARVAVAAARKATVDLGSRVQYYHGCNRDDAVPRADQAPSDRFRFLNRAAMVVAGETREEDGSVAKPWRLCTVQQVEDVKSVVRVLPLWSSGILVSVTVNAQVSLTVLQALTMDRAVGPRFAVPAASITVTVLAAFVLAAALFDRVAAPLCAAAGKLAITPLRRVGLGHALNVASMAVAALVERRRIGAARGRAAAAAAVVPMSVLWLVPQLALTGAEEALHLPGNTALFYGELPASLRGTATAMPPLFIAAGSYLSAAAVDAVKRGTTWLPDDLNASRLDCVYWTLAVLAAVNLGYFLLCATTYKYNNYGGDDGNVKAQTQTDDVS

SEQ ID NO: 2730 - DNA, 1551 bp, Arabidopsis thaliana
  misc_feature (1)..(1551): useful for making plants with increased nitrogen use efficiency as described in USSN 12/615,920
  CDS (1)..(1551): Ceres cDNA 2997404
atggctcgttcagtcgacacagaagcaatgaccactcgcgatccaagcagcaagcgcggtggctggaaaacgtttccattcatgatcgctacattgttaggactttccatagcttcattcggatgggtgatgaacttggtcgtcttcctaattaaagaattcaacatcaagagcatcgctgctacgcagaattctaatattgttaatggatgtgtgagcatgttgcctgttgttgcagccattctagctgattcttttttcggaaacattcccgtcatctccgtctctgccttcatttctttgcttggcatcattctattgaccatgattacatctttggaccacttgagacctccaccgtgtgaaacagggtcaattctatgcgaatcgccatcaaaactccagctcgggatcttgtatatagccttagctctagtgatcattggatcagctggtacgcggtttaccttagcatccgcgggtgcaaaccaatatgagaaacctaaagaacaaggaagctttttcaactggtacttcctcacactctacactggagctattactggtgcaacagcaattgtatatacacaggaaaatgctagctggaaacttgggttcggtctttgcgccgtcgctaatttgatcagtttcatagttttcgtctctggcaagagatactacaagcatgacaaaccaatgggaagtcccttcacaaatctgatccgcgttgtagtcgctgctacaagaaaaaggaaagctgtgatttcatctagagaagaagactatcaccatgggcttggaagagaaggcaagacatcttctgcaatgccctccaagagctttaggttctttaaccgtgcagcattgaaaaccgaagatgactcagttaataacaactggaggctatgttctgttcaagaagtagaagattttaaagccgttttccgagttctccctctgttactagccatcatcttcgttagtactcccatggtgacgcaaacaagcttgattatattacaagctctagtcacagaccgcggtctcgggcctcacttcaaaatcccggccgggtccctccaagtcatagtaatcatcactgcatgtattgttatcttaatgaacaattgccttgtctatcccatgtaccagaagctagcccataagccattgacaccgcttcaaaaagtcggtataggccacgttttcatcattttaagcatggcgatatccgccattgtggaagcaaagaggctgaaaacagttactaatggccattccatgtcagtgctatggctgcaccgcgacttcattgcctcagtggtgattggaatatctttctacctgagcacagctctgatcactctgatccagaagaccaccaagtggttaccaaatgatattaaccatggaagagttgacaatgtttactggcttttagtcattgtaggagtcttgaactatttccttgtctgcgcttggttttacagatatagaaacctgaatgatgatgatgatcaggaacaagatccaaaagacgatacaacctaa

SEQ ID NO: 2731 - protein, 516 aa, Arabidopsis thaliana; identical to SEQ ID NO: 2725
  misc_feature (1)..(516): useful for making plants with increased nitrogen use efficiency as described in USSN 12/615,920

SEQ ID NO: 2732 - DNA, 1886 bp, Arabidopsis thaliana
  misc_feature (1)..(1886): useful for making plants with increased nitrogen use efficiency as described in USSN 12/615,920
  misc_feature (1)..(1886): sequence of in planta Ceres clone 2997404
atggctcgttcagtcgacacagaagcaatgaccactcgcgatccaagcagcaagcgcggtggctggaaaacgtttccattcatgatcggttagtgtattttatgactgtttggtttatgtttttgaacacaaaacatagacaaatgatagtgattgtaaggctctatatggtgcagctacattgttaggactttccatagcttcattcggatgggtgatgaacttggtcgtcttcctaattaaagaattcaacatcaagagcatcgctgctacgcagatttctaatattgttaatggatgtgtgagcatgtttcctgttattgcagccattctagctgattcttttttcggaaacattcccgtcatctccgtctctgccttcatttctttgcttgtaagtctgagacttaaatattctattgtcttgtgtgacacacaaagcttactagttgttaaacgtttccagggcatcgttctattgaccatgattacatctttggactacttgagacctccaccgtgtgaaacggggtcaattctatgccaatcgtcatcaaaactccagctcggaatcttgtatatagccttagctctagtgatcattggatcagctggtacgcggtttaccttagcatccgcgggtgcaaaccaatatgagaaacctaaagaacaaggaagctttttcaactggtacttcctcacactctacactggagctattactggtgcaacagcaattgtatatacacaggaaaatgctagctggaaacttgggttcggtctttgcgccgtcgctaatttgatcagtttcatagttttcgtctctggcaagagatactacaagcatgacaaaccaatgggaagtcccttcacaaatctgatccgcgttgtagtcgctgctacaagaaaaaggaaagctgtgatttcatctagagaagaagactatcaccatgggcttggaagagaaggcaagacatcttctgcaatgccctccaagagctttaggtgaaaaaacaaaaaaaacttgcttcattcatcaaacttaaaacagaacttaaaagagcttttacatgtgcaggttctttaaccgtgcagcattgaaaaccgaagatgactcagttaataacaactggaggctatgttctgttcaagaagtagaagattttaaagccgttttccgagttctccctctgttactagccatcatcttcgttagtactcccatggtgacgcaaacaagcttgattatactaaaagctctagtcacagaccgcggtctcgggcctcacttcaaaatcccggccgggtccctccaagtcatagtaatcatcactgcatgtattgttatcttaatgaacaattgccttgtctatcccatgtaccagaagctagcccataagccattgacaccgcttcaaaaagtcggtataggccacgttttcatcattttaagcatggcgatatccgccattgtggaagcaaagaggctgaaaacagttactaatggccattccatgtcagtgctatggctggttcctccccttgtgatagtaggaataggagaaacgttccaatttccggcgaatattgaattattctatagagaattccccgagtctctgagtagcaccgcgacttcattgacctcagtggtgattggaatatctttctacctgagcacagctctgatcactctgatccagaagaccaccaagtggttaccaaatgatattaaccatggaagagttggcaatgtttactggcttttagtcattgtaggagtcttgaatttcggctatttccttgtctgcgcttggttttacagatatagaaacctgaatgatgatgatgatcaggaacaagatccaaaagacgatacaacctaa

SEQ ID NO: 2733 - protein, 516 aa, Arabidopsis thaliana; identical to SEQ ID NO: 2725
  misc_feature (1)..(516): useful for making plants with increased nitrogen use efficiency as described in USSN 12/615,920

SEQ ID NO: 2734 - DNA, 2106 bp, Arabidopsis thaliana
  misc_feature (1)..(2106): useful for making plants with increased nitrogen use efficiency as described in USSN 12/615,920
  misc_feature (1)..(2106): Ceres cDNA ID 13649807
tgcacaaaagaaaccaagagctctcaaacaaaacagccttttacataagaacaaacacccccaaaaactgcaaaaaaaagagagagatcattaatccatcttcaagatgtctcttcctgaaactaaatctgatgatatccttcttgatgcttgggacttccaaggccgtcccgccgatcgctcaaaaaccggcggctgggccagcgccgccatgattctttgtattgaggccgtggagaggctgacgacgttaggtatcggagttaatctggtgacgtatttgacgggaactatgcatttaggcaatgcaactgcggctaacaccgttaccaatttcctcggaacttctttcatgctctgtctcctcggtggcttcatcgccgatacctttctcggcaggtacctaacgattgctatattcgccgcaatccaagccacgggtgtttcaatcttaactctatcaacaatcataccgggacttcgaccaccaagatgcaatccaacaacgtcgtctcactgcgaacaagcaagtggaatacaactgacggtcctatacttagccttatacctcaccgctctaggaacgggaggcgtgaaggctagtgtctcgggtttcgggtcggaccaattcgatgagaccgaaccaaaagaacgatcgaaaatgacatatttcttcaaccgtttcttcttttgtatcaacgttggctctcttttagctgtgacggtccttgtctacgtacaagacgatgttggacgcaaatggggctatggaatttgcgcgtttgcgatcgtgcttgcactcagcgttttcttggccggaacaaaccgctaccgtttcaagaagttgatcggtagcccgatgacgcaggttgctgcggttatcgtggcggcgtggaggaataggaagctcgagctgccggcagatccgtcctatctctacgatgtggatgatattattgcggcggaaggttcgatgaagggtaaacaaaagctgccacacactgaacaattccgttcattagataaggcagcaataagggatcaggaagcgggagttacctcgaatgtattcaacaagtggacactctcaacactaacagatgttgaggaagtgaaacaaatcgtgcgaatgttaccaatttgggcaacatgcatcctcttctggaccgtccacgctcaattaacgacattatcagtcgcacaatccgagacattggaccgttccatcgggagcttcgagatccctccagcatcgatggcagtcttctacgtcggtggcctcctcctaaccaccgccgtctatgaccgcgtcgccattcgtctatgcaaaaagctattcaactacccccatggtctaagaccgcttcaacggatcggtttggggcttttcttcggatcaatggctatggctgtggctgctttggtcgagctcaaacgtcttagaactgcacacgctcatggtccaacagtcaaaacgcttcctctagggttttatctactcatcccacaatatcttattgtcggtatcggcgaagcgttaatctacacaggacagttagatttcttcttgagagagtgccctaaaggtatgaaagggatgagcacgggtctattgttgagcacattggcattaggctttttcttcagctcggttctcgtgacaatcgtcgagaaattcaccgggaaagctcatccatggattgccgatgatctcaacaagggccgtctttacaatttctactggcttgtggccgtacttgttgccttgaacttcctcattttcctagttttctccaagtggtacgtttacaaggaaaaaagactagctgaggtggggattgagttggatgatgagccgagtattccaatgggtcattgatcatgaattcatgatcatgatcatgatgatgaacattatgcatgtctatgttgatatgtttgaatttgattttgagttttgtttgtatattttatgatgcttttcttaattacctcttgtttccgagtcgacaaataatggaccgaccgataagggataaaagttaaagttttcccatcaggttctgtataaaagcagaaattgtaacatttcttaagatttgacgc

SEQ ID NO: 2735 - protein, 23 aa, Arabidopsis thaliana
  misc_feature (1)..(23): useful for making plants with increased nitrogen use efficiency as described in USSN 12/615,920
EQTPPKTAKKRERSLIHLQDVSS

SEQ ID NO: 2736 - protein, 26 aa, Arabidopsis thaliana
  misc_feature (1)..(26): useful for making plants with increased nitrogen use efficiency as described in USSN 12/615,920
CLGLPRPSRRSLKNRRLGQRRHDSLY

SEQ ID NO: 2737 - protein, 12 aa, Arabidopsis thaliana
  misc_feature (1)..(12): useful for making plants with increased nitrogen use efficiency as described in USSN 12/615,920
GRGEADDVRYRS

SEQ ID NO: 2738 - protein, 17 aa, Arabidopsis thaliana
  misc_feature (1)..(17): useful for making plants with increased nitrogen use efficiency as described in USSN 12/615,920
SGDVFDGNYAFRQCNCG

SEQ ID NO: 2739 - protein, 81 aa, Arabidopsis thaliana
  misc_feature (1)..(81): useful for making plants with increased nitrogen use efficiency as described in USSN 12/615,920
HRYQFPRNFFHALSPRWLHRRYLSRQVPNDCYIRRNPSHGCFNLNSINNHTGTSTTKMQSNNVVSLRTSKWNTTDGPILSL

SEQ ID NO: 2740 - DNA, 1773 bp, Arabidopsis thaliana
  misc_feature (1)..(1773): useful for making plants with increased nitrogen use efficiency as described in USSN 12/615,920
  CDS (1)..(1773): Ceres clone 1816383
atgtctcttcctgaaactaaatctgatgatatccttcttgatgcttgggacttccaaggccgtcccgccgatcgctcaaaaaccggcggctgggccagcgccgccatgattctttgtattgaggccgtggagaggctgacgacgttaggtatcggagttaatctggtgacgtatttgacgggaactatgcatttaggcaatgcaactgcggctaacaccgttaccaatttcctcggaacttctttcatgctctgtctcctcggtggcttcatcgccgatacctttctcggcaggtacctaacgattgctatattcgccgcaatccaagccacgggtgtttcaatcttaactctatcaacaatcataccgggacttcgaccaccaagatgcaatccaacaacgtcgtctcactgcgaacaagcaagtggaatacaactgacggtcctatacttagccttatacctcaccgctctaggaacgggaggcgtgaaggctagtgtctcgggtttcgggtcggaccaattcgatgagaccgaaccaaaagaacgatcgaaaatgacatatttcttcaaccgtttcttcttttgtatcaacgttggctctcttttagctgtgacggtccttgtctacgtacaagacgatgttggacgcaaatggggctatggaatttgcgcgtttgcgatcgtgcttgcactcagcgttttcttggccggaacaaaccgctaccgtttcaagaagttgatcggtagcccgatgacgcaggttgctgcggttatcgtggcggcgtggaggaataggaagctcgagctgccggcagatccgtcctatctctacgatgtggatgatattattgcggcggaaggttcgatgaagggtaaacaaaagctgccacacactgaacaattccgttcattagataaggcagcaataagggatcaggaagcgggagttacctcgaatgtattcaacaagtggacactctcaacactaacagatgttgaggaagtgaaacaaatcgtgcgaatgttaccaatttgggcaacatgcatcctcttctggaccgtccacgctcaattaacgacattatcagtcgcacaatccgagacattggaccgttccatcgggagcttcgagatccctccagcatcgatggcagtcttctacgtcggtggcctcctcctaaccaccgccgtctatgaccgcgtcgccattcgtctatgcaaaaagctattcaactacccccatggtctaagaccgcttcaacggatcggtttggggcttttcttcggatcaatggctatggctgtggctgctttggtcgagctcaaacgtcttagaactgcacacgctcatggtccaacggtcaaaacgcttcctctagggttttatctactcatcccacaatatcttattgtcggtatcggcgaagcgttaatctacacaggacagttagatttcttcttgagagagtgccctaaaggtatgaaagggatgagcacgggtctattgttgagcacattggcattaggctttttcttcagctcggttctcgtgacaatcgtcgagaaattcaccgggaaagctcatccatggattgccgatgatctcaacaagggccgtctttacaatttctactggcttgtggccgtacttgttgccttgaacttcctcattttcctagttttctccaagtggtacgtttacaaggaaaaaagactagctgaggtggggattgagttggatgatgagccgagtattccaatgggtcattga

SEQ ID NO: 2741 - protein, 590 aa, Arabidopsis thaliana
  misc_feature (1)..(590): useful for making plants with increased nitrogen use efficiency as described in USSN 12/615,920
MSLPETKSDDILLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCNPTTSSHCEQASGIQLTVLYLALYLTALGTGGVKASVSGFGSDQFDETEPKERSKMTYFFNRFFFCINVGSLLAVTVLVYVQDDVGRKWGYGICAFAIVLALSVFLAGTNRYRFKKLIGSPMTQVAAVIVAAWRNRKLELPADPSYLYDVDDIIAAEGSMKGKQKLPHTEQFRSLDKAAIRDQEAGVTSNVFNKWTLSTLTDVEEVKQIVRMLPIWATCILFWTVHAQLTTLSVAQSETLDRSIGSFEIPPASMAVFYVGGLLLTTAVYDRVAIRLCKKLFNYPHGLRPLQRIGLGLFFGSMAMAVAALVELKRLRTAHAHGPTVKTLPLGFYLLIPQYLIVGIGEALIYTGQLDFFLRECPKGMKGMSTGLLLSTLALGFFFSSVLVTIVEKFTGKAHPWIADDLNKGRLYNFYWLVAVLVALNFLIFLVFSKWYVYKEKRLAEVGIELDDEPSIPMGH

SEQ ID NO: 2742 - protein, 590 aa, Arabidopsis thaliana; identical to SEQ ID NO: 2741
  misc_feature (1)..(590): useful for making plants with increased nitrogen use efficiency as described in USSN 12/615,920

SEQ ID NO: 2743 - protein, 589 aa, Brassica napus
  misc_feature (1)..(589): useful for making plants with increased nitrogen use efficiency as described in USSN 12/615,920
MSLPETKTQTLLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCDPTTSSHCVQANGIQLTVLYLALYLTALGTGGVKASVSGFGSDQFDDTEPKERSQMTYFFNRFFFCINVGSLMAVTVLVYIQDDVGRKWGYGICALAIVLSLSIFLAGTNRYRFKKLIGSPMTQVGTVLVAAWRNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 2744 - protein, 588 aa, Brassica napus
  misc_feature (1)..(588): useful for making plants with increased nitrogen use efficiency as described in USSN 12/615,920
MSLPETKSQTLLDAWDFQGRPADRSKTGGWASAAMILCIEAVERLTTLGIGVNLVTYLTGTMHLGNATAANTVTNFLGTSFMLCLLGGFIAHTFLGRYLTIAIFAAIQATGVSILTLSTIIPGFQPPRCPTTSSHCVQPSGIQLTVLYLALYLTALGTGGVKASVSGFGSDQFDETEPKEQSQMTYFFNRFFFCINVGSLLAVTVLVYMQDDVGRKWGYGLCALAIVLSLSIFLAGTNRYRFKKLIGSPMTQVAAVIVAAWWNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 2745 - protein, 596 aa, Prunus persica
  misc_feature (1)..(596): useful for making plants with increased nitrogen use efficiency as described in USSN 12/615,920
MSNCTLPETQEKLTLPDAWDFKGRPAERSKTGGWTAAAMILGGEACERLTTLGIAVNLVTYLTGTMHLGNATSANTVTNFLGTSFMLCLLGGFVADTFLGRYLTIAIFATFQAMGVTILTISTTIPSLRPPKCTSDTSTPCIPASGKQLMVLYIALYLTALGTGGLKSSVSGFGSDQFDESDKQERRQMTNFFNWFFFFISIGSLAAVTVLVYIQDNLGRQWGYGICVCAIVLGLIVFLSGTRRYRFKKLVGSPLTQISGVCVAAWRKRNMELPSDMSFLYNVDDIDDGLKKKKKQKLPHSKQFRFLDKAAIKEPKTTSGTAMIINKWSLSTLTDVEEVKLIIRMLPIWATTIMFWTVYAQMTTFSVSQATSMDRHIGKSFQIPPASLTAFFVGSILLTVPVYDRLIVPMARKALENPQGLTPLQRMGVGLVFSIFAMVAAALTEVKRLNIARSHGLTDNPTAEIPLSVFWLVPQFFFVGSGEAFTYIGQLDFFLRECPKGMKTMSTGLFLSTLSLGFFFSSLLVTIVHKTTGHNKPWLADNLNQGKLYDFYWLLALLSALNLVIYLFCANWYVYKDKRLAEEGIELEEPEICAHA

SEQ ID NO: 2746 - protein, 347 aa, Glycine max
  misc_feature (1)..(347): useful for making plants with increased nitrogen use efficiency as described in USSN 12/615,920
VCAMLVALLVLLSSTRRYRYKRLVGSPLTQIAMVFVAAWRKRHLELPSDSSLLFNLDDVADESLRKNKQMLPHSKQFRFLDKAAIKDPKMDGEEITMQRNWYLSTLTDVEEVKMVQRILPVWATTIMFWTVYAQMTTFSVQQATTMDRRIGNSFQIPAASLTVFFVGSVLLTVPIYDRVITPIAKKISHNPQGLTPLQRIGVGLVFSIFAMVSAALIEIKRLRMAQFFFVGSGEAFTYIGQLDFFLRECPRGMKTMSTGLFLSTLSLGFFLSSLLVTLVHKATRHREPWLADNLNHGRLHHFYWLLALLSGVNLVAYLFCAKGYVYKDKRLAEAGIELEETDTACHA

SEQ ID NO: 2747 - protein, 590 aa, Nicotiana plumbaginifolia
  misc_feature (1)..(590): useful for making plants with increased nitrogen use efficiency as described in USSN 12/615,920
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSTLLYNIDDIPGDGNKKAKQRLPHSKEFRFLDKAAIKVQDTESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFVSSILVTIVHKVTVKNPWLADNLNQGRLYDFYWLLATLSVLNLMVFLFISRRYVYKEKRLAECGIEMEDSEPACH

SEQ ID NO: 2748 - protein, 594 aa, Nicotiana tabacum
  misc_feature (1)..(594): useful for making plants with increased nitrogen use efficiency as described in USSN 12/615,920
MALPETQQDSKALPDAWDYKGRPALRSSSGGWASGAMILGVEAVERLTTLGIAVNLVTYLTGTMHLGNATAANNVTNFLGTSFMLTLFGGFVADTFLGRYLTIGIFATVQAMGVTILTISTIIPSLRPPKCEQVGSSSCIPANSKQLMVLYIALYMTALGTGGLKSSVSGFGTDQFDDADKKEKGQMIKFFDWFFFFINVGSLGAVTVLVYIQDNLGREWGYGICACAIVIGLVVFLSGTRKYRFKKLVGSPLTQIASVIVAAWKKRHLELLSDSSLLFEIDDIFGEGNKKNKQKLPHSKEYRFLDKAAIKEDHDLESNGTNVVINKWKLATLTDVEEVKLLIRMLPTWATTIMFWTVYAQMTTFSVSQATTMDRHIGTFEIPPASLTVFFVGSILLTVIFYDRVIVPICRRFMNKPHGLTPLQRIFTGLVLSILAMIAAALTEVKRLKVAHLHGLTNDANATIPLSVFWLVPQFLLVGAGEAFTYIGQLDFFLRECPKGMKTMSTGLFLSTLALGFFFSSILVTIVHVVTGTTNPWLADNLNQGRLYDFYWLLAILSVLNLMFFLYFSRKYVYKEKRLAEMGIELEDDGPVCH

SEQ ID NO: 2749 - protein, 590 aa, Nicotiana tabacum
  misc_feature (1)..(590): useful for making plants with increased nitrogen use efficiency as described in USSN 12/615,920
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMELPSDSSLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTSPLQRIAVGLILSIIAMIAAALTEVKRLNVAHLHGLTNDANAKVPLSVFWLVPQFLLVGAGEAFTYIGQLDFFLRECPKGMKTMSTGLFLSTLSLGFFFSSILVTIVHKVTGKNPWLADNLNQGRLYDFYWLLATLSVLNLMIFLFISRRYVYKEKRLAECGIEMEDSEPACH

SEQ ID NO: 2750 - protein, 594 aa, Nicotiana tabacum
  misc_feature (1)..(594): useful for making plants with increased nitrogen use efficiency as described in USSN 12/615,920
MALPETQQDSKALPDAWDYKGRPALRSSSGGWASGAMILGVEAVERLTTLGIAVNLVTYLTGTMHLGNASSANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDSDKKEKGQMIKFFDWFFFFINVGSLGAVTVLVYIQDNLGREWGYGICACAIVIALVVFLFGTRKYRFKKLGGSPLTQIASVIVAAWKKRHLELPSDSSLLFEIDDIFGEGNKKSKQKLPHSKEYRFLDKAAIKEDDDLESNGTNVVINKWKLATLTDVEEVKILIRMLPTWATTIMFWTVYAQMTTFSVSQATTMDRHIGTFEIPPATLTVFFVGSILLTVIFYDRIIVPICRRFMNKPHGLTPLQRIFTGLVLSILAMIAAALTEVKRLKVAHLHGLTNDANATIPLTVFWLVPQFLLVGAGEAFTYIGQLDFFLRECPKGMKTMSTGLFLSTLALGFFFSSILVTIVHVVTGTTNPWLADNLNQGRLYDFYWLLAILSVFNLMFFLYSSRKYVYKEKRLAEMGIELEDDGPVCH

SEQ ID NO: 2751 - protein, 590 aa, Nicotiana tabacum
  misc_feature (1)..(590): useful for making plants with increased nitrogen use efficiency as described in USSN 12/615,920
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSYLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFFSSILVTIVHKVTVKNPWLADNLNQGRLYDFYWLLATLSVLNLMIFLFISRRYVYKEKRLAECGIEMEDSEPACH

SEQ ID NO: 2752 - protein, 160 aa, Triticum aestivum
  misc_feature (1)..(160): useful for making plants with increased nitrogen use efficiency as described in USSN 12/615,920
  misc_feature (135)..(135): Xaa can be any naturally occurring amino acid
MVGLLPQTNAAAQAEVLGDAWDYRGRPAARSTTGRWGAAAMILVAELNERLTTLGIAVNLVTYLTATMHVGNAEAANVVTNFMGTSFMLCLLGGFVADSFLGRYLTIAIFTAIQASGVTILTISTAAPGLRPPAXHGGGRRDRDLLPRVGRQLGVLYLAL

SEQ ID NO: 2753 - protein, 146 aa, Triticum aestivum
  misc_feature (1)..(146): useful for making plants with increased nitrogen use efficiency as described in USSN 12/615,920
FLGTSFLLCLLGGFVADTYLGLYLTIAISTAVQAAGMAVLTVSTAAPGLRPAPCKDPTGDGRLPGCAPPTGAQLGVLYLGLYLTALGTGGLKSSVSGFGSDQFDESHAGERRRMARFFGWFFFFISLGSLLAVTVLVYVQDNVGRR

SEQ ID NO: 2754 - protein, 160 aa, Triticum aestivum
  misc_feature (1)..(160): useful for making plants with increased nitrogen use efficiency as described in USSN 12/615,920
  misc_feature (158)..(158): Xaa can be any naturally occurring amino acid
CAASIAVGLVVFLAGTRRYRFKKLAGSPLTQIAAVVVAAWRKRGVQLPTDTSMLYDIDVGKVAAIEGASTKKSKLKERIPHTKQFRFLDHAAINSDPAGEPTKWQLATLTDVEEVKTVARMLPIWATTIMFWTVYAQMTTFSVSQATTMDRHIGPSFXIP

SEQ ID NO: 2755 - protein, 123 aa, Narcissus pseudonarcissus
  misc_feature (1)..(123): useful for making plants with increased nitrogen use efficiency as described in USSN 12/615,920
QPMSVFWLVPQFFLVGAGEAFCYIGQLDFFLRECPKGMKTMSTGMFLSTLSLGFFLSSALVTIVHKVTGESGQGAWLPDDLNRGKLYDFYWLLAVLSAVNLVAFLVSARWYVYKENRMATDDG

SEQ ID NO: 2756 - protein, 603 aa, Oryza sativa
  misc_feature (1)..(603): useful for making plants with increased nitrogen use efficiency as described in USSN 12/615,920
MVGMLPETNAQAAAEEVLGDAWDYRGRPAARSRTGRWGAAAMILVAELNERLTTLGIAVNLVTYLTATMHAGNAEAANVVTNFMGTSFMLCLLGGFVADSFLGRYLTIAIFTAVQASGVTILTISTAAPGLRPAACAAGSAACERATGAQMGVLYLALYLTALGTGGLKSSVSGFGSDQFDESDSGEKSQMMRFFNWFFFFISLGSLLAVTVLVYVQDNLGRPWGYGACAAAIAAGLVVFLAGTRRYRFKKLVGSPLTQIAAVVVAAWRKRRLELPSDPAMLYDIDVGKLAAAEVELAASSKKSKLKQRLPHTKQFRFLDHAAINDAPDGEQSKWTLATLTDVEEVKTVARMLPIWATTIMFWTVYAQMTTFSVSQATTMDRHIGASFQIPAGSLTVFFVGSILLTVPIYDRLVVPVARRATGNPHGLTPLQRIGVGLVLSIVAMVCAALTEVRRLRVARDARVGGGEAVPMTVFWLIPQFLFVGAGEAFTYIGQLDFFLRECPKGMKTMSTGLFLSTLSLGFFVSSALVAAVHKLTGDRHPWLADDLNKGQLHKFYWLLAGVCLANLLVYLVAARWYKYKAGRAAAAGDGGVEMADAEPCLH

SEQ ID NO: 2757 - protein, 594 aa, Oryza sativa
  misc_feature (1)..(594): useful for making plants with increased nitrogen use efficiency as described in USSN 12/615,920
MVLPETAAEGKALTDAWDYKGRPAGRAATGGWGCAAMILGAELFERMTTLGIAVNLVPYMTGTMHLGNAAAANTVTNFIGTSFMLCLLGGFVADTYLGRYLTIAIFEAVQATGVMILTISTAAPGLRPPACGDPKGASAECVAADGTQLGVLYLGLYLTALGTGGLKSSVSGFGSDQFDESDVDGERKKMMRFFNWFYFFVSLGALLAVTVLVYVQDNVGRRWGYGICAAGILAGLAVFLSGTRRYRFKKLVGSPLTQVAAVTAAAWSKRSLPLPSDPDMLYDVDDAAAAGHDVKGKQRMPHSKECRFLDHAAIIDRSAAESPATASKWRLCTRTDVEEVKQVVRMLPIWATTIMFWTIHAQMTTFAVAQAELMDRRLAGGFLIPAGSLTVFLIASILLTVPFYDRLVVPVARRATANPHGLTPLQRVFVGLSLSIAGMAVAAAVERHRATASASAAAAAPTVFLLMPQFLLVGAGEAFTYMGQLDFFLRECPKGMKTMSTGLFLSTCAIGFFFSTLLVTIVHKVTGHGARGGGWLADNLDDGRLDYFYWLLAVISAINLVLFTVAARGYVYKEKRLADAGIELADEETIAVGH

SEQ ID NO: 2758 - DNA, 1566 bp, Arabidopsis thaliana
  misc_feature (1)..(1566): useful for making plants with increased nitrogen use efficiency as described in USSN 12/615,920
  misc_feature (1)..(1566): Ceres cDNA ID 2706693
atgtcagttctgtcatgggcttttaccgttgcgtggtttaccctctggatgttgatgctatacttgacgaacgagatgaagctaaagttcacagacgcagctgcgattgtaaatgtgtttgctggtgtatcagctattggtcatcttggcatgcaatttcttgttgatgcatttattggtcacttttggatgctctgtctctctactttagcattcagtttcggtttcgggttcttggcaatatcagcgtcaccaatactttcaggcaatggacaaaagggcctgttctacgtagcgctaacggttatatccgttggtatatttggacggtctatctctttgggagtatttacagaagaccaactagaagacggtaggaacaagggaaaccccgccaagctcgttagctttgtcattggaaatgtggggaattttgtgttcttgttacttgctgctattgcaatgcctcagataagtccgtggtttgttaggttcacgatcccctcgggctgtgaggtattagcaatgctgatttttatttccggtgcgtgttcatacaaacgggttaaaccaggtgggagccctttgacaacggttttccgggtctttatggcttctgcttccaaaatgtcttgtgcatactcgaacaactcaagccagctctatgaaaaagctgagtgtgatcaagatattaagccccacacaagcagcttaaggtatctagatagagctgcaatgatactccaaacagagtctttggaacaacagaggaaaaacagatggaagctttgtcgggtgacagaagtggagcaaacgaaaagcgtcatacgcacggttcctttgtttgcgacatctctcatttcggggattgtcttctctcttggtaatactttcttccttgaacaagcaaaccatatggactccaagttcggatcatggaaccttcctctcccactcctcttactctttagtgaagctgcaaggctaggatcccgagaactatgtgtcatggctgcaaaacgccatgccattgacttccctgaatcacctaaacaaaccaaaacgccttatggtataccagtctccatcatcctatcgatattttgctgctccatcgctgcacatgttgagtctaggaggctcaaagtagttagtactcaaggtttactacatgaaactgtccccatgagtgtattctggctgctcccacagtacattctactcggttcaatcacaggaatctacgaaaacagctttgcgctttacctagaagaaacggtgcctgaagagttgagccaatacatggttctattaaacgtgggagtgtgcggggtcgggatcatgagcaacattgctcttgttagtttggtgggcagtgtaagcggaggcaaatggtttcaagacacaataaacaagagccgggtggataactattattgggttataacagtgttttgcatgttcaatctcttgttatatttcattgtaacctataggtacacagtgtgtaacaagaaagatggtgcaacacaagaaaatgatcgaaggataatcgcttctgtgtag

SEQ ID NO: 2759 - protein, 521 aa, Arabidopsis thaliana
  misc_feature (1)..(521): useful for making plants with increased nitrogen use efficiency as described in USSN 12/615,920
MSVLSWAFTVAWFTLWMLMLYLTNEMKLKFTDAAAIVNVFAGVSAIGHLGMQFLVDAFIGHFWMLCLSTLAFSFGFGFLAISASPILSGNGQKGLFYVALTVISVGIFGRSISLGVFTEDQLEDGRNKGNPAKLVSFVIGNVGNFVFLLLAAIAMPQISPWFVRFTIPSGCEVLAMLIFISGACSYKRVKPGGSPLTTVFRVFMASASKMSCAYSNNSSQLYEKAECDQDIKPHTSSLRYLDRAAMILQTESLEQQRKNRWKLCRVTEVEQTKSVIRTVPLFATSLISGIVFSLGNTFFLEQANHMDSKFGSWNLPLPLLLLFSEAARLGSRELCVMAAKRHAIDFPESPKQTKTPYGIPVSIILSIFCCSIAAHVESRRLKVVSTQGLLHETVPMSVFWLLPQYILLGSITGIYENSFALYLEETVPEELSQYMVLLNVGVCGVGIMSNIALVSLVGSVSGGKWFQDTINKSRVDNYYWVITVFCMFNLLLYFIVTYRYTVCNKKDGATQENDRRIIASV

SEQ ID NO: 2760 - DNA, 1812 bp, Arabidopsis thaliana
  misc_feature (1)..(1812): useful for making plants with increased nitrogen use efficiency as described in USSN 12/615,920
  CDS (1)..(1812): Ceres cDNA ID 12711144
atgaaatatatgtctttttctcaaagtcttgttttgttctttgccatattattacaggaagtggaagaagaggtctcaagatgggaaggctacgccgattggagaaacagagcagccgtgaaaggccgtcacggtggcatgctcgccgcctctttcgtcttagtggtggagatattagagaatctagcgtatttggcgaatgcgagtaatcttgtgctatacctaagagaatacatgcacatgtctccatcaaaatcggcaaatgacgtcaccaatttcatgggcacagcttttctcctagctctcctcggtggtttcctctccgacgctttcttctccacttttcaaatcttcctcatctcagcttccatcgagtttttgggattgatcatactcacaattcaagctcggacaccatccttaatgcctccatcgtgcgatagtcccacatgtgaagaagtgagtggttcgaaggcagcgatgctattcgtggggttgtaccttgtagctttgggtgtgggagggatcaaaggttcattagcatctcacggagcagaacagtttgatgagagtacacctaaaggtcggaaacaaaggtcaacgttctttaactacttcgtgttttgtcttgcttgtggagcactagttgctgtcacgtttgtagtttggttagaagacaacaaaggatgggaatggggattcggtgtttctaccattgctatcttcgtctctattctcatctttctctctggatcaagattttataggaacaagattccatgtggaagtcctctcaccacaatcttgaaggttcttcttgcggcttcggttaagtgctgctcgagtggaagttcaagcaatgcggttgcgagtatgtccgtgagtccctcaaatcattgcgtatcaaaggggaaaaaagaagttgaatcacaaggagaattggaaaagccacgtcaagaagaagctttgcctcctcgggcacaactaactaacagtttgaaagtattaaatggagctgcggatgaaaaacctgtccatagattgttagaatgcacagtccaacaagtggaagatgtgaagattgtcttgaaaatgcttccgatatttgcttgcactatcatgcttaactgttgcttagctcagctctctacattctccgtccaacaagctgcttccatgaacacaaagataggaagcctaaagatacctccagcttccttaccgatcttccccgtcgttttcataatgatcctcgcacctatctacgaccatctcattatcccattcgctagaaaagctaccaagaccgaaacaggagtcactcatctacaaagaatcggagtaggtttagttctttcgatattagcaatggcggttgcagctctagttgagattaaacgaaagggagtggctaaagactccggcttgcttgactcgaaagaaaccttacccgtgactttcctatggatcgcacttcagtatcttttcctagggtcagccgatctattcacactagctggactactagagtatttcttcacggaagcaccttcctcaatgagatctctcgcaacatcgctctcgtgggcttctttggctatggggtattacctaagctcagtgatcgtgtccatagtaaacagcatcacaggaagctcagggaacacaccttggctcagaggaaaaagcataaaccgttacaaactagactacttctattggctaatgtgtgttcttagtgcagctaacttcttgcactacctcttttgggcaatgcgttacaagtatagatcaactggttcaagaagctaa

SEQ ID NO: 2761 - protein, 603 aa, Arabidopsis thaliana
  misc_feature (1)..(603): useful for making plants with increased nitrogen use efficiency as described in USSN 12/615,920
MKYMSFSQSLVLFFAILLQEVEEEVSRWEGYADWRNRAAVKGRHGGMLAASFVLVVEILENLAYLANASNLVLYLREYMHMSPSKSANDVTNFMGTAFLLALLGGFLSDAFFSTFQIFLISASIEFLGLIILTIQARTPSLMPPSCDSPTCEEVSGSKAAMLFVGLYLVALGVGGIKGSLASHGAEQFDESTPKGRKQRSTFFNYFVFCLACGALVAVTFVVWLEDNKGWEWGFGVSTIAIFVSILIFLSGSRFYRNKIPCGSPLTTILKVLLAASVKCCSSGSSSNAVASMSVSPSNHCVSKGKKEVESQGELEKPRQEEALPPRAQLTNSLKVLNGAADEKPVHRLLECTVQQVEDVKIVLKMLPIFACTIMLNCCLAQLSTFSVQQAASMNTKIGSLKIPPASLPIFPVVFIMILAPIYDHLIIPFARKATKTETGVTHLQRIGVGLVLSILAMAVAALVEIKRKGVAKDSGLLDSKETLPVTFLWIALQYLFLGSADLFTLAGLLEYFFTEAPSSMRSLATSLSWASLAMGYYLSSVIVSIVNSITGSSGNTPWLRGKSINRYKLDYFYWLMCVLSAANFLHYLFWAMRYKYRSTGSRS

SEQ ID NO: 2762 - protein, 567 aa, Arabidopsis thaliana
  misc_feature (1)..(567): useful for making plants with increased nitrogen use efficiency as described in USSN 12/615,920
MEVEMHGDVSKWEGYADWRNKAALRGRHGGMLAASFVLAVEILENLAFLANASNLVLYLKNFMHMSLARSSSEVTTFMATAFLLALLGGFLADAFFSTFVIFLISASIEFLGLILLTIQARRPSLMPPPCKSSAALRCEVVGGSKAAFLFVGLYLVSLGIGGIKGSLPSHGAEQFDEGTPKGRKQRSTFFNYYVFCLSCGALVAVTFVVWIEDNKGWEWGFGVSTISIFLSILVFLLGSRFYKNKIPRGSPLTTIFKVLLAASIVSCSSKTSSNHFTSREVQSEHEEKTPSQSLTNSLTCLNKAIEGKTHHIWLECTVQQVEDVKIVLKMLPIFGCTIMLNCCLAQLSTYSVHQAATMNRKIVNFNVPSASLPVFPVVFMLILAPTYDHLIIPFARKVTKSEIGITHLQRIGVGLVLSIVAMAVAALVELKRKQVAREAGLLDSEETLPITFLWIALQYLFLGSADLFTLAGLLEFFFTEAPSSMRSLATSLSWASLALGYYLSSVMVPIVNRVTKSAGQSPWLGEKLNRNRLDLFYWLMCVLSVVNFLHYLFWAKRYKYISTGSIS

SEQ ID NO: 2763 - protein, 589 aa, Arabidopsis thaliana
  misc_feature (1)..(589): useful for making plants with increased nitrogen use efficiency as described in USSN 12/615,920
MSTNYTAINHILHFHSPNSCFLMIMSLEFEQMDEANRLSAWNGYVDWRSRPALRGRHGGMLAASFVLVVEVLENLAFLANASNLVLYLSTKMGFSPSGAANAVTAFMGTAFFLALLGGFLADAFFTTFHIYLVSAAIEFLGLMVLTVQAHEHSTEPWSRVFLFVGLYLVALGVGGIKGSLPPHGAEQFDEETSSGRRQRSFFFNYFIFSLSCGALIAVTVVVWLEDNKGWSYGFGVSTAAILISVPVFLAGSRVYRLKVPSGSPITTLFKVLTAALYAKYKKRRTSRIVVTCHTRNDCDDSVTKQNCDGDDGFLGSFLGEVVRERESLPRPLRCTEEQVKDVKIVIKILPIFMSTIMLNCCLAQLSTFSVQQASTMNTKLGSFTVPPAALPVFPVVFMMILAPTYNHLLLPLARKSTKTETGITHLQRIGTGLVLSIVAMAVAALVETKRKHVVVSCCSNNNSSSYSSSPLPITFLWVAIQYVFLGSADLFTLAGMMEFFFTEAPSTMRSLATSLSWASLAMGYYFSSVLVSAVNFVTGLNHHNPWLLGENLNQYHLERFYWLMCVLSGINFLHYLFWASRYVYRSNQG

SEQ ID NO: 2764 - protein, 558 aa, Arabidopsis thaliana
  misc_feature (1)..(558): useful for making plants with increased nitrogen use efficiency as described in USSN 12/615,920
MDEANRLSAWNGYVDWRSRPALRGRHGGMLAASFVLVVEVLENLAFLANASNLVLYLSTKMGFSPSGAANAVTAFMGTAFFLALLGGFLADAFFTTFHIYLVSAAIEFLGLMVLTVQAHEHSTEPWSRVFLFVGLYLVALGVGGIKGSLPPHGAEQFDEETSSGRRQRSFFFNYFIFSLSCGALIAVTVVVWLEDNKGWSYGFGVSTAAILISVPVFLAGSRVYRLKVPSGSPITTLFKVLTAALYAKYKKRRTSRIVVTCHTRNDCDDSVTKQNCDGDDGFLGSFLGEVVRERESLPRPLRCTEEQVKDVKIVIKILPIFMSTIMLNCCLAQLSTFSVQQASTMNTKLGSFTVPPAALPVFPVVFMMILAPTYNHLLLPLARKSTKTETGITHLQRIGTGLVLSIVAMAVAALVETKRKHVVVSCCSNNNSSSYSSSPLPITFLWVAIQYVFLGSADLFTLAGMMEFFFTEAPSTMRSLATSLSWASLAMGYYFSSVLVSAVNFVTGLNHHNPWLLGENLNQYHLERFYWLMCVLSGINFLHYLFWASRYVYRSNQG

SEQ ID NO: 2765 - protein, 151 aa, Brassica napus
  misc_feature (1)..(151): useful for making plants with increased nitrogen use efficiency as described in USSN 12/615,920
MIMSLEIQQMDEANRLSVWNGYVDWRNRPALRGYHGGMLAASFVLVVEVLENLAFLANASNLVLYLSTKMGFSPSGAANAVTAFMGTAFFLALLGGFLADAFFTTFHIYLVSAAIEFLGLLVLTVQAHEHSTEPWARVVLYVGLYLVALGV

SEQ ID NO: 2766 - protein, 420 aa, Glycine max
  misc_feature (1)..(420): useful for making plants with increased nitrogen use efficiency as described in USSN 12/615,920
MLFAGLYLVALGVGGVKGSLPSHGAEQFDDNTPSGRRQRSTFFNYFVFCLSCGALIAVTFVVWVEDNKGWEWGFGISTIAIFVSIPVFLAGSTTYRSKIPSGSPLTTILKVLVAASLNSCFNSRNSSSAVVNMTSSPSNPHSGSRKQQAGKEASNTTNKEPEALTNTLKFLNKAADQNNNNPIYSSIECTVEQVEDVKIVLKVLPIFACTIMLNCCLAQLSTFSVEQAATMDTKLGSLKVPPASLPIFPVLFIMVLAPIYDHIITPFARRVTKTEMGITHLQRIGIGLVLSIVAMAVAAVVEVKRKRVAMETHTNNNNSLLGHDATKPLPITFLWIAFQYLFLGSADLFTLAGLLEFFFTEAPSSMRSLATSLSWASLAVGYYLSSAIVSIVNSVTGNTSHRPWLSGANLNHYHLERFYW

SEQ ID NO: 2767 - protein, 592 aa, Zea mays
  misc_feature (1)..(592): useful for making plants with increased nitrogen use efficiency as described in USSN 12/615,920
MEDVAPGAEPWEGYVDWRNRPATRSRHGGMAAASFVLVVEVLENLAFLANASNLVTYLMGFMHYSPSQSATAVTNFMGTAFLLALLGGFLSDAFFTTYTIYIASAFIELMGLVILTVQARTQSLMPPQCAKPAAPCEPVSGAKKAMLFAGLYLTALGVGGIKGSLPSHGAEQFDEHAARGRKGRSTFFNYFVFCLSCGALVAVTFAVWVEDNKGWQWGFGISTIAILLSIPLFVAGSSRYRNKVPTGSPLTTIAKVLIAAALARRGCAPSSSNGAVIDRAPSPTGSTDMKEYCKPGDMEEITVSGAAIVASSPAEPSRELAFLNRAVQCQPPRHGRLACTVQEVEDVKIVLMVLPIFLSTIMLNCCLAQLSTFSVEQAATMDTRVGSLTVPPASLPVFPVTFIIILAPVYDHVIVPFARRVTGTEMGITHLQRIGTGLVLSIVAMAVAAVVEVKRKNVASHNGMLDSTKPLPITFFWIAFQYLFLGSADLFTLAGLLEFFFSEAPARMRSLATSLSWASLALGYYLSSVLVSIVNSVTGRGDHRPWLQGASLNHYHLERFYWVMCVLSTINYLFFLFLAVRYKYRNAGVIKG

SEQ ID NO: 2768 - protein, 525 aa, Zea mays
  misc_feature (1)..(525): useful for making plants with increased nitrogen use efficiency as described in USSN 12/615,920
MHMDVARATTMASNFFAALQMFSIPAAFLADSYIKRFYTVLIFGPIEILGYILLAVQAHVPSLHPPPCVPGQETSTCESVSGSNLSLLLLGLYLIPIGDGAARACLPALGGEQFDRSDPVEQRQESSFFNWYTFSVSTGGFVGLVFIVWVENSKGWDVGFAVCALSVLLGMLIWIAGLPLYRNQLPTSSPITRILQVLVAAFKKRNVALPANPSELKQISQGDAGSLEILHRTDGFRCLDKAAVDTGRTGGWILCSITQVEETKIILRMVPIFLSAVLGYIPVPLILNFTVQQGNTMDTRLGALHISPATLFIIPTLFQMVILVVYDRFIVPFLRRITGYVGGVTHLQRIGIGFLSTVVATGVAAIVEASRKKVVRDSCLVDATAGIPISVFWLTIQFFLLGIVDVTSFVGLLEFFYSEASTGMKSIGSSIFYCILGVSAWLGSLLIQVANRVTRHRDGTGGWLDGTNLNKGKLERFYWLLAVLELVSLLVYVFFASRYVYGNDQRVVADEDNNTAPSDGTINVI

SEQ ID NO: 2769 - protein, 614 aa, Oryza sativa
  misc_feature (1)..(614): useful for making plants with increased nitrogen use efficiency as described in USSN 12/615,920
MENEEMSKVTQANGIDSREHKGQSIAVEANSKGETREVVEGKVDWRGRPAIRGSHGGVANSFFILVNFGLENLASLSLAVNLIIYFMTVMHIGLTDGSNLLTNYMGTSYMVAVLISVFADTFIGRYKTVIISSVIELVGLLILTLQAHSNKLKPPYCVFPFDPKCETVSGDGRTHLYVGLYLVAIGSAGIKAALPAHCADQFDEKHPTEKLQMSSFFNWLLLSLCTGGAISVTVFVWIQSYKGWDKGFGAATGVMGLALLVFIAGLPGYRISVVQGSTALLEILQVYVAAIRNRNMKLPENPDELYEISKSKAPPDTDFMAHRDKPFRFLDKAAIVQAPTDEAPSPWRQCRVTQVEHAKTVLAMVPIFCSAIIMSTCLAQLQTFSIQQGVTMDRTIGTFKMPPASLPIIPLIVLVFAVPIYERGFVPFARRITGHPNGIPHLQRVGVGLVLSIVSMAIAAVVEVRRKRVAARHGMLDANPILGKQLPISCFWLAPQFTVFGVADMFTFIGLLEFFYSQAPPALKSMSSSFLWCPMSLGYFLSTIIVKAVNAATRGATASGGWLAGNNINRNHLDLFFWLLAVLSFLNFLNYLFWASWYKYKPQQSAHVPAEHKV

SEQ ID NO: 2770 - protein, 557 aa, Oryza sativa
  misc_feature (1)..(557): useful for making plants with increased nitrogen use efficiency as described in USSN 12/615,920
MVVGGFVDWRGNPIDRKVHGGVRAAWFMFFLSVVTNMENIPNMLNLVTYLHGTMHMGVSSSATTVTNFIGATSGFALLGAFLSDSYITRSRTILLFGPLEFLALGLLALQAYLPSLHPPPCNIEAELSNCEEVHGFNTVILHIGLYTWAFSEGCIRACTPSLGADQFDHEDPSESRQQSSFFNWFTFGISLGGFIGLILIVWLENYKGWDIGFGVCALLILLGLLIVATGLPFYRNQVPEGSPLTRILQVLVVAFKNRKYELPEKLEEAQENRNGLDSIEVPRPTNFLKFLDKASINHGEDGAWSVCSTMKVEETKIVLRMLPLFISSMIGYISNPLLLTFTVQQGSMTNTRLGKIHISPATLFVIPITFQMLMLAVYDRFLVPFMRKRTGYACGITHLQRVGLGFASMIVASAVAAVVERKRKEAAVQMSLFWLAPQFFLLGVSDVTSFVGLLEFFNSEAPKDMKSIGTALFWCELGLASWMGTFLVELVNKATRHGHHRGWLEGTSLNNSHLDLFYWVVAVIGLLGFLNYLYWAKKYAYRHNPRMVTPSADQDSP

SEQ ID NO: 2771 - protein, 572 aa, Oryza sativa
  misc_feature (1)..(572): useful for making plants with increased nitrogen use efficiency as described in USSN 12/615,920
MAVGGFLDWRGNPINRKVHGGVRAAWFVYFLTVVTSTVNVPNMLNMVTYLYGTMHMGISSSSTTVTNVLGATSGFALLGAFLSDSYITRARTILLFGPLEFLGYGLLALQAYLPSLRPPPCNAEAEASSCREVHGRNAVLLYAALYISAFGDGFMRACMPPLGADQFDHEDPSESRQQSSFFNWYTFGISFGGFIGLILIVWLENSKGWDVGFGVCAFLILLGLLVVAAGLPLYRNHVPEGSPLTRILQVLVVAFKNRKLQLPEKLEEAQEERSTEQGGSTEVTEIASQTNSSLKFLDKACINGGKDGAWSVCSTKNVEETKAVLRVLPVFISSLIGYMSNPLLFTFTVQQGGLTNTRLGRIHVSPATLFIIPSAFQMALLPVYDRFLVPLLRRRTGYASGVTHLQRVGAGFAAVILASAIAAVVERKRRADAAAAGQMSLFWLAPQFFLLGVSDVTSFPGLLELFSSEAPRGMKSIASALFWCELGLSSWLATLLVQVVNRATRRHGGGGGGGWLEGATLNTSRLDLFYWVVAAVGLLGFVNYLYWASRYIYRQDPRVVVDVEPSADHDSP

SEQ ID NO: 2772 - protein, 620 aa, Arabidopsis thaliana
  misc_feature (1)..(620): useful for making plants with increased nitrogen use efficiency as described in USSN 12/615,920
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGAYISDTYVGRFKTIAFASFATLLGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFAIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSMK

SEQ ID NO: 2773 - protein, 644 aa, Arabidopsis thaliana
  misc_feature (1)..(644): useful for making plants with increased nitrogen use efficiency as described in USSN 12/615,920
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGAYISDTYVGRFKTIAFASFATLLLLNYFCIVRKRMNLLRDHAIEDDKGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFAIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSMK

SEQ ID NO: 2774 - protein, 600 aa, Oryza sativa
  misc_feature (1)..(600): useful for making plants with increased nitrogen use efficiency as described in USSN 12/615,920
MEIGAVENGGVVGGEVVAGKRGKTPQGWKCMPFIIATETFEKVATIGVVANLTVYLVKRFNIGQIEAANITNIFFGTLNFAPLLGAFISDVYLGRFKTLAYGCFASLLGMLGMTLYASLPALKPPICHEKTRLGGGCNSPSTLQLSVLYLSLGFLIIGGGAIRPCSLPFGVDQFDKTDEEGRKGLNSYYNWYYGTSTAALVLSMIVIIYIQNNVSWPIGFGIPTLLMFLAIIMLFLGTNLYVHVQPEGSIFAGIAQVLVASFKKRNLKLPCPHDINQQGLMLYNPPSKGNRVFRLPLTSQFRFLNKGAIVMGDDINVDGSARNSWELCNVQQIEEVKCLIRIVPVCISGVLCFVALAQQFTYIILQTFTMDCHFGTHFEIPAGSVVSISLIALTLFIPIYDRILVPIARGFTGVESGITLLQRQGIGLAISPISMVVAGLVERKRRNSALSNGGISPMSVLWLAPQLVLMGIAEAFNAVGQIEFYNKQFPENMQTLAGSLFFCTIAGANYLSTALANIMRKVTTRDGHSSWLTDNINLGKLDYYFYFIALMGVLNLIYFLICSHFYQYKVMSLHSEESIKIPTKEEEATEIDIDTDAPSK

SEQ ID NO: 2775 - protein, 591 aa, Oryza sativa
  misc_feature (1)..(591): useful for making plants with increased nitrogen use efficiency as described in USSN 12/615,920
MEIGAVENGGVVGGEVVAGKRGKTPQATETFEKVATIGVVANLTVYLVKRFNIGQIEAANITNIFFGTLNFAPLLGAFISDVYLGRFKTLAYGCFASLLGMLGMTLYASLPALKPPICHEKTRLGGGCNSPSTLQLSVLYLSLGFLIIGGGAIRPCSLPFGVDQFDKTDEEGRKGLNSYYNWYYGTSTAALVLSMIVIIYIQNNVSWPIGFGIPTLLMFLAIIMLFLGTNLYVHVQPEGSIFAGIAQVLVASFKKRNLKLPCPHDINQQGLMLYNPPSKGNRVFRLPLTSQFRFLNKGAIVMGDDINVDGSARNSWELCNVQQIEEVKCLIRIVPVCISGVLCFVALAQQFTYIILQTFTMDCHFGTHFEIPAGSVVSISLIALTLFIPIYDRILVPIARGFTGVESGITLLQRQGIGLAISPISMVVAGLVERKRRNSALSNGGISPMSVLWLAPQLVLMGIAEAFNAVGQIEFYNKQFPENMQTLAGSLFFCTIAGANYLSTALANIMRKVTTRDGHSSWLTDNINLGKLDYYFYFIALMGVLNLIYFLICSHFYQYKVMSLHSEESIKIPTKEEEATEIDIDTDAPSK

SEQ ID NO: 2776 - protein, 572 aa, Glycine max
  misc_feature (1)..(572): useful for making plants with increased nitrogen use efficiency as described in USSN 12/615,920
ENDPKIDYRGWKAMPFIIGNETFEKLGAIGTLANLLVYLTTVFNLKNITATNIINIFNGSTNFATFIGAFLSDTYFGRYKTIGFCTFTSFLGLLVIQLTAVFKNLHPPHCGKEMKTCKGPTAGQMAFLVSGFGLLLIGAAGVRPCNLAFGADQFNPNTDSGKKGINSFFNWYFFTFTFAQMVSLTLIVYVQSNVSWAIGLGIPAALMLISCVVYFMGSKIYVKVEPSGSPIAGIVQVFVVAVKKRSIKLPAEHPMLSLFNYVPPMSVNSKLPYTFQFRLLDKAAIVTPKDKIKPDGSAADPWNLCSIQQVEEAKCVVRVLPIWFAAIVYHLVIVQMHTLLVFQALQSDRRLGSSNFKIPGASFNVFLMLSMTLWLPIYDRIVVPFSLSNTPEKSGGITLLQSDGIGIFISALCMIVAGVVEEHRRSLALTNPIGVQPRKGAISSMSGLWLIPQLSLAGLSESFTAVGQVEFYYKQFPENMRSIAGSLFYCGMAGSSYLSTLLISIVHNTSEKSATGNWLPEDLNKGRLDFFYYMIAALEIMNLGYFLLCSKWYKYKEIGSSDLELNQVPKHI

SEQ ID NO: 2777 - protein, 572 aa, Glycine max; identical to SEQ ID NO: 2776
  misc_feature (1)..(572): useful for making plants with increased nitrogen use efficiency as described in USSN 12/615,920

SEQ ID NO: 2778 - protein, 604 aa, Cucumis sativus
  misc_feature (1)..(604): useful for making plants with increased nitrogen use efficiency as described in USSN 12/615,920
MEIESLRVSVDEKVLKDEEKNEKEEMKMKMKMKRKLGGVKTMPFILGNEVCDRFASSGFHSNIITYLTQDLNMPLVPASNILTNFAATSSFTSLIGALIADSFAGRFWTITIASIIYELGMVTITISAILPSLHPPPCPTQINCTQASGTQLMILYLALLLTSLGAGGIRPCVVAFAADQFDMTKVGIAGRTWNFFNWYYFCMGMATLTALTVVVYIQDNVGWGWGFGLPTIAMALSVVAFVVGSPLYNKLKPSGSPLVRLAQVVVAAFKNRKAVLPDDSKLLYRNHELDAAIAIQGRLVHTDQFKWLDKAAVITSPDSTANPPNLWRLATVHRVEELKSIIRMLPIWAAGILLVTASSHQHSFTIQQARTMNRHLTPTFQIPPATLSIFGILSMLTGLVLYDRLLVPFAKKLTHNPSGITCLQRMGVGFAINILATLVSSIVEIKRKKVAANHGLLDNPTATIPFSVFWLVPQFWLHGIAEVFMSVGHLEFMYDQSPESLRSTATALYWLAISVGNYIGTLMVYLVHKYTGEEHNWLPDRNLNRGRLEYYYWLVSGIQVMNLVYYVICAWFYTYKPLEEEKINIENKDGDQEWERCEDTIKIA

SEQ ID NO: 2779 - protein, 574 aa, Oryza sativa
  misc_feature (1)..(574): useful for making plants with increased nitrogen use efficiency as described in USSN 12/615,920
MALNAFAQPVTNYLIKRYNMKPNAATNVANVFSGTYSFSPVVGAFVADAFCGRFWTLLFGAVAAFVAMVVITLSATIRQLKPPSCSDVARQAGTCAGPSGLHRAVLYIGMALLVVATGGANPTSLPFGADQFDHDDASSGSSSNEADERRRRAEEPAGLKRFYNWYYVVTMMASFMALTFIAYIQDKVSWGLGFGIPTALVAATFAVFLAGTPLYVRVPAEGSIFSSVARVVVASCRKRRLTLPHPRDARQQEAVLYNPPVVVAAGTGTSRVFKLPLTLQLSFLNKAAIVTADADEIRPDGSPARPWSLCSVQQVEEVKCLVKIVPVWISGVMWFISVAELTNYTFLQALTMDLHMGRSFTIPPVSIAAIFNLAIVLFVPVYDLLVARAAQRVTGVEGGITVLQRQGVGVAISGLALVVAAVVERRRRASALDNGGTSPMSVFVLAPQLAVMGVSAAFNMIGQMEFYNTEFPDQMRTLANAAFYCAQGASSYLATAVVNVVNARTRRRGGGQGWVAEDINAGKLDHFYYAMAVFAAINFVYFLVCSYFYRYKGEPEVAAEDSPPATPEAVLLKH

SEQ ID NO: 2780 - protein, 580 aa, Zea mays
  misc_feature (1)..(580): useful for making plants with increased nitrogen use efficiency as described in USSN 12/615,920
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 2781 - protein, 580 aa, Zea mays
  misc_feature (1)..(580): useful for making plants with increased nitrogen use efficiency as described in USSN 12/615,920
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESVIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 2782 - protein, 580 aa, Lycopersicon esculentum; identical to SEQ ID NO: 2689
  misc_feature (1)..(580): useful for making plants with increased nitrogen use efficiency as described in USSN 12/615,920

SEQ ID NO: 2783 - protein, 579 aa, Hordeum vulgare
  misc_feature (1)..(579): useful for making plants with increased nitrogen use efficiency as described in USSN 12/615,920
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTSLYRHQRPGGSPLTRIAQVLVAATRKLGVAVDGSALYETADKESGIEGSRKLEHTRQFRFLDKAAVETHADRTAAAPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQHGLYGEKDVVPISIFWQVPQYFIIGCAEVFTFVGQLEFFYDQAPDAMRSMCSALSLTTVALGNYLSTLLVTVVAKVTTRGGKQGWIPDNLNVGHLDYFFWLLAALSLVNFAVYLLIASWYTYKKTAGDSPDAKGGAHDQ

SEQ ID NO: 2784 - protein, 584 aa, Vicia faba; identical to SEQ ID NO: 2688
  misc_feature (1)..(584): useful for making plants with increased nitrogen use efficiency as described in USSN 12/615,920

SEQ ID NO: 2785 - protein, 594 aa, Prunus persica
  misc_feature (1)..(594): useful for making plants with increased nitrogen use efficiency as described in USSN 12/615,920
MSNCTLPETQEKLTLPDAWDFKGRPAERSKTGGWTAAAMILGGEACERLTTLGIAVNLVTYLTGTMHLGNATSANTVTNFLGTSFMLCLLGGFVADTFLGRYLTIAIFATFQAMGVTILTISTTIPSLRPPKCTSDTSTPCIPASGKQLMVLYIALYLTALGTGGLKSSVSGFGSDQFDESDKQERRQMTNFFNWFFFFISIGSLAAVTVLVYIQDNLGRQWGYGICVCAIVLGLIVFLSGTRRYRFKKLVGSPLTQISGVCVAAWRKRNMELPSDMSFLYNVDDIDDGLKKKKKQKLPHSKQFRFLDKAAIKEPKTTSGTAMIINKWSLSTLTDVEEVKLIIRMLPIWATTIMFWTVYAQMTTFSVSQATSMDRHIGKSFQIPPASLTAFFVGSILLTVPVYDRLIVPMARKALENPQGLTPLQRMGVGLVFSIFAMVAAALTEVKRLNIARSHGLTDNPTAEIPLSVFWLVPQFFFVGSGEAFTYIGQLDFFLRECPKGMKTMSTGLFLSTLSLGFFFSSLLVTIVHKTTGHNKPWLADNLNQGKLYDFYWLLALLSALNLVIYLFCANWYVYKDKRLAEEGIELEEPEICA

SEQ ID NO: 2786 - protein, 567 aa, Solanum demissum
  misc_feature (1)..(567): useful for making plants with increased nitrogen use efficiency as described in USSN 12/615,920
MESSVRGVDEAAIMKSSTRRKNGGWITFPFIIVSATMAGLSLASGGWTSNLIVYLIDEFNMKSIKTAKVYNVINGCTTLFPIVGGILADSYLGSFSVIWFSSLISALGILLLLFTSAIDVLRPPPCDDGSSLCTSPSTHQYAVLYVALALASLGVAGTRFIIAPMGANQFDKPKHQAIFFNWYIFAFYMSFAISTTVIVYVEDNVSWSWGYGISMAFNILGLAMFLIGKRFYCDVKEQGGSPFVNLARVIVVAIQKWRVPLSEQTQHYYHDPSDTTTTLTITQIPTKSFKFLNCAAFITEGDTKPDGSISNPWRLCTVQQVEDLKSLIKLFPLWASGFLISTQLVIQASLLILQALKMDRHMGPHFEIPAGSMLVFILLFTCIAIFIIDRFLYPFLAKYTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAHYLGNTLIDLVQRLSGWLPDNINKGRTDNVFWLCCILGSANFMYYVVCASLYKYKNVDNKSNIAPSK

SEQ ID NO: 2787 - protein, 559 aa, Prunus dulcis; identical to SEQ ID NO: 2685
  misc_feature (1)..(559): useful for making plants with increased nitrogen use efficiency as described in USSN 12/615,920
  misc_feature (46)..(46): Xaa can be any naturally occurring amino acid

SEQ ID NO: 2788 - protein, 228 aa, Glycine max
  misc_feature (1)..(228): useful for making plants with increased nitrogen use efficiency as described in USSN 12/615,920
RALNKAALIMEGELNPDGTRVNQWRLVSIQQVEEVKCLARIIPIWAAGILSLISMTQQGTFTVSQAMKMNRHLGAKFQIPAGSVSVISLITIALWLPFYDRILVPKLRKMTKHEGGITLLLRIGIGMVFSILSMVVAGYVEKVRRDSANSNPTPLGIAPMSVLWLAPHLILMGLCEAFNIIGQIEFFNRQFPEHMRSIGNSFFSCSFGVSSYVSSIIGQHSSSFYKNT

SEQ ID NO: 2789 - protein, 594 aa, Nicotiana plumbaginifolia
  misc_feature (1)..(594): useful for making plants with increased nitrogen use efficiency as described in USSN 12/615,920
MALPETQQDSKALPDAWDYKGRPALRSSSGGWASGAMILGVEAVERLTTLGIAVNLVTYLTGTMHLGNATAANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDGDKKEKGQMIKFFDWFFFFINVGSLGAVTVLVYIQDNLGREWGYGICACAIVIGLVVFLSGTRKYRFKKLVGSPLTQIASVIVAAWKKTHLELPSNSSLLFEIDNIFGEGNKKSKQKLPHSKEYRFLDKAAIKEDNDLESNGTKVVINKWKLATLTDVEEVKLLIRMLPTWATTIMFWTVYAQMTTFSVSKATTMDRHIGTFEIPPASLTVFFVGSILLTVIFYDRIIVPICRRFMNKPHGLTPLHRIFTGLVLSILAMIAAALTEVKRLKVAHLHGLTNDANATIPLTVFWLVPQFLLVGAGEAFTYIGQLDFFLRECPKGMKTMSTGLFLSTLALGFFVSSILVTIVHVVTGTKNPWLADNLNQGRLYDFYWLLAILSVFNLMFFLYSSRKYVYKEKRLAEMGIELEDDGPVCH

SEQ ID NO: 2790 - protein, 566 aa, Oryza sativa; identical to SEQ ID NO: 2703
  misc_feature (1)..(566): useful for making plants with increased nitrogen use efficiency as described in USSN 12/615,920

SEQ ID NO: 2791 - protein, 435 aa, Triticum aestivum
  misc_feature (1)..(435): useful for making plants with increased nitrogen use efficiency as described in USSN 12/615,920
  misc_feature (3)..(3): Xaa can be any naturally occurring amino acid
  misc_feature (21)..(21): Xaa can be any naturally occurring amino acid
  misc_feature (328)..(328): Xaa can be any naturally occurring amino acid
  misc_feature (342)..(342): Xaa can be any naturally occurring amino acid
  misc_feature (398)..(398): Xaa can be any naturally occurring amino acid
  misc_feature (400)..(400): Xaa can be any naturally occurring amino acid
  misc_feature (432)..(432): Xaa can be any naturally occurring amino acid
MSXGAGGIRPCSMAFGADQFXRHPKERRSRILQAYFNAYYASIGVAFTVAVTVIVYVQDNVGWKAGFAVPMGLMMLSAVSFLLGSRLYVKEKGSKQMFAGIGAALVAAIRNYRVQLPAKTEDGVYHHLKDCKLTVPTDRLRFLNKACIISNNGGVDLPGTGAAASERDGNVGGRRLCTVDQVEQLKSAVRILPIWSSTVFLAQAMSQNYAVLQANEMDRRIGVGQFRVPGCSLTMFNMVTMSLWSGSYDRWIAPALRRVTGDPRGLTMKQRVGVGLLLATAAMAVSGAVEGARRRLELAGGGGAGMSAFWLVPQFALMGLAEAFGVIXELEFFYTELPKSMXSFSMALLYMAMGVGNLVNSLIVKVVDDASRRGGRTSWLSSDLNAGHYDYYYWLLAXLXAVNFVYFLWCAWKYGEEGKNVEWEEGEGEREXPMA

SEQ ID NO: 2792 - protein, 583 aa, Alnus glutinosa
  misc_feature (1)..(583): useful for making plants with increased nitrogen use efficiency as described in USSN 12/615,920
MEESKKSCFISDRVDYKGDPADRNTTGGWVPAALIVGIEVSERLSTMGIIVNLVTYLKGTMHQSSTTSSNSTSNVAGTSFLLCLLGGILADSFLGRYWTIAIFSVIHALGTCMLAISAALPELRPSECNLHHDFPLKCEEPSSFQMGILYTALYSMALGVGGIKSSVSGFGTEQFDQNDEKEMSEMAHFFNRFYLIISFGTLLAVTVLVYVQDQVGRSWGYGICSASMFLSIVAFLVGTKRYRYRECTGSPIIQILQVIVAAIRKRKAELPTDLSFLYDKASDKESTISHTDKYSCLDKGAIITGMDRGADGLTISNPWGLCTVTEVEEVKMLIRILPIMASTIIFWTIRAQLLSFSVQQAATMERTIENFPIPPASFNGFFVGSTIITLIMYDRLLPFLRQSSNGVQGFTNLQKIGIAIFLSILGMAAASFAEMKRLEVVRANRGSTSTSSTLPITAFYLLPQFVLVGIGDGFMYTGQLDFFITESPKGMKAISTGLFLTTNALGFFGSSILVTIITKVTGEEVGHGWLLSRINDSRLDFFYALLAVLGFINLVFYLVLASWYKPSPVEDAHQKINGKEEKV

SEQ ID NO: 2793 - protein, 275 aa, Xerophyta humilis
  misc_feature (1)..(275): useful for making plants with increased nitrogen use efficiency as described in USSN 12/615,920
SLQQVEEVKCLLRIIPIWSTGIIYYIAIVQQQTYVVYEALQSDRHLGNTSFLIPAASYSVFAMLAMTIWIPIYDRIIVPRFRKLTGQEGGITLLQRMGVGLVLAIIGMVVSAIIEIQRRSYAIHRPTIGTAPSGGAISSMSSLWLIPQLVILGLSEAFNAIGQIEFYYKQFPENMRSVAGSLFFLGAATANYLSGALIGVVHRVTGRGAGKNWLAGDLNKGRLDYYYFFIAGLGVLNLVYFMMCAKWYKYKEADSSSNAGEISLVDEIISKEPLV

SEQ ID NO: 2794 - protein, 297 aa, Nepenthes alata; identical to SEQ ID NO: 2690
  misc_feature (1)..(297): useful for making plants with increased nitrogen use efficiency as described in USSN 12/615,920

SEQ ID NO: 2795 - protein, 84 aa, Brassica napus
  misc_feature (1)..(84): useful for making plants with increased nitrogen use efficiency as described in USSN 12/615,920
RVLVPFLRRITGHKSGITLLQRIGTGIVFAILSMIVAGLVERKRRIRSINAGDATGMTPMSVFWLSPQLILMGLCEAFNIIGTD

SEQ ID NO: 2796 - protein, 201 aa, Cicer arietinum
  misc_feature (1)..(201): useful for making plants with increased nitrogen use efficiency as described in USSN 12/615,920
AILITLAVNDRIIMPLWKKMKGKPGFTNLQRIAIGLLLSTFGMAAASLCEVKRLSVAKSVKGNQATIPISVFLLIPQFFLVGSGEAFIYTGQLDFFITQSPKGMKTMSTGLFLTTLSLGFFISSFLVSVVKKVTGTRDGQGWLADNINKGRLDLFFALLTILSFINFVAFLVCAFWYKPKKAKPSMQMGAINNGSSVEEKC

SEQ ID NO: 2797 - protein, 159 aa, Plantago major
  misc_feature (1)..(159): useful for making plants with increased nitrogen use efficiency as described in USSN 12/615,920
MLQRIGIGLVLSLVSIVYAAIIERKRLATAMEYGLVDMPKAVVPMSALWLAPQYVLSGVADVFTMIGLQEFFYDQIPCDLKSIGLAMYLSILGIGSLLSSFLVSFIQNMTKGHGQDGWFADNLNKAHLDYFYWLLAGLSTVGLSAYIYFARSYVYRRKV

SEQ ID NO: 2798 - protein, 138 aa, Glycine max
  misc_feature (1)..(138): useful for making plants with increased nitrogen use efficiency as described in USSN 12/615,920
  misc_feature (92)..(92): Xaa can be any naturally occurring amino acid
  misc_feature (130)..(130): Xaa can be any naturally occurring amino acid
LDQVYASNILNIWSGITNFFPLIGAFISDAYVGRFWTIAFASFSSLLGMVVVTLTAWLPELHPPPCTPQQQALNQCVKASTPHLGALLTGLXLLSVGSAGIRPCSIPFGVDQFDPSTDEGKKGINSFFNXYYTTFTVV

SEQ ID NO: 2799 - protein, 112 aa, Fragaria x ananassa
  misc_feature (1)..(112): useful for making plants with increased nitrogen use efficiency as described in USSN 12/615,920
EITGHPAGITQLQRVGIGLVLSAVSMAVAGIVEVKRRNYALAHSPLAPGGISLFWLSFQYAIFGIADMFTLVGLLEFFYREAPAGMKSLSTSFTWLSLSFGYFLSSTLLRTH

SEQ ID NO: 2800 - protein, 110 aa, Arabidopsis thaliana
  misc_feature (1)..(110): useful for making plants with increased nitrogen use efficiency as described in USSN 12/615,920
MEAGKTPPTTTTTTEKKTEQVKDNDLPTDSPYMATGTLEDYKLKAYGAEVTKSLLLVLEVAPPMLLLLLATHPPPLPPMRKSVKKKKDYNNERVLWIVGKQTHNCSMFNN

SEQ ID NO: 2801 - protein, 111 aa, Arabidopsis thaliana
  misc_feature (1)..(111): useful for making plants with increased nitrogen use efficiency as described in USSN 12/615,920
  misc_feature (62)..(62): Xaa can be any naturally occurring amino acid
MEAGKTPPTTTTTTEKKTEQVKDNDLPTDSPYMATGTLEDYKLKAYGAEGHQEPTPGLGGGXHRCSYSFWRRTRRHYHRCESSVKKKKDYNNERVLWIVGKQTHNCSMFNN

SEQ ID NO: 2802 - protein, 83 aa, Arabidopsis thaliana
  misc_feature (1)..(83): useful for making plants with increased nitrogen use efficiency as described in USSN 12/615,920
MEAGKTPPTTTTTTEKKTEQVKDNDLPTDSPYMATGTLEDYKLKAYGAEGHQEPTPGLGGGSTDAPTPSGDAPAATTTDAKAP

SEQ ID NO: 2803 - protein, 83 aa, Arabidopsis thaliana; identical to SEQ ID NO: 2802
  misc_feature (1)..(83): useful for making plants with increased nitrogen use efficiency as described in USSN 12/615,920

SEQ ID NO: 2804 - protein, 83 aa, Arabidopsis thaliana; identical to SEQ ID NO: 2802
  misc_feature (1)..(83): useful for making plants with increased nitrogen use efficiency as described in USSN 12/615,920

SEQ ID NO: 2805 - protein, 83 aa, Arabidopsis thaliana
  misc_feature (1)..(83): useful for making plants with increased nitrogen use efficiency as described in USSN 12/615,920
MEAGKTPPTTTTTTEKKTEQVKDNDLPTDSPYMATGTLEDYKLKAYGAEGHQEPTPGLGGGSTNAPTPSGDAPAATTTDAKAP

SEQ ID NO: 2806 - protein, 83 aa, Arabidopsis thaliana; identical to SEQ ID NO: 2802
  misc_feature (1)..(83): useful for making plants with increased nitrogen use efficiency as described in USSN 12/615,920

SEQ ID NO: 2807 - protein, 83 aa, Arabidopsis thaliana
  misc_feature (1)..(83): useful for making plants with increased nitrogen use efficiency as described in USSN 12/615,920
MEAGKTPPTTTTTTEKKTEQVKDNDLPTDSPYMATGTLEDHKLKAYGAEGHQEPTPGLGGGSTDAPTPSGDAPAATTTDAKAP

SEQ ID NO: 2808 - protein, 83 aa, Arabidopsis thaliana
  misc_feature (1)..(83): useful for making plants with increased nitrogen use efficiency as described in USSN 12/615,920
MEAGKTPPTTTTTTENKTEQVKDNDLPTDSPYMATGTLEDYKLKAYGAEGHQEPTPGLGGGSTDAPTPSGDAPAATTTDAKAP

SEQ ID NO: 2809 - protein, 82 aa, Brassica napus
  misc_feature (1)..(82): useful for making plants with increased nitrogen use efficiency as described in USSN 12/615,920
MEAEKIPPATTTTEKKPEQEVKNDDLPTNSPYVDESGSLEDYKMKAYGAQGHQEVKAGLGGGSTDAPTPSGGVTTATAEKAP

SEQ ID NO: 2810 - protein, 228 aa, Arabidopsis thaliana
  misc_feature (1)..(228): useful for making plants with increased nitrogen use efficiency as described in USSN 12/615,920
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 2811 - protein, 225 aa, Arabidopsis thaliana
  misc_feature (1)..(225): useful for making plants with increased nitrogen use efficiency as described in USSN 12/615,920
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLGKFSFLFVS

SEQ ID NO: 2812 - protein, 234 aa, Arabidopsis thaliana
  misc_feature (1)..(234): useful for making plants with increased nitrogen use efficiency as described in USSN 12/615,920
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLGKFSFLFVSISGSFLFFQ

SEQ ID NO: 2813 - protein, 247 aa, Glycine max
  misc_feature (1)..(247): useful for making plants with increased nitrogen use efficiency as described in USSN 12/615,920
MATMLTKEHGLNLKETELCLGLPGGGGGGGGGGGGGGGEVETPRATGKRGFSETVDLKLNLHSKEDLNENLKNVSKEKTLLKDPAKPPAKAQVVGWPPVRSYRKNMMAVQKVSTEDVAEKTTSSTANPGAFVKVSMDGAPYLRKVDLTMYKSYKELSDALAKMFSSFTMGNYGAQGMIDFMNESKLMDLLNSSEYVPSYEDKDGDWMLVGDVPWEMFVESCKRLRIMKGSEAIGLAPRAMEKCKSRS

SEQ ID NO: 2814 - protein, 277 aa, Populus tremula x Populus tremuloides
  misc_feature (1)..(277): useful for making plants with increased nitrogen use efficiency as described in USSN 12/615,920
MATATVLGTERADLNYKATELCLGLPGAVGVKNEVETPNKATGKRGFAETVDLKLNLQAKEGVMDLNENINNIASEDKNHLPSATIKDPAKPPAKAQVVGWPPVRSYRKNVLAQKNASEEGFGAQVEGWPPVRSYRKNVLVQKNASEEGEKASTGGCSAAFVKVCMDGAPYLRKVDLKMYKSYQELSDALAKMFSSLTMGNYGAQGMIDFMNESKLMDLLNSSEYVPSYEDKDGDWMLVGDVPWEMFVDSCKRPRIMKGSEAVGLAPRAMEKCKSRT

SEQ ID NO: 2815 - protein, 240 aa, Nicotiana tabacum
  misc_feature (1)..(240): useful for making plants with increased nitrogen use efficiency as described in USSN 12/615,920
MTSVMGAECDKIQLDYEAETELRLGLRSAINGNEGEMTSKNNGKRVFSETVDLKLNLSSKDSTVDNQVDNIKEKKNIAPTDPAKPPAKAQVVGWPPVRSFRKNVLTVQKNSTGNGESSGGGAAFVKVSVDGAPYLRKVDLKMYKSYQQLSDALGKMFSSFTIGNCGTHGFKDFMNESKLIDLLNGSDYVPTYEDKDGDWMLVGDVPWEMFVDSCKRLRIMKGSEAIGLAPRAVEKCKNRS

SEQ ID NO: 2816 - protein, 227 aa, Plantago major
  misc_feature (1)..(227): useful for making plants with increased nitrogen use efficiency as described in USSN 12/615,920
MVESCTKMNFEETELRLGLPGGAAAAGEKTTNNNNYGKRGYEQTVDLKLNLSSKDLPNQTDLAENKKNDQPVKPPAKAQVVGWPPVRNFRKNVMAVQKTEKAEESGGSAAFVKVSMDGAPYLRKVDLKMYKTYEELSDALGKMFSSFTMSKCDAQGMMDFMNESKLMDLLNGSDYVPTYEDKDGDWMLVGDVPWEMFVGSCKRLRIMKGTEAIGLAPRAMEKCKSRS

SEQ ID NO: 2817 - protein, 246 aa, Glycine max
  misc_feature (1)..(246): useful for making plants with increased nitrogen use efficiency as described in USSN 12/615,920
MVFEETELRLGLGLCLPGNGTTATTEAAAAELGVRKRGFSETETDETATVDLMLNLSPKEAAAADGADPREKPKTSPKEKTLLLPDPAKPPAKAQVVGWPPVRSFRKNMFAAQKSSGGEESEKSSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 2818 - protein, 248 aa, Glycine max
  misc_feature (1)..(248): useful for making plants with increased nitrogen use efficiency as described in USSN 12/615,920
MVFEETELRLGLRLGLPGNGAAPTTEAAAELGVRKRGFSETETDETTSVDLMLNLSPKEASAAATTDGADPRENPKTSPKDKNLPLLDPAKPPAKAQVVGWPPVRSFRKNMFAAQKSSGGEESEKNSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 2819 - protein, 164 aa, Arabidopsis thaliana
  misc_feature (1)..(164): useful for making plants with increased nitrogen use efficiency as described in USSN 12/615,920
LKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 2820 - protein, 164 aa, Arabidopsis thaliana
  misc_feature (1)..(164): useful for making plants with increased nitrogen use efficiency as described in USSN 12/615,920
LKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSFEYVPSYEDKDGDWMLVGDVPWPMFVESCKRLRIMKGSEAIGLAPRAMEKFKNRS

SEQ ID NO: 2821 - protein, 231 aa, Glycine max
  misc_feature (1)..(231): useful for making plants with increased nitrogen use efficiency as described in USSN 12/615,920
MINFEETELRLGLPGGSASDHNESTTVKGSGGKRGFSETASVDLKLNLSSSDDSASDSPSSASTEKTTTAAPLPPSRANDPAKPPAKAQVVGWPPVRSFRKNIVQRNKNEEEAAFVKVSMDGAPYLRKVDIKLYKSYQELSDALAKMFSSFTIEKCGSQGMKDFMNETKLIDLLNGSDYVPTYQDKDGDWMLVGDVPWEMFVESCQRLRIMKGSEAIGLAPRAVEKCKNRS

SEQ ID NO: 2822 - protein, 194 aa, Mirabilis jalapa
  misc_feature (1)..(194): useful for making plants with increased nitrogen use efficiency as described in USSN 12/615,920
MMKNDMNKSGGGVIAKDVNDNTKVNGANNNADLAKPPAKAQVVGWPPVRSYRKNMLAVQKSTGAPESESEKPAANGGLVKVSMDGAPYLRKVDLKLYKSYQDLSDALGKMFSSFTLGNYGSQGMIDFMNESKLMDLINGSDYVPTYEDKDGDWMLVGDVPWEMFVESCKRLRIMKGKEAAGLAPRAMEKCKNRI

SEQ ID NO: 2823 - protein, 229 aa, Populus tremula x Populus tremuloides
  misc_feature (1)..(229): useful for making plants with increased nitrogen use efficiency as described in USSN 12/615,920
MEVEKGTKMRFEETELRLGLPGNGGGGTEGGEFARKRGFSETVDLKLNLSSKEGGIDPNHEKTRREKNLLATDPAKPPAKAQVVGWPPVRSFRKNMLAVQKSSTDQESTNKVPGGNATFVKVSMDGAPYLRKVDLNMYKTYHELSDALGKMFSSFTIGNCGSHGMKDFLNESKLIDLLNGTDYVPSYEDKDGDWMLVGDVPWDMFVESCKRLRIMKGTEATGLGNEYTA

SEQ ID NO: 2824 - protein, 243 aa, Glycine max
  misc_feature (1)..(243): useful for making plants with increased nitrogen use efficiency as described in USSN 12/615,920
MGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEESEKNSSPNASFVKVSMDGAPYLRKVDLKMYKSYRELSDSLGKMFSSFTFGNCESQGMKDFMNESKLNDLLNSSDYVPTYEDKDGDWMLVGDVPWEMFVESCKRLRIMKGKEAIGLGLAPRAMAKCKNRS

SEQ ID NO: 2825 - protein, 252 aa, Glycine max
  misc_feature (1)..(252): useful for making plants with increased nitrogen use efficiency as described in USSN 12/615,920
MEVGLKKENMGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEESEKNSSPNASFVKVSMDGAPYLRKVDLKMYKSYRELSDSLGKMFSSFTFGNCESQGMKDFMNESKLNDLLNSSDYVPTYEDKDGDWMLVGDVPWEMFVESCKRLRIMKGKEAIGLGLAPRAMAKCKNRS

SEQ ID NO: 2826 - protein, 254 aa, Glycine max
  misc_feature (1)..(254): useful for making plants with increased nitrogen use efficiency as described in USSN 12/615,920
  misc_feature (162)..(162): Xaa can be any naturally occurring amino acid
MEVGLNKKENMGFEETELRLGLPGNVGGTGTEEVLIRKRGFSETETETEEDESATTVDLMLNLSSKEAAAAADPTDKHKTLPKEKTLLPADPAKPPAKAQVVGWPPVRSFRKNMLAVQKSVGEENEKNSSSPNASFVKVSMDGAPYLRKVDLKMYKSYRELXDSLGKMFSSFTIGNCESQGMKDFMNESKLNDLLNSSDYVPTYEDKDGDWMLVGDVPWEMFVESCKRLRIMKGKEAIGLGLAPRAMAKSKNRS

SEQ ID NO: 2827 - protein, 275 aa, Zea mays
  misc_feature (1)..(275): useful for making plants with increased nitrogen use efficiency as described in USSN 12/615,920
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAAAVLADPAEKPRAAKAQVVGWPPVRSFRKNIMSVQSDKGAGKDAAAANGDKSSAAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 2828 - protein, 230 aa, Cucumis sativus
  misc_feature (1)..(230): useful for making plants with increased nitrogen use efficiency as described in USSN 12/615,920
MEKKKMGFEETELRLGLPGNNNIGSSELGEVAARKRGFAETVSSETISKVDLKLNLSSKETVGVGDDDLVADSNPSNKDKAVLTADPAKPPAKAQVVGWPPVRSFRKNNMLAFVKVSMDGAPYLRKVDLKMYKSYKQLSDALAAMFGSFTTIGNCGSQEMKDFMNESKLMDLLSGSDYVPTYEDKDGDWMLVGDVPWEMFVESCKRLRIMKGKEAIGLAPRAMEKCKNRS

SEQ ID NO: 2829 - protein, 252 aa, Triticum aestivum
  misc_feature (1)..(252): useful for making plants with increased nitrogen use efficiency as described in USSN 12/615,920
MAADLGFEATELRLGLPGGGEGEARSSSGKRGFAETIDLKLKLEPAGEEAPAEEDRADVAVVAAAAAENQEETATDAGGGKMKRSPSQSSVVTTAALPDPAEKPRAPKAQVVGWPPVRSFRKNILAEKSSPAAAAAFVKVSMDGAPYLRKVDLNMYKTYQDLSKALEKMFSSFTIGNCGTPGMNGMNESKLMDLLNGSEYVPTYEDKDGDWMLVGDVPWEMFVESCKRLRIMKGSEAIGLAPRAMEKCKNRS

SEQ ID NO: 2830 - protein, 233 aa, Triticum aestivum
  misc_feature (1)..(233): useful for making plants with increased nitrogen use efficiency as described in USSN 12/615,920
MAGADVDVGTELRLGLPGGGAEAAKAGKRGYEDTIDLKLTLPTGGMQEDSAGKPEPAADKAKRPAEAAAADPEKPPAPKAQAVGWPPVRSYRRNAMTVQSVKIKKEEETEKQQPAAAAAAGANGSNFVKVSMDGAPYLRKVDLKMYNTYKDLSIALQKMFSTFTATGNEGKMVEAVNGSDVVTTYEDKDGDWMLVGDVPWEMFVASCKRLRIMKGSEAIGLAPRAKDKYKNKS

SEQ ID NO: 2831 - protein, 233 aa, Triticum aestivum; identical to SEQ ID NO: 2830
  misc_feature (1)..(233): useful for making plants with increased nitrogen use efficiency as described in USSN 12/615,920

SEQ ID NO: 2832 - protein, 302 aa, Pinus pinaster
  misc_feature (1)..(302): useful for making plants with increased nitrogen use efficiency as described in USSN 12/615,920
MERFANDVDEHSLKETELRLGLPGVCESDTGPGQTRNGKRGFSEVMDSTKASSFNDNKWIFPSVKCQPATSAITETAEACKGSQPGLFSATPSQKIMMQGGCGAPQSWAGDNGLSRSTAPKDELHPKTPRDGPTEKTNGASQSQAATDPAMAPAPKAQVVGWPPIRSFRKNTLAANSKPNDEGSSSNALYVKVSMDGAPYLRKVDLKMYSTYHELSSALEKMFSCFNMGQCGAPGLSESKLIDLLNGSEYVPTYEDKDGDWMLVGDVPWEMFVDSCKRLRITKASEAIGLAPRAMEKSRSKN

SEQ ID NO: 2833 - protein, 188 aa, Saccharum hybrid cultivar
  misc_feature (1)..(188): useful for making plants with increased nitrogen use efficiency as described in USSN 12/615,920
SSVVTAAAAIQADPAEKPRAPKAQVVGWPPVRSFRKNIMSVQSDKGAGGSKDADKSSPPPAAAAAVGGAAFVKVSLDGAPYLRKVDLKMYKMYKSYQELSKALEKMFSSTIGSCGSQGMNGMNESKLVDLLNGSEYVPTYEDKEGDWMLVGDVPWEMFVESCKRLRIMKGSEAIGLAPRAMEKCKNRS

SEQ ID NO: 2834 - protein, 252 aa, Glycine max
  misc_feature (1)..(252): useful for making plants with increased nitrogen use efficiency as described in USSN 12/615,920
  misc_feature (157)..(157): Xaa can be any naturally occurring amino acid
MAGLGFEETKLRLGLPGGSNEAEEAAAAVRSSGKRGYAETIDLVLKLEPASVAAPPFEDDEEVADGVAEAQPSPAAADGQLKRSPSQCSVVTAAQPDADPEKPRAPKAQAVGWPPVRSFRRNMLAATAERGGAALVKVSMDGAPYLRKVDMGTYKSXQELSKALEKMFSSFTIGNDCSQAQGMTGMNESKLVDLLNGSDYVPTYEDKDGDWMLVGDVPWEMFVASCKRLRIMKGSEAIGLAPRAMEKCKSRS

SEQ ID NO: 2835 - protein, 236 aa, Oryza sativa
  misc_feature (1)..(236): useful for making plants with increased nitrogen use efficiency as described in USSN 12/615,920
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAVTTYEDKDGDWMLVGDVPWQMFVESCKRLRIMKGSEAIGLAPRAKDKYKNKS

SEQ ID NO: 2836 - protein, 302 aa, Pinus taeda
  misc_feature (1)..(302): useful for making plants with increased nitrogen use efficiency as described in USSN 12/615,920
MERFANDGDEHSLKETELRLGLPGVCESDTGLGQTRNGKRAFSEVMDSTKASSFNDNKWIFPSVKCQPPTSAITETAEACKGSQPGLFSATPGQKIMMQGGCGAPQSWAGDNGLSKSTAPKDELHPKTPRGGPTEKTNAASQSQAATDPAMAPAPKAQVVGWPPIRSFRKNTLAANSKPNDEGSSSNALYVKVSMDGAPYLRKVDLKMYSTYHELSSALEKMFSCFTMGQCGSPGLSESKLIDLLNGSEYVPTYEDKDGDWMLVGDVPWEMFVDSCKRLRITKASEAIGLAPRAMEKSRSKN

SEQ ID NO: 2837 - protein, 351 aa, Zinnia elegans
  misc_feature (1)..(351): useful for making plants with increased nitrogen use efficiency as described in USSN 12/615,920
MPPPLLGVEGDGLGNVSLMTSASTMESIFQKNAELTERNYLGLSDCSSFDSTAVSGISEVKRNNLNLKATELRLGLPGSQSPERDVDVDLVNSESLDEKPLFPLLPSKDGICSNSQKVFVSGNKRGFSDAIDEGKWMFGSSGTDSETSNMNGKISSGAQPVMIKDATSKVVTQEQTHATFGTNLNIVNTSNPPAAKAQVVGWPPVRSFRKNILATNSKTNDEVDGKPGPGALFVKVSMDGAPYLRKVDLRSYSTYQQLSSAIEKMFSCFTIGQCGSQGAPGRESLSESKLRDLLHGSEYVLTYEDKDGDWMLVGDVPWDMFIGSCKRLKIMKGSDAIGLAPRAMEKSKNRN

SEQ ID NO: 2838 - protein, 359 aa, Vitis vinifera
  misc_feature (1)..(359): useful for making plants with increased nitrogen use efficiency as described in USSN 12/615,920
MSPPLLGVGEEEGQSNVTILASSASMESVCQISSGLKERNYMGLSECSSVDSSAISTDSDGNKSSLNLKATELRLGLPGFLSPGREPELCLLSSTKLDEKPLFPLHPSKDLTYTSSQKTVVSGNKRGFADAMNGFSEGKFLANSEVNVMLSPRPSPNKENLGSQPAKMKEMASPKIVQERPRATNETPPNHTGTGNNNSSAPATKAQVVGWPPIRSFRKNTLATTSKNTEVDGKAGPGALFVKVSMDGAPYLRKVDLRNYSAYQELSSALEKMFSCFTIGQYGSHGAPGREMLSESKLKDLLHGSEYVLTYEDKDGDWMLVGDVPWQMFIETCKRLRIMKSCDAIGLAPRAVEKCKNRN

SEQ ID NO: 2839 - protein, 349 aa, Solanum tuberosum
  misc_feature (1)..(349): useful for making plants with increased nitrogen use efficiency as described in USSN 12/615,920
MSPPLLGVGEEEGQSNVTLLASSTSLGSICKKGSALKERNYMGLSDCSSVDSCNISTSSEDNNGCGLNLKATELRLGLPGSQSPERGEETCPVSSTKVDEKLLFPLHPAKDTAFSVSQKTVVTGNKRGFSDTMDGFSEGKFLSNSGVKSGDAKETSRVQPSKMKDANTQSTVPERPSAVNDASNRAGSGAPATKAQVVGWPPIRSFRKNTLASASKNNEEVDGKAGSPALFIKVSMDGAPYLRKVDLRTYSAYQELSSALETMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 2840 - protein, 130 aa, Brassica napus
  misc_feature (1)..(130): useful for making plants with increased nitrogen use efficiency as described in USSN 12/615,920
  misc_feature (122)..(122): Xaa can be any naturally occurring amino acid
MIGQLMNLNATELCLGLPGGTKAVESPAKSSVRNKRGFSETMDLMLNLQCNKEETVDLNNATASKEKTLLKDPAKPPAKAQVVGWPPVRNYRKNMMTQQKTSGEEEASSEKAGNGGGAALVXVSMDGAPY

SEQ ID NO: 2841 - protein, 308 aa, Lycopersicon esculentum
  misc_feature (1)..(308): useful for making plants with increased nitrogen use efficiency as described in USSN 12/615,920
MGLSDCSSVDSCNISTSSEDNNGCGLNLKATELRLGLPGSQSPERGEETCPVISTKVDEKLLFPLHPSKDTAFSVSQKTVVSGNKRGFSDAMDGFSEGKFLSNSGVKAGDTKETSRVQPPKMKDANTQSTVPERPSAVNDASNRAGSGAPATKAQVVGWPPIRSFRKNTLASASKNNEEVDGKAGSPALFIKVSMDGAPYLRKVDLRTCSAYQELSSALEKMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 2842 - protein, 129 aa, Brassica napus
  misc_feature (1)..(129): useful for making plants with increased nitrogen use efficiency as described in USSN 12/615,920
  misc_feature (42)..(42): Xaa can be any naturally occurring amino acid
MIGQLMNLKATELCLSLPGGAETLDTPAKSAVGNKRGFSETXDLMLNLQSNKERAIDLNNATASKQKTLLKDPVKPPAKAQVVGWPPVRNYRKNIMTNQKTSGADEASSEKAGNGGGGATGATLVKVSM

SEQ ID NO: 2843 - protein, 233 aa, Oryza
  misc_feature (1)..(233): useful for making plants with increased nitrogen use efficiency as described in USSN 12/615,920
MAGLGFDETELRLGLPGAGELAARSSGKRGFAETIDLKLKLQPAAPAAVSGEEGAQEDKEDADAAAAAADEKMSMKRSASQSSVVTAEPDPDKPRAPKAQVVGWPPVRSFRKNVLAEKCKAAALVKVSMDGAPYLRKIDVAMYKSYPELSMAFQNMFTSFTIGKCGSHQQLKESNKLRDDLEYVPTYEDKDGDWMLVGDVPWEMFVESCKRLRIMKGSEAIGLAPRAVEKCKS

SEQ ID NO: 2844 - protein, 228 aa, Zea mays
  misc_feature (1)..(228): useful for making plants with increased nitrogen use efficiency as described in USSN 12/615,920
MAGADVDVGTELRLGLPGGGAAAAKKDTIDLKLKLPTAGMEEAAAAARPEPAADKAKRPAEAPAADAEKPPAPKAQAVGWPPVRSYRRNAMTTVVQAVRSKKEEEPEKQQQPAAANAFVKVSMDGAPYLRKVDLKTYSSYKDLSAALKKMFGTFTASGNSMNEGRLVDPAGDADDVVTTYEDKDGDWMLVGDVPWEMFVESCKRLRIMKSSEAIGLAPRTKDKCKNKS

SEQ ID NO: 2845 - protein, 252 aa, Pinus taeda
  misc_feature (1)..(252): useful for making plants with increased nitrogen use efficiency as described in USSN 12/615,920
MSCSVGNMAMVLEKSGGNAQHEKRDSLDFAETELKLGLPGVAAGARQRICGKRSFSEAMESRNYTIPDEDITNTSTHEDLDKFKGPIVKEKQMALSANDPPRMGPPPPSKAQVVGWPPVRDFRKVRTVAASNSLYVKVSMDGAPYLRKVDLKLYSTYHELTSALEKMFSCLIIMGKCGSLALNESNLMDLPNGSEYVPTYEDKDGDWMLIGDVPWQMFVDSCQRMRIMTASEAIGLAPRTMENCKNRNRVHP

SEQ ID NO: 2846 - protein, 231 aa, Pinus taeda
  misc_feature (1)..(231): useful for making plants with increased nitrogen use efficiency as described in USSN 12/615,920
MSCSVGGMEKSSTGAQQENKCSLDIFAETELRLGLPGVAAGERQRICGKRSFSEAMESRNFSIPQEEAHKFHEPNLGTEKQMVRPANDPPKMGPTPPKAQIVGWPPVKDFRKVRTIAASSSLYVKVSMDGAPYLRKVDLKMYSTYHDLSSALENMFGCLITMGKCGSSGIKESNLMDVVNGSEYVATYEDKDGDWMLVGDVPWQMFVDSCQRVRIMKASEAIGLAPRAMEK

SEQ ID NO: 2847 - protein, 106 aa, Glycine max
  misc_feature (1)..(106): useful for making plants with increased nitrogen use efficiency as described in USSN 12/615,920
MDGAPYLRKVDIKLYKSYQELSDALAKMFSSFTIEKCGSQGMKDFMNETNGSDYVPTYEDKDGDWMLVGDVPWEMFVESCKRLRIMKGSEAIGLAPRAVEKCKNRS

SEQ ID NO: 2848 - protein, 97 aa, Mirabilis jalapa
  misc_feature (1)..(97): useful for making plants with increased nitrogen use efficiency as described in USSN 12/615,920
KSYQDLSDALGKMFSSFTLGNYGSQGMIDFMNESKLMDLINGSDYVPTYEDKDGDWMLVGDVPWEMFVESCKRLRIMKGKEAAGLAPRAMEKCKNRI

SEQ ID NO: 2849 - protein, 208 aa, Gossypium hirsutum
  misc_feature (1)..(208): useful for making plants with increased nitrogen use efficiency as described in USSN 12/615,920
MSSENGKRLLETDAGGLNFEATELTLGLPGEPRVTSDGGAKLGSKRGFSETVDLKLGDNNQEVKLGHSLQEAAKSPVSKTQVVGWPPVRGFAKRGKKSCKYVKVAVDGAPYLRKVDLEIYNSYQQLLTSLEDMFSCFTIRNYLNEKKIDQVNGIEYMPTYEDKDGDWMLVGDVPWQMFVESCKRLRLMKSSEAVGLGLKTAPKYSSTN

SEQ ID NO: 2850 - protein, 193 aa, Vigna radiata
  misc_feature (1)..(193): useful for making plants with increased nitrogen use efficiency as described in USSN 12/615,920
MENSLGSYEKELNLKATELRLGLPGSDEPEKRATARSNKRSSPEASDEESISNGSDVTKEDNVVPPAKAQVVGWPPIRSYRKNNVQQKKEEESEGNGMYVKVSMAGAPYLRKIDLKVYKSYPELLKALENMFKCIFGEYSEREGYNGSEYAPTYEDKDGDWMLVGDVPWNMFVSSCKRLRIMKGSEAKGLGCF

SEQ ID NO: 2851 - protein, 167 aa, Pisum sativum
  misc_feature (1)..(167): useful for making plants with increased nitrogen use efficiency as described in USSN 12/615,920
VVVSKRGFSETESESESESEITTVDLKLNLSPKEGAADPQLKPKEKSLLVSDSGTKPPAKAQVVGWPPVRSFRKNMFAGQKSIGGSEETTKKSSDGSNAISFVKVSMDGAPYLRKIDLKMYKSYPELSDALAKMFNSITNGNCESQGIKDFMKESNKMMDLLNTSDY

SEQ ID NO: 2852 - protein, 190 aa, Gossypium barbadense
  misc_feature (1)..(190): useful for making plants with increased nitrogen use efficiency as described in USSN 12/615,920
MEGSVGYDNDLNLRATELRLGLPGTEPVSIVRSNKRSLQQVADDDCGVNGCRSDDQNETAPPPPKAQIVGWPPIRSYRKNNIQTKKNESEGGGIYVKVSMDGAPYLRKIDLKIYSGYPELLQAIENMFKFTIGEYSEREGYKGSDYAPTYEDKDGDWMLVGDVPWEMFITSCKRLRIMKGSEARGLGCGV

SEQ ID NO: 2853 - protein, 218 aa, Glycine max
  misc_feature (1)..(218): useful for making plants with increased nitrogen use efficiency as described in USSN 12/615,920
TNPPAKAQVVGWPPVRSYRKNMIAVQKVSNEEVADNTTISTLANSGAFVQVSMDGAPYLRKVDLPMYKSYIRLISCLGQNVQLLHHGYLWGPRNDIFMNDSKLMDLPPSSEYVPPHQNTDGDWMLVGDVPWEMFVVVMQPPGEIMNGSETIGPCVQNIGKMQKQKGKLAQYNVLREIPYATGPMEQIISPTSATLWSGMLLVECVWCLAFCSYKDCVV

SEQ ID NO: 2854 - protein, 172 aa, Antirrhinum majus
  misc_feature (1)..(172): useful for making plants with increased nitrogen use efficiency as described in USSN 12/615,920
KATELRLGLPGTDESEPQTSSSIKNNNNKRSSSEMQGSCQKSTQQEESIAPAPKAQVVGWPPVRSFRKNVMKASESDGSGMFVKVSMDGAPYLRKIDLKFYNNYFDLLKALENMFKCTIGVYSEREGYNGSEFAPTYEDKDGDWMLVGDVPWDMFITSCKRLRIMQSKLCCL

SEQ ID NO: 2855 - protein, 71 aa, Glycine max
  misc_feature (1)..(71): useful for making plants with increased nitrogen use efficiency as described in USSN 12/615,920
MIDFMNESKLMDLLNSSEYVPSYEDKDGDWMLVGDVPWEMFVESCKRLRIMKGSEAIGLAPRAMEKCKSRS

SEQ ID NO: 2856 - protein, 99 aa, Lycopersicon esculentum
  misc_feature (1)..(99): useful for making plants with increased nitrogen use efficiency as described in USSN 12/615,920
  misc_feature (76)..(77): Xaa can be any naturally occurring amino acid
VRSFRKNVMTVQKNTTGAGEISGTGTGAAFVKVSVDGAPYLRKVDLKMYKSYQQLSDALGKMFSSFTIGNCGTQGXXDFMNESKLIDLLNGSDYVPTYE

SEQ ID NO: 2857 - protein, 484 aa, Physcomitrella patens
  misc_feature (1)..(484): useful for making plants with increased nitrogen use efficiency as described in USSN 12/615,920
MNVSEGCSTLTGAQLKYSTDKSNMSYETVYRDAAVESPQREVSNESGSTLKEHDYFGLSEVLSSNSSSGKQPEKCCREELNLNESATTLQLGPPAAVKPSGQADGDDAHDEGAGPENPAKRSAYHMQQESLADGRKAAAEMGSFKIQRKNILEEFRAMKAHAHMTKSPKTVQTMQHNMHVSYSGAQMAFGGAKNNGVKRVFSEAVVANHNAASGVGVGVREGNDDVSRCEEMNGTEQLDLKVHLPKGMGMARMAPASGSPSFDNMQGPLNPFFRKSLVSKMPVPDGGDSSANASNDCANRKGMVASPSVQPPPAQNQTVGWPPVKNFNKMNTPAPPASTPARACPSVQRKGASTSSSGNLVKIYMDGVPFGRKVDLKTNDSYDKLYSMLEDMFQQYISGQYCGGRSSSSGESHWVASSRKLNFLEGSEYVLIYEDHEGDSMLVGDVPWELFVNAVKRLRIMKGSEQVNLAPKNADPTKVQVAVG

SEQ ID NO: 2858 - protein, 503 aa, Physcomitrella patens
  misc_feature (1)..(503): useful for making plants with increased nitrogen use efficiency as described in USSN 12/615,920
MKFSNEVVHKSMNITEDCSALTGALLKYSTDKSNMNFETLYRDAAVESPQHEVSNESGSTLKEHDYFGLSEVSSSNSSSGKQPEKCCREELNLNESATTLQLGPPAAVKPSGHADGADAHDEGAGPENPAKRPAHHMQQESLADGRKAAAEMGSFKIQRKNILEEFRAMKAQAHMTKSPKPVHTMQHNMHASFSGAQMAFGGAKNNGVKRVFSEAVGGNHIAASGVGVGVREGNDDVSRCEEMNGTEQLDLKVHLPKGMGMARMAPVSGGQNGSAWRNLSFDNMQGPLNPFFRKSLVSKMPVPDGGDSSANASNDCANRKGMVASPSVQPPPAQNQTVGWPPVKNFNKMNTPAPPASTPARACPSVQRKGASTSSSGNLVKIYMDGVPFGRKVDLKTNDSYDKLYSMLEDMFQQYISGQYCGGRSSSSGESHWVASSRKLNFLEGSEYVLIYEDHEGDSMLVGDVPWELFVNAVKRLRIMKGSEQVNLAPKNADPTKVQVAVG

SEQ ID NO: 2859 - protein, 102 aa, Lycopersicon esculentum
  misc_feature (1)..(102): useful for making plants with increased nitrogen use efficiency as described in USSN 12/615,920
VRSFRKNMLSQKGNNNNNNNEEISEKDEKTIAFVKVSMDGAPYLRKVDLKMYKSYQQLSHSLTNMFSSFTMGNYGSQGMIDFMNERKLMDVLNSSDYVPTYE

SEQ ID NO: 2860 - protein, 183 aa, Avena sativa
  misc_feature (1)..(183): useful for making plants with increased nitrogen use efficiency as described in USSN 12/615,920
YRVSIGLPGNGGWCSGWGRGDDGGAANARASVQGRGETWVRRRSGRQGCGGGGGRREEEGAGPAAKAQVVGWPPIRSYRKNTMATSLSAPRSKDEVEAKQAPVAGCLYVKVSMDGAPYLRKVDLKMYKNYKDLSLELEKKFSCFTVGHGESNGKSGRDGLSDCRLMDPKSGAELVLTYEDKDG

SEQ ID NO: 2861 - protein, 174 aa, Zea mays
  misc_feature (1)..(174): useful for making plants with increased nitrogen use efficiency as described in USSN 12/615,920
  misc_feature (152)..(152): Xaa can be any naturally occurring amino acid
MAGADVDVGTELRLGLPGGGADAAKAAKRGFEDTIDLKLKLPTAGMEEAAAAAAAAAKPEPAAEKAKRPAEAPAADAEKPPAPKAQAVGWPPVRSYRRNVMTVQSVKSKKEEEPEKQQSAANAGGNGSAFVKVSMDGAPYLRKVDLKMYNSXHGALRCSEEDVQHLHHIREQHE

SEQ ID NO: 2862 - protein, 51 aa, Cucumis sativus
  misc_feature (1)..(51): useful for making plants with increased nitrogen use efficiency as described in USSN 12/615,920
LTCEDKDGDWMLVGDVPWEMFTESCRRLRIMKGSEAIGLAPRATEKCKNRN

SEQ ID NO: 2863 - protein, 48 aa, Mirabilis jalapa
  misc_feature (1)..(48): useful for making plants with increased nitrogen use efficiency as described in USSN 12/615,920
EDRDGDWMLVGDVPWEMFVNSCKRLRIMKGSEAIGLAPRAVEKCKSRS

SEQ ID NO: 2864 - protein, 52 aa, Mirabilis jalapa
  misc_feature (1)..(52): useful for making plants with increased nitrogen use efficiency as described in USSN 12/615,920
NVLTYEDKDGDWMLVGDVPWEMFIDSCKRLKIMKSSDAIGLAPRTMEKSKSQ

SEQ ID NO: 2865 - protein, 86 aa, Glycine max
  misc_feature (1)..(86): useful for making plants with increased nitrogen use efficiency as described in USSN 12/615,920
  misc_feature (85)..(85): Xaa can be any naturally occurring amino acid
MATMLTKEHGLNLKETELCLGLPGGGGGGGGGGEVETPRATGKRGFSETVDLKLNLHSKEDLNENLKNVSKEKTLLKDPAKPPAXA

SEQ ID NO: 2866 - protein, 75 aa, Glycine max
  misc_feature (1)..(75): useful for making plants with increased nitrogen use efficiency as described in USSN 12/615,920
MTTMLTNEHGLSLNLKETELCLGLPGGGSEVETPRATGKRGFSETVDLKLNLQTKEDLNENLKNVSKEKTLLKDP

SEQ ID NO: 2867 - protein, 111 aa, Citrus limon
  misc_feature (1)..(111): useful for making plants with increased nitrogen use efficiency as described in USSN 12/615,920
METSVPYENDLNLKATELRLGLPGSDENEQQTRNNKRSLPDTPDDLDTKDKSDEAASVAKAQVVGWPPIRSYRKNSLQQKKNEGECAGIYVKVSMDGAPYLRKIDLKLYNG

SEQ ID NO: 2868 - protein, 122 aa, Zea mays
  misc_feature (1)..(122): useful for making plants with increased nitrogen use efficiency as described in USSN 12/615,920
  misc_feature (113)..(113): Xaa can be any naturally occurring amino acid
MAGADVDVGTELRLGLPGGGADAAKAAKRGFEDTIDLKLKLPTAGMEEAAAAAAAKPEPAAEKAKRPAEAPAADAEKPPAPKAQAVGWPPVRSYRRNVMTVQSVKSKKEEEPXKQQSAANAG

SEQ ID NO: 2869 - protein, 43 aa, Brassica napus
  misc_feature (1)..(43): useful for making plants with increased nitrogen use efficiency as described in USSN 12/615,920
MIGELINLKATELCLGLPGGAEANENLEKSAVGNKRGFSETVD

SEQ ID NO: 2870 - protein, 85 aa, Triticum aestivum
  misc_feature (1)..(85): useful for making plants with increased nitrogen use efficiency as described in USSN 12/615,920
  misc_feature (36)..(36): Xaa can be any naturally occurring amino acid
  misc_feature (78)..(78): Xaa can be any naturally occurring amino acid
MDGAPYLRKVDLNMYKTYQDLSKALEKMFSSFTIGXLWNSRDERHERKQADGSAQWIRVCSDVRGQGRRLDARRRRPXGRCSSSH

SEQ ID NO: 2871 - protein, 127 aa, Glycine max
  misc_feature (1)..(127): useful for making plants with increased nitrogen use efficiency as described in USSN 12/615,920
FFIMSMCIRISTSFYCANQLVMLFWLIIGTPRVIKIYNMSFEMSFFFQDDNEHTNYSIDKPWKIFETASHIFRVSPHYYVISYINMKFFFFMSTRMFVESCKRLRIMKGKEAIGLAPRAVEKCKNRS

SEQ ID NO: 2872 - protein, 164 aa, Parthenium argentatum
  misc_feature (1)..(164): useful for making plants with increased nitrogen use efficiency as described in USSN 12/615,920
MDTTFRLSSGGEDYGGEEELELGLGLGLSSGAYASSSNGAHSQVVGWPPVKTYRMNSLLNQAKFSKNEEEKGVGGNDTSKKKKNIDHENKADEVVAKESEHSGFVKVNMDGLPIGRKVNLNAHDCYETLAVALETMFLKACTSVTSIRRAKQQRSRLLDGSSEF

SEQ ID NO: 2873 - protein, 231 aa, Arabidopsis thaliana
  misc_feature (1)..(231): useful for making plants with increased nitrogen use efficiency as described in USSN 12/615,920
MPKSKRDRPVTLSKTKKKGREHKECIVNGIREAVEKYSSVYVFSFENMRNIKFKEFRQQFRHNGKFFLGSNKVMQVALGRSAEDELRSGIYKVSKLLRGDTGLLVTDMPKEEVESLFNAYEDSDFSRTGSIAVETEGPLEQFTHEMEPLLRKLEMPVRLNKGTVELVADFVVCEEGKQLSPKSAHILRLLRMKMATFKLNLLCRWSPSDFELYREDLSELYREDLSDVETS

SEQ ID NO: 2874 - protein, 229 aa, Glycine max
  misc_feature (1)..(229): useful for making plants with increased nitrogen use efficiency as described in USSN 12/615,920
MPKSKRNRQVTLSKTKKKGRDHKETIVNGIKDAAEKYGHVYVFSFENMRNQKFKEFRDQLKSSSRFFLGSNKVMQVALGRSASDEIRPGLHKVSKLLRGDSGMVFTNLSKEEVERLFKEFEEYDFARTGSNATEKVDLKEGPLEQFTHEMEPFLRKQGMPVRLNKGVVELVSDFVVCEEGKPLSPEASRILRLMGIKMATFRLSLICRWSPDEFELYIDGPDESDIECS

SEQ ID NO: 2875 - protein, 234 aa, Triticum aestivum
  misc_feature (1)..(234): useful for making plants with increased nitrogen use efficiency as described in USSN 12/615,920
MPKSKRNRSVTLSKTKKKPGLERKGKVVTEIKDAIERHSSAYVFTYNNMRNQKLKDLRDQLKSSSRIFLAGKKVMQIALGRSPADEAKTGLHKLSKFLQGASGLLFTNLPRDDVERLFREFEVNDFARTGSIATQTVELKEGPLEQFSHEMEPFLRKQGLPVRLNKGVVELVADHVVCEEGKPLSPEAAHTLRVLGTKMATFRLYLVCRWSSDDFEVYKEGLAHLGGEEADESS

SEQ ID NO: 2876 - protein, 231 aa, Zea mays
  misc_feature (1)..(231): useful for making plants with increased nitrogen use efficiency as described in USSN 12/615,920
MPKSKCNRPVTLSKTKKKPGLERKGKVVAEIKDAVDKYSSAYVFTYDNMRNQKLKDLREQLKSSSRIFLAGKKVMQIALGRSPADEAKTGLHKLSKFLQGNSGLLFTNLPRDDVERMFREFEEHDFARTGSTAADTVELKEGPLEQFTHEMEPFLRKQGLPVRLNKGVVELVADHVVCEEGKPLSPEAAQTLRLLGIQMATFRLYLVCRWSSDEFEAYKEGLMHLGADDSS

SEQ ID NO: 2877 - protein, 139 aa, Brassica napus
  misc_feature (1)..(139): useful for making plants with increased nitrogen use efficiency as described in USSN 12/615,920
MPKSKRDRPVTLSKTKKKGREHKECIVNGIREAVEKYSSVYVFSFENMRNIKFKEFRQQFRHNGRFFLGSNKVMQVALGRSASDEICPGIFKASKLLHGDAGLLVTDMPKEEVESLFNAYEDSDFSRTGSTAVETVELK

SEQ ID NO: 2878 - protein, 178 aa, Zea mays
  misc_feature (1)..(178): useful for making plants with increased nitrogen use efficiency as described in USSN 12/615,920
  misc_feature (168)..(168): Xaa can be any naturally occurring amino acid
MPKSKRNRPVTLSKTKKKPGLERKGKVVAEIKDAVDKYSSAYVFTYDNMRNQKLKDLREQLKSSSRIFLAGKKVMQIALGRSPADEAKTGLHKLSKFLQGNSGLLFTNLPRDDVERMFREFEEHDFARTGSTAIDTVELKEGPLEQFTHEMEPFLRKQGLPVRLKQGXCRVGCRPCSL

SEQ ID NO: 2879 - protein, 170 aa, Glycine max
  misc_feature (1)..(170): useful for making plants with increased nitrogen use efficiency as described in USSN 12/615,920
MPKSKRNRQVTLSKTKKKGRDHKETIVNGIKDAAEKYGCVYVFSFENMRNQKLKEFREQLKSNSRFFLGSNKVMQVALGRSASDEIRPGLHKVSKLLRGDSGMFFTNLSKEEVERLFKEFEEYDFARTGSIATEKVIGVSSYDYDFFIQHGMVLGPLGGSCKTAIETSNL

SEQ ID NO: 2880 - protein, 112 aa, Brassica napus
  misc_feature (1)..(112): useful for making plants with increased nitrogen use efficiency as described in USSN 12/615,920
  misc_feature (22)..(22): Xaa can be any naturally occurring amino acid
  misc_feature (26)..(26): Xaa can be any naturally occurring amino acid
  misc_feature (34)..(34): Xaa can be any naturally occurring amino acid
  misc_feature (65)..(66): Xaa can be any naturally occurring amino acid
  misc_feature (90)..(90): Xaa can be any naturally occurring amino acid
MPKSKRDRPVTLSKTKKKGREXKETXVNGIREAXEKYSSVYVFSFENMRNIKFKEFRQQFRHNGXXFLGSNKVMQVALGRSASDEMHPGXFKVSKMLRGDAGLLVTDMPKEE

SEQ ID NO: 2881 - protein, 148 aa, Glycine max
  misc_feature (1)..(148): useful for making plants with increased nitrogen use efficiency as described in USSN 12/615,920
  misc_feature (3)..(4): Xaa can be any naturally occurring amino acid
  misc_feature (12)..(12): Xaa can be any naturally occurring amino acid
  misc_feature (33)..(33): Xaa can be any naturally occurring amino acid
  misc_feature (39)..(39): Xaa can be any naturally occurring amino acid
  misc_feature (44)..(44): Xaa can be any naturally occurring amino acid
  misc_feature (47)..(47): Xaa can be any naturally occurring amino acid
  misc_feature (53)..(53): Xaa can be any naturally occurring amino acid
  misc_feature (58)..(58): Xaa can be any naturally occurring amino acid
  misc_feature (63)..(63): Xaa can be any naturally occurring amino acid
  misc_feature (68)..(69): Xaa can be any naturally occurring amino acid
  misc_feature (79)..(79): Xaa can be any naturally occurring amino acid
  misc_feature (81)..(81): Xaa can be any naturally occurring amino acid
  misc_feature (83)..(83): Xaa can be any naturally occurring amino acid
  misc_feature (88)..(88): Xaa can be any naturally occurring amino acid
  misc_feature (91)..(91): Xaa can be any naturally occurring amino acid
  misc_feature (104)..(104): Xaa can be any naturally occurring amino acid
  misc_feature (109)..(109): Xaa can be any naturally occurring amino acid
  misc_feature (122)..(122): Xaa can be any naturally occurring amino acid
  misc_feature (131)..(131): Xaa can be any naturally occurring amino acid
  misc_feature (142)..(144): Xaa can be any naturally occurring amino acid
  misc_feature (148)..(148): Xaa can be any naturally occurring amino acid
MPXXKRNRQVTXSKTKKKGRDHKETIVNGIKDXAEKYGXVYVFXFEXMRNQKXKEFRXQLKSXSRFFXXSNKVMQVALXRXAXDEIRXGLXKVSKLLRGDSGMXFTNLXKEEVERLFKEFEXYDFARTGSXATEKVDLKEGXXXAIHX

SEQ ID NO: 2882 - protein, 101 aa, Brassica napus
  misc_feature (1)..(101): useful for making plants with increased nitrogen use efficiency as described in USSN 12/615,920
  misc_feature (14)..(15): Xaa can be any naturally occurring amino acid
  misc_feature (19)..(19): Xaa can be any naturally occurring amino acid
  misc_feature (31)..(31): Xaa can be any naturally occurring amino acid
  misc_feature (77)..(77): Xaa can be any naturally occurring amino acid
  misc_feature (92)..(92): Xaa can be any naturally occurring amino acid
  misc_feature (99)..(99): Xaa can be any naturally occurring amino acid
MPKSKRDRTVTLSXXKKKXREHKEIIVNGIXEAVEKHTSVYVFSFENMRNIKFKEFRNQFRHTGRFFLGSNKVMQVXLGRSASDEIRPGIFXVSKLLHXDA

SEQ ID NO: 2883 - DNA, 2161 bp, Arabidopsis thaliana
  misc_feature (1)..(2161): useful for making plants with increased nitrogen use efficiency as described in USSN 12/615,920
aacccaaaaaagcttctaacaaagagaaagtgtctgtatgttgtgcccactctctacatttatcaatcacttcatgtgtgttaccttgattgcaaaaaagtgagaatatattctcacaacattaaatccaccccgaaatcgaagtgagtatatcacgagtgtagtaatatcttagagatggttttggaggatagaaaggacggttcttctttgccgggacgatccggtagtttctctaaatcgtcaccgtcggagttggatgttgttgatccatacaagcggataagttcgccgggatctatattggatgccgagaaggtggagaaaaagcctggaggatggagagccgtctcgttcattttaggaaatgagacgctggagagactgggatcgataggattgttggcaaacttcatggtttatctaaccaaagtgtttcacttagaacaagtcgacgctgcaaatgtcatcaacatttggtcaggtttcaccaatctcactcctctcgtcggaacgtatatctcagacacttacgttggccgcttcaagaccatcgctttcgcctcattcgccactctcctcggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacacagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaggctgaaacttccggcggaagatgacggcactgtacctattacgacacagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcgcgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaattctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttccaagaaatcgatggaatgatttaatagactatccttagggacaacaagaagattgtcgatgttgtttgaataattactatgacaatgtatgtatcataatatgtaagaactagaatatataataaatttttacctttcatg

SEQ ID NO: 2884 - protein, 332 aa, Arabidopsis thaliana
  misc_feature (1)..(332): useful for making plants with increased nitrogen use efficiency as described in USSN 12/615,920
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGTYISDTYVGRFKTIAFASFATLLGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRRLKLPAEDDGTVPITTQPSSLACYPSYTAVTNSGVLTKPRWL

SEQ ID NO: 2885 - DNA, 1863 bp, Arabidopsis thaliana
  misc_feature (1)..(1863): useful for making plants with increased nitrogen use efficiency as described in USSN 12/615,920
  CDS (1)..(1863): Full length cDNA to which Ceres clone 15650 is a truncated version
atggttttggaggatagaaaggacggttcttctttgccgggacgatccggtagtttctctaaatcgtcaccgtcggagttggatgttgttgatccctacaagcggataagttcgccgggatctatattggatgctgagaaggtagagaaaaagcctggaggatggagagccgtctcgttcattttaggaaatgagacgctggagagactgggatcgataggattgttggcaaacttcatggtttatctaaccaaagtgtttcacttagaacaagtcgacgctgcaaatgtcatcaacatttggtcaggtttcaccaatctcactcctctcgtcggagcgtatatctcagacacttatgttggccgcttcaagaccatcgctttcgcctcattcgccactctcctcggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacacagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcgcgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaactctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttcgaagaaatcgatgaaatga

SEQ ID NO: 2886 - protein, 620 aa, Arabidopsis thaliana; identical to SEQ ID NO: 2772
  misc_feature (1)..(620): useful for making plants with increased nitrogen use efficiency as described in USSN 12/615,920

SEQ ID NO: 2887 - DNA, 1014 bp, Arabidopsis thaliana; identical to SEQ ID NO: 1683
  misc_feature (1)..(1014): useful for making plants with modulated biomass as described in USSN 12/605,261
  misc_feature (1)..(1014): Ceres CLONE ID no. 8161

SEQ ID NO: 2888 - protein, 218 aa, Arabidopsis thaliana; identical to SEQ ID NO: 1685
  misc_feature (1)..(218): useful for making plants with modulated biomass as described in USSN 12/605,261

SEQ ID NO: 2889 - DNA, 960 bp, Arabidopsis thaliana
  misc_feature (1)..(960): useful for making plants with modulated biomass as described in USSN 12/605,261
  misc_feature (1)..(960): Ceres CLONE ID no. 8490
atttttgtttctctctttctctctgatatttttcattttcttcttcttctctctctctctccacaaagataagccaacaatggttggtgattacagaggacgctttagtagccgtcgtttctccgatgactctgacgattcttccgacgatgcttcttccgtggagggagagaccacttcttccatgtactctgcggggaaagagtatatggaaacagaatggactaatgagaagcatagtttatatcttaaatctatggaagcttcattcgtagatcagttatataactcgctcggagctctcgggaagaacgagaatgtatccgaatcaacgaggttcggtagcggtagaaaaccgtctcaagaacagttcaaggttcttcatgatggtttctggcagaagattaatgtgaaacaacctgaacatcggattaacggaaggcacggtggtaattctcatgagtttcttaggagtccatggattaagcattataaacctttagtaaagacacaaatcccggtaacggatgagcccgaaaatcaagttgttagcagctctaatgggaagaagggaatatgcagctctggctcagcctctagtctcaagcagctaagctctcattcgcgtgaccacgaccaaatcagcgttggagaagcagaggtatcggatcagaactttgttaacgaaggaataaaaggcgaaaacggaagctcgaagaagatgaagacggtgatgatgagtgaatcgtcgagtaccgatcaggttgttccactcaataaactcttgcaacatgacgtaaatttgaagtctgtttcttgagaggtcagatggtgaagctttatatgaggagagaattttgtaatgtatatatatttgcataacttataagtcaaatatactatccttagttacaagtttcttcatcatatatccctaactataaatatatttatatgccc

SEQ ID NO: 2890 - protein, 246 aa, Arabidopsis thaliana; identical to SEQ ID NO: 1690
  misc_feature (1)..(246): useful for making plants with modulated biomass as described in USSN 12/605,261

SEQ ID NO: 2891 - DNA, 792 bp, Populus balsamifera subsp. trichocarpa
  misc_feature (1)..(792): useful for making plants with modulated biomass as described in USSN 12/605,261
  misc_feature (1)..(792): GDNA ANNOT ID no. 1443850
  misc_feature (1)..(792): CDNA ID no. 37078836
atgcaaaaatcccgagaagagaggcaaaacgatgccgtaaaagaaagtgaaagtcgaacgagatcagaaacgtctgggttaactggtcacgagtcagtcgagttggctcaattacaggattcaccgatgatagaatccatgtcttcagaatggacagatgagaagcacaaactttatcttaaatccatggaggcttcatttgttaatcaattatacaattcgatagatcttcttggttggcgttcccagaaggggaggccagttccaaacttgtctggggaagtcaattgtagcacctgtagaccttctggccagtttaaggttcttcgacgtggcggctggcagaaaatcaattttcgaagacatgaatctcaactaagctcagcgaaggactcccgtgggtatttaacaagcccatggattcaacaatttacgcctgcaagaaaaccagaaggtgcaacatctcctgctcttcaagaatgtgctatccaaagtcgaggaatcaatttaaagtggaagaaagcagttctctgctgtccagcaactaattcaaaactttctcattttggcaactctttttcatgtcatcgtgatttcgttgaaagcaacacagagatgtcaggccagaactttgttgacgaagacatcgaaagtgaaagtgcaagcagttctttcagctcaaaaaggttgaaaactctgaaaactgatccttcgagtagtgaccaggttgttccccacagcaagactcctgtggaagaagaggttactgagtgtatttctgcagctaaataa

SEQ ID NO: 2892 - protein, 263 aa, Populus balsamifera subsp. trichocarpa
  misc_feature (1)..(263): useful for making plants with modulated biomass as described in USSN 12/605,261
  misc_feature (1)..(263): GDNA ANNOT ID no. 1443850
  misc_feature (1)..(263): CDNA ID no. 37078836
MQKSREERQNDAVKESESRTRSETSGLTGHESVELAQLQDSPMIESMSSEWTDEKHKLYLKSMEASFVNQLYNSIDLLGWRSQKGRPVPNLSGEVNCSTCRPSGQFKVLRRGGWQKINFRRHESQLSSAKDSRGYLTSPWIQQFTPARKPEGATSPALQECAIQSRGINLKWKKAVLCCPATNSKLSHFGNSFSCHRDFVESNTEMSGQNFVDEDIESESASSSFSSKRLKTLKTDPSSSDQVVPHSKTPVEEEVTECISAAK

SEQ ID NO: 2893 - DNA, 759 bp, Populus balsamifera subsp. trichocarpa
  misc_feature (1)..(759): useful for making plants with modulated biomass as described in USSN 12/605,261
  misc_feature (1)..(759): GDNA ANNOT ID no. 1496794
  misc_feature (1)..(759): Ceres CDNA ID no. 37078800
atgcaaaaatcccgagaagagaggcaaaacgatgccgtaaaagaaagtgaaagtcgaacgagatcagaaacgtctgggttaactggtcacgagtcagtcgagttggctcaattacaggattcaccgatgatagaatccatgtcttcagaatggacagatgagaagcacaaactttatcttaaatccatggaggcttcatttgttaatcaattatacaattcgatagatcttcttggttggcgttcccagaaggggaggccagttccaaacttgtctggggaatttaaggttcttcgacgtggcggctggcagaaaatcaattttcgaagacatgaatctcaactaagctcagcgaaggactcccgtgggtatttaacaagcccatggattcaacaatttacgcctgcaagaaaaccagaaggtgcaacatctcctgctcttcaagaatgtgctatccaaagtcgaggaatcaatttaaagtggaagaaagcagttctctgctgtccagcaactaattcaaaactttctcattttggcaactctttttcatgtcatcgtgatttcgttgaaagcaacacagagatgtcaggccagaactttgttgacgaagacatcgaaagtgaaagtgcaagcagttctttcagctcaaaaaggttgaaaactctgaaaactgatccttcgagtagtgaccaggttgttccccacagcaagactcctgtggaagaagaggttactgagtgtatttctgcagctaaataa

SEQ ID NO: 2894 - protein, 252 aa, Populus balsamifera subsp. trichocarpa
  misc_feature (1)..(252): useful for making plants with modulated biomass as described in USSN 12/605,261
  misc_feature (1)..(252): GDNA ANNOT ID no. 1496794
  misc_feature (1)..(252): Ceres CDNA ID no. 37078800
MQKSREERQNDAVKESESRTRSETSGLTGHESVELAQLQDSPMIESMSSEWTDEKHKLYLKSMEASFVNQLYNSIDLLGWRSQKGRPVPNLSGEFKVLRRGGWQKINFRRHESQLSSAKDSRGYLTSPWIQQFTPARKPEGATSPALQECAIQSRGINLKWKKAVLCCPATNSKLSHFGNSFSCHRDFVESNTEMSGQNFVDEDIESESASSSFSSKRLKTLKTDPSSSDQVVPHSKTPVEEEVTECISAAK

SEQ ID NO: 2895 - DNA, 1153 bp, Arabidopsis thaliana
  misc_feature (1)..(1153): useful for making plants with modulated biomass as described in USSN 12/605,261
  misc_feature (1)..(1153): Ceres CLONE ID no. 37288
agcccctttcccaatatttgatcaatttctaaagaaaaccccttcctctactagtcctcctcctatatatacaaaatcttaagaaatctctctacttgtttcctctgttatcataatctcttctctctatatctcttctcttcttcttttaccctgtttttttttttcattccacagagcccaggttgattgattttgttattcagagatatggggagaggaaggattgagattaagaagattgagaatatcaacagtcgtcaagtcactttctctaagagacgaaacggtttgatcaagaaggctaaagagctttcgattctctgtgacgccgaggttgctcttatcatcttctccagcaccggcaagatttacgatttctccagcgtctgtatggagcaaattctttctagatatggatacactactgcgtccactgagcataaacaacaaagagaacaccaacttctaatttgtgcttcacatggaaatgaagctgtgttgcgaaatgatgattctatgaaggtggaacttgaaagattacagcttgcaattgagagacttaagggtaaggagcttgaaggtatgagtttcccggatcttatttcttttgaaaaccagttgaacgagagcttgcatagtgtcaaggatcaaaagacacaaatcctgctcaaccagattgagagatccaggatacaggagaaaaaagcattggaagaaaaccaaatcttgcgcaaacaggttgagatgttggggagaggttcaggaccaaaagtgttgaatgaaaggcctcaagattctagcccagaagccgatcccgagagctcttcatcagaagaggatgagaatgacaacgaggagcaccattccgacacttccttgcagttggggttgtcgtcgacggggtattgcacaaagagaaagaagccgaagatcgaactggtctgcgataactctgggagtcaagtggcttctgattgatggaatcgattatttttctaattctggttgtttaggggtctctatgtgtcttcttgtttctggctgttcttttgctttatttcatctcaagtagagttttcttaatgtttaggtggaacatttttccataatcaagaagggatttgatcaatcaataacattagattttctt

SEQ ID NO: 2896 - protein, 255 aa, Arabidopsis thaliana
  misc_feature (1)..(255): useful for making plants with modulated biomass as described in USSN 12/605,261
  misc_feature (81)..(180): Pfam Name: K-box; Pfam Description: K-box region
  misc_feature (9)..(59): Pfam Name: SRF-TF; Pfam Description: SRF-type transcription factor (DNA-binding and dimerisation domain)
MGRGRIEIKKIENINSRQVTFSKRRNGLIKKAKELSILCDAEVALIIFSSTGKIYDFSSVCMEQILSRYGYTTASTEHKQQREHQLLICASHGNEAVLRNDDSMKVELERLQLAIERLKGKELEGMSFPDLISFENQLNESLHSVKDQKTQILLNQIERSRIQEKKALEENQILRKQVEMLGRGSGPKVLNERPQDSSPEADPESSSSEEDENDNEEHHSDTSLQLGLSSTGYCTKRKKPKIELVCDNSGSQVAS

SEQ ID NO: 2897 - protein, 254 aa, Gossypium hirsutum
  misc_feature (1)..(254): useful for making plants with modulated biomass as described in USSN 12/605,261
  misc_feature (1)..(254): GI no. 52789958
MGRGKIEIKRIENANSRQVTFSKRRAGLLKKAKELAILCDAEVAVIIFSNTGKLFEFSSSGMNKTISRYKSAQGSPEIAQVEHKAEKQDSKEADHLKDEIAKLQMKQLQLLGKNLTSMSLKELQLLEQQLNEGLLSVKEKKEQLLMQQLEQSRLQEQRAMLENETLRRQVEELRGFFPTTDHPIQPYLECYPVERKNSLMSHSIPSPDLTCNCTVEKGDSDTTLYLGLPSDYHKRKKPEIESHSNESESQLGLL

SEQ ID NO: 2898 - protein, 247 aa, Glycine max
  misc_feature (1)..(247): useful for making plants with modulated biomass as described in USSN 12/605,261
  misc_feature (1)..(247): Ceres CLONE ID no. 523628
MGRGKIEIKKIENLNSRQVTFSKRRNGLLKKAKELSVLCDAEVAVIIFSSTGKLYEFSNTSMEHTLSRYSKGAESDSAEQPIDVPPTDVMAVEPDTNLLMEEITKLRSAYLRMMGKELDGLSLKELQQLENQLSEGMQSVKDKKEQVLVEQLRKSRIQEQKAMLENEVLRKQLEEIQNKTKSQFLEFSSLDRTFSKNGSKSLFNCASEENDLSDTSLQLGLSTDYGRQRKALKMEPCNDSGSQVASH

SEQ ID NO: 2899 - protein, 269 aa, Petunia x hybrida
  misc_feature (1)..(269): useful for making plants with modulated biomass as described in USSN 12/605,261
  misc_feature (1)..(269): GI no. 34452081
MGRGKIDIKLIENVNNRQVTFSKRRAGLLKKANELSVLCDAEVAVIIFSSTGKLFEFSSTSMKQTLSRYNRCLASTETSAIEKKLEDNEQPQPLQTYVPKQEQKEMDILKDELSKLKMDQLRLLGKDLSGMGLNELRLLEHQLNEGLLAIKDRKEELLIQQLEQSRRQEERAALESETLRRQLEELRGLFPLSTSLPPPYLEYHPLEQKYPILKEGEESLDSDTACEDGVDDEDSNTTLQLGLPIVGRKRKKPEQDSPSSNSENQVGSK

SEQ ID NO: 2900 - protein, 265 aa, Brassica napus
  misc_feature (1)..(265): useful for making plants with modulated biomass as described in USSN 12/605,261
  misc_feature (1)..(265): Ceres CLONE ID no. 1251169
MDRGKIEIKRIENANSRQVTFSKRRAGLLKKAHELSVLCDSEVAVIVFSKSGKLFEFSSTGMKRTVLRYENYQRSSDAPLIKYKPENQEEDCTEVDFLKNEISKLQEKHLQMQGKGLNALCLKELQHLEQQLNVSLISVRERKELLLTKQIEESRIREQRAELENETLRRQVQELRNFLPSINQNYVPSYITCFAIDPKNSPVNNSGLDDTNYSLQKTNSDTTLQLGLPGEAQARRRSEANRESPSSDSVTTSTTKATPQRINLV

SEQ ID NO: 2901 - protein, 235 aa, Zea mays
  misc_feature (1)..(235): useful for making plants with modulated biomass as described in USSN 12/605,261
  misc_feature (1)..(235): Ceres CLONE ID no. 244916
MVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTRLIEENSRLKEQLQVTRMSRMETQLGADPEFVYEEGQSSESVTNTSYPRPSTDTDDCSDTSLRLGLPLFSSK

SEQ ID NO: 2902 - DNA, 640 bp, Arabidopsis thaliana
  misc_feature (1)..(640): useful for making plants with modulated biomass as described in USSN 12/605,261
  misc_feature (1)..(640): Ceres CLONE ID no. 2835
tgaacaccgaatctctcaacacaaacaaaatcacacatctctcttcatctttttgtttcctgcaagaatctgaatctgctttactattgtgtcatcatgatgaacatcgacgatacgacgtctccaatggcccacccgatcggtccatctcagcctccttccgaccaaaccaaacaagatccgccaagtttgccccaagaagcagcttcttctgtttcggccgacaagaaagatctagctttgcttgaagagaaaccgaagcagagtcaagaagaagatagagtggacactgggagagagaggttaaagaagcatcggagagagatcgctggtagggtttggataccggagatatggggacaagaagagcttcttaaggattggatcgattgttcaacgtttgacacgtgtctagtccctgccggaatctcgtctgcacgtactgctctcgtagaggaagctaggcgagctgcttcagcttctggtgggttacataatcgttgcttgatcttacgttgaatttaatataataagataacatacttataaatgtggttcttgttcctcaataatataaggcactattgttacattgttgataatattctaactcattttactcgtaactttatgaaacatt

SEQ ID NO: 2903 - protein, 140 aa, Arabidopsis thaliana
  misc_feature (1)..(140): useful for making plants with modulated biomass as described in USSN 12/605,261
MMNIDDTTSPMAHPIGPSQPPSDQTKQDPPSLPQEAASSVSADKKDLALLEEKPKQSQEEDRVDTGRERLKKHRREIAGRVWIPEIWGQEELLKDWIDCSTFDTCLVPAGISSARTALVEEARRAASASGGLHNRCLILR

SEQ ID NO: 2904 - protein, 126 aa, Brassica napus
  misc_feature (1)..(126): useful for making plants with modulated biomass as described in USSN 12/605,261
  misc_feature (1)..(126): Ceres CLONE ID no. 1085655
MKNIDDTTSPMTRVIDPSQPPSDQSQQEPSLTNEASSVSDKKDQALPEEKPKQNQENERAVTGREKLKHHRREMAGRVWIPEIWGQEELLKDWIDCSTFDTCLVPNGISSARAALVEEARRAASAS

SEQ ID NO: 2905 - protein, 135 aa, Brassica napus
  misc_feature (1)..(135): useful for making plants with modulated biomass as described in USSN 12/605,261
  misc_feature (1)..(135): Ceres CLONE ID no. 1087946
  misc_feature (7)..(7): Xaa is any aa, unknown or other
MLHFSWXMKNIDDTTSPMTHLINPSQPPSDKTQQDPSLSTEACIVSDKKDQALPEEKPKQNQEAIIGRDKLKQHRREMAGRVWIPERWGQEDLLKDWIDCSKFDTCLVPNGISSARSALVEEARRAASASGGLHN

SEQ ID NO: 2906 - protein, 180 aa, Glycine max
  misc_feature (1)..(180): useful for making plants with modulated biomass as described in USSN 12/605,261
  misc_feature (1)..(180): Ceres CLONE ID no. 635536
MKEKTLSMAHQYSSSNESDSQIIPPQPFKLKKPHQPKGKQMGQEQENESQYLEELVSDSRPRKYSGKDNNNILGQIPSASKIHNKVEIALDHNATKEGITSVEGDHQDSGREKLKRHRVEVAGRVWIPDIWGQEEILKDWIDCTAFDAPLVPSRIVMARTALVEEGRRATSGGLRIENRC

SEQ ID NO: 2907 - DNA, 1025 bp, Zea mays
  misc_feature (1)..(1025): useful for making plants with modulated biomass as described in USSN 12/605,261
  misc_feature (1)..(1025): Ceres CLONE ID no. 235672
  misc_feature (321)..(321): n is a, c, t, g, unknown, or other
acagagcgccacgaggcgagcagtcgagtgttccctagagtccccgttcctccgccgccgcctgcaaccgcttcacgtgccctgatccatcgcaggtcccctttctgaccccaaatggagccgaagaagtcctctgctcagcaccagccccacgccatggaacccaagaagtcctctccacgcggcgccggggccgtcgccgccaccgccactgaagccgagtccccgttgagcagcttgttctacccgccggcgcccgcggcaaatgggaaagatcaggagttgtacagcattatttacaaagggcagagcgggagcgcnacaagctggcgcgacaggtaatggtaaaccgcaatgggctccttccaaaagtcataccgcgtacgcaaaggacggtaaacattcaccaccttatgatacgtcatgttttgggtcatctgtgcattatggtggtcgagattatttctacggcagctctacaaccaagaaagcgacagaatcctccactgactacaaaggggacaagaaagatccagtcgcagattctcatggcgactggtggcaaggctcattttattactaagagaacctggtggcctctccttggagaacaaggaacagaaggaggggcagtgaagctcggtttccttgattgctagcagtattatcttgtgtcatagtggacccgctttcgtccagtggtggtgcgccaatatttagaagcgtcacctggcctgggcagatgtagtgtgcgtcttatagtctctgctttagatgtgcaatgtaacgaagctttagcacagtatgaactagaccgcataaaagaatccatgtccattccgccagtaatatgagcgggttggtatctgactccttagagtcaaaattctgtacaattggatcgtcgctccaaagcaaaaaaaaaaaacaataataatgtgctggagaagcggcgatgacttcacattgtacacctttaccagctggaatttgacagaagtttggaaactgttcttgtcaattgc

SEQ ID NO: 2908 - protein, 155 aa, Zea mays
  misc_feature (1)..(155): useful for making plants with modulated biomass as described in USSN 12/605,261
MEPKKSSAQHQPHAMEPKKSSPRGAGAVAATATEAESPLSSLFYPPAPAANGKDQELYSIIYKGQSGSAQAGATGNGKPQWAPSKSHTAYAKDGKHSPPYDTSCFGSSVHYGGRDYFYGSSTTKKATESSTDYKGDKKDPVADSHGDWWQGSFYY

SEQ ID NO: 2909 - protein, 156 aa, Oryza sativa subsp. japonica
  misc_feature (1)..(156): useful for making plants with modulated biomass as described in USSN 12/605,261
  misc_feature (1)..(156): GI no. 56784045
MEPKRSPALPQPNVETKKSPPRAAAGGGGGGTAAVGGESPLSSLFHQPSHGAKGKEDIYSIFYKGQNGTAQAGTADGKSQWTPPKSRTVYTKDNKQSNQYDSVDTSCFGSSVNYGGRDYYGISGHKQSTESNDYKADKKDPSTDSHGDWWQGSFYY

SEQ ID NO: 2910 - protein, 137 aa, Zea mays
  misc_feature (1)..(137): useful for making plants with modulated biomass as described in USSN 12/605,261
  misc_feature (1)..(137): Ceres CLONE ID no. 688400
MEAKKSGPAAAGAAAPPPANGYFSTVFSASPAGSANDAKQADLYTMLNKQTSRGQNGSGITDGKSHGRPTYKDGKHAYPNDSSESPYFGSSVHYGGREFYSNTLQKQPANEPQTKYKEDKPDGSATRGDWWQGSLYY

SEQ ID NO: 2911 - protein, 147 aa, Triticum aestivum
  misc_feature (1)..(147): useful for making plants with modulated biomass as described in USSN 12/605,261
  misc_feature (1)..(147): Ceres CLONE ID no. 630099
MDAKKRSPPAPSAAGAAPPAANGYFNSVFSAPASPAANPRDARQMDLYTILNKQNPKGQSGGGIAGNAKSHGSPTIGRVAYQDGKQFYPNESSESPYFGSSVHYGGRDFYDSSPHKQADESPRNYKEDNADGSLATRGDWWQGSLYY

SEQ ID NO: 2912 - DNA, 568 bp, Arabidopsis thaliana
  misc_feature (1)..(568): useful for making plants with modulated biomass as described in USSN 12/605,261
  misc_feature (1)..(568): Ceres CLONE ID no. 258241
aaatcttctttcctcaatatcacccagaagaaagagaaagtgaaacagatcaagaaagagattgagaaaaatgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctgattattagatttttttggtgtaagctataaatattctagggtttttatgcaattttcttttaagaaaaatctgaaaattttaattttatgaagcttagaattttaagaaatgtgtaatgaaaaaaaaaaaaga

SEQ ID NO: 2913 - protein, 121 aa, Arabidopsis thaliana
  misc_feature (1)..(121): useful for making plants with modulated biomass as described in USSN 12/605,261
  misc_feature (28)..(72): Pfam Name: zf-B_box; Pfam Description: B-box zinc finger
MCRGLNNEESRRSDGGGCRSLCTRPSVPVRCELCDGDASVFCEADSAFLCRKCDRWVHGANFLAWRHVRRVLCTSCQKLTRRCLVGDHDFHVVLPSVTTVGETTVENRSEQDNHEVPFVFL

SEQ ID NO: 2914 - protein, 117 aa, Arabidopsis thaliana
  misc_feature (1)..(117): useful for making plants with modulated biomass as described in USSN 12/605,261
  misc_feature (1)..(117): Ceres CLONE ID no. 803247
  misc_feature (82)..(82): Xaa is any aa, unknown or other
  misc_feature (92)..(92): Xaa is any aa, unknown or other
  misc_feature (101)..(101): Xaa is any aa, unknown or other
  misc_feature (102)..(102): Xaa is any aa, unknown or other
MCRGFEKEEERRSDNGGCQRLCTESHKAPVSCELCGENATVYCEADAAFLCRKCDRWVHSANFLARRHLRRVICTTCRKLTXRCLVGDNFNXVLPEIRMIXXIEEHSSDHKIPFVFL

SEQ ID NO: 2915 - DNA, 492 bp, Arabidopsis thaliana
  misc_feature (1)..(492): useful for making plants with modulated biomass as described in USSN 12/605,261
  misc_feature (1)..(492): GDNA ANNOT ID no. 1488021
  misc_feature (1)..(492): Ceres CDNA ID no. 37167642
atgtgtagaggtaatcaggagagaagtaaccaaggcagttcttgtaacaaggaggctgtttcacctaatgcaacctcaagattcgtttgttgtgagctatgtggctcgagggcaacattgtattgtcaagcagatcatgcatttctatgtcaaaaatgtgacggatgggtgcatggagctaatttcttagccctcaggcatgttagaaacatgttatgcaacacatgccaaaatcttacacagagatgtctcattggggcttcaactgaggtgatgctttcaactattcatatccaaattcagagaccacagcagctttattcctggaaagaggagggagacacagacaggataaatgggtggcactttcctataaaattccaagtgagaagtgcttttaagcagaagcagcatattctacacgtcattaacagcagcaaccatcaacataaatggcatgacatcacatataggagagatgaagaatggtag

SEQ ID NO: 2916 - protein, 163 aa, Populus balsamifera subsp. trichocarpa
  misc_feature (1)..(163): useful for making plants with modulated biomass as described in USSN 12/605,261
  misc_feature (1)..(163): GDNA ANNOT ID no. 1488021
  misc_feature (1)..(163): Ceres CDNA ID no. 37167642
MCRGNQERSNQGSSCNKEAVSPNATSRFVCCELCGSRATLYCQADHAFLCQKCDGWVHGANFLALRHVRNMLCNTCQNLTQRCLIGASTEVMLSTIHIQIQRPQQLYSWKEEGDTDRINGWHFPIKFQVRSAFKQKQHILHVINSSNHQHKWHDITYRRDEEW

SEQ ID NO: 2917 - DNA, 630 bp, Arabidopsis thaliana; identical to SEQ ID NO: 2034
  misc_feature (1)..(630): useful for making plants with increased salt tolerance as described in USSN 12/377,106
  misc_feature (1)..(630): Ceres LOCUS ID At5g67390
  misc_feature (1)..(630): Also Known As Ceres SEED LINE ME09090

SEQ ID NO: 2918 - DNA, 531 bp, Arabidopsis thaliana; identical to SEQ ID NO: 1954
  misc_feature (1)..(531): useful for making plants with increased salt tolerance as described in USSN 12/377,106
  misc_feature (1)..(531): Ceres SEED LINE ME09090

SEQ ID NO: 2919 - protein, 176 aa, Arabidopsis thaliana; identical to SEQ ID NO: 1955
  misc_feature (1)..(176): useful for making plants with increased salt tolerance as described in USSN 12/377,106
  misc_feature (1)..(176): Ceres SEED LINE ME09090
  misc_feature (1)..(176): Score of 409.6 for HMM of FIGURE 1 of USSN 12/377,106.

SEQ ID NO: 2920 - DNA, 651 bp, Populus balsamifera subsp. trichocarpa; identical to SEQ ID NO: 1956
  misc_feature (1)..(651): useful for making plants with increased salt tolerance as described in USSN 12/377,106
  misc_feature (1)..(651): Ceres GDNA ANNOT ID no. 1446889

SEQ ID NO: 2921 - protein, 216 aa, Populus balsamifera subsp. trichocarpa; identical to SEQ ID NO: 1957
  misc_feature (1)..(216): useful for making plants with increased salt tolerance as described in USSN 12/377,106
  misc_feature (1)..(216): Ceres GDNA ANNOT ID no. 1446889
  misc_feature (1)..(216): Score of 526.2 for HMM of FIGURE 1 of USSN 12/377,106.
  misc_feature (1)..(216): Functional Homolog of  Ceres LOCUS ID no. At5g67390

SEQ ID NO: 2922 - protein, 202 aa, Medicago truncatula; identical to SEQ ID NO: 1958
  misc_feature (1)..(202): useful for making plants with increased salt tolerance as described in USSN 12/377,106
  misc_feature (1)..(202): Public GI no. 92883700
  misc_feature (1)..(202): Score of 487.9 for HMM of FIGURE 1 of USSN 12/377,106.
  misc_feature (1)..(202): Functional Homolog of  Ceres LOCUS ID no. At5g67390

SEQ ID NO: 2923 - protein, 203 aa, Solanum tuberosum; identical to SEQ ID NO: 1959
  misc_feature (1)..(203): useful for making plants with increased salt tolerance as described in USSN 12/377,106
  misc_feature (1)..(203): Public GI no. 82623371
  misc_feature (1)..(203): Score of 482.9 for HMM of FIGURE 1 of USSN 12/377,106.
  misc_feature (1)..(203): Functional Homolog of  Ceres LOCUS ID no. At5g67390

SEQ ID NO: 2924 - protein, 207 aa, Triticum aestivum; identical to SEQ ID NO: 2079
  misc_feature (1)..(207): useful for making plants with increased salt tolerance as described in USSN 12/377,106
  misc_feature (1)..(207): Ceres CLONE ID no. 918760
  misc_feature (1)..(207): Score of 422.0 for HMM of FIGURE 1 of USSN 12/377,106.
  misc_feature (1)..(207): Functional Homolog of  Ceres LOCUS ID no. At5g67390

SEQ ID NO: 2925 - protein, 162 aa, Panicum virgatum; identical to SEQ ID NO: 1962
  misc_feature (1)..(162): useful for making plants with increased salt tolerance as described in USSN 12/377,106
  misc_feature (1)..(162): Ceres CLONE ID no. 1775586
  misc_feature (1)..(162): Score of 325.3 for HMM of FIGURE 1 of USSN 12/377,106.
  misc_feature (1)..(162): Functional Homolog of  Ceres LOCUS ID no. At5g67390

SEQ ID NO: 2926 - DNA, 666 bp, Brassica napus
  misc_feature (1)..(666): useful for making plants with increased salt tolerance as described in USSN 12/377,106
  misc_feature (1)..(666): Ceres CLONE ID no. 977067
  misc_feature (1)..(666): Ceres SEED LINE ME12707
  misc_feature (1)..(666): similar to a tetracycline transporter-like protein in Arabidopsis and rice
actcacattttttcatttgcttagaggacatctcttaacaatggaggaaacaacaacgtttcaggggctaagacaccttttcatgaccgtcttcttgcacggattctcggcgttcattgtagtcccggtcattacagacgtcagcatggcggctttatgtcctggaaaagacgagtgttccctcgcaatttacctctcaggctttcaacaggctattacgggtgtggggtccttgatgatgatgccgttggtaggaagcttgtcagataagcatggaagaaaaagtttactcacacttccaatggcactcaacattctgcctcttgtctttgatgtagatgttgaatgttcactttgaagaatctctgaatagtgccatctgtctcttgaaatctctcaacggcatgtacaacacattggataaatcatactccaaagcatccatatataatctgaaaatccgtgcaaggtgtttttcagacatagacttccacaagcttccacagccatgatttcaatcaccaaatactttagatgcaccaagtctaacatctagaaatcttcaaacaaaaccaacaaacaatttcgttttgtacctcacgaatttctttatgataaaacaaagattaccagctatttcaaataaactgaattaacttgaaagcc

SEQ ID NO: 2927 - protein, 105 aa, Brassica napus
  misc_feature (1)..(105): useful for making plants with increased salt tolerance as described in USSN 12/377,106
  misc_feature (1)..(105): Ceres CLONE ID no. 977067
  misc_feature (1)..(105): Ceres SEED LINE ME12707
  misc_feature (1)..(105): Score of 252.1 for HMM of FIGURE 2 of USSN 12/377,106.
  misc_feature (13)..(93): Pfam Name: MFS_1 Pfam Description: Major Facilitator Superfamily
  misc_feature (1)..(105): similar to a tetracycline transporter-like protein in Arabidopsis and rice
MEETTTFQGLRHLFMTVFLHGFSAFIVVPVITDVSMAALCPGKDECSLAIYLSGFQQAITGVGSLMMMPLVGSLSDKHGRKSLLTLPMALNILPLVFDVDVECSL

SEQ ID NO: 2928 - protein, 105 aa, Artificial
  misc_feature (1)..(105): useful for making plants with increased salt tolerance as described in USSN 12/377,106
  misc_feature (1)..(105): truncation of Ceres Annot no. 1450608 sequence from Populus balsamifera
  misc_feature (1)..(105): Score of 271.1 for HMM of FIGURE 2 of USSN 12/377,106.
  misc_feature (10)..(104): Pfam Name: MFS_1 Pfam Description: Major Facilitator Superfamily
  misc_feature (1)..(105): Functional Homolog of  Ceres CLONE ID no. 977067
MEKLTELSHLLVTVFLSSFASLMVIPAITDVTMVAVCPGKDECSLAIYLSGFQQAIIGLGTVVMMPLIGNLSDQYGRKALLTLPMTLSIIPLVILAYSRTTNFFY

SEQ ID NO: 2929 - protein, 105 aa, Artificial
  misc_feature (1)..(105): useful for making plants with increased salt tolerance as described in USSN 12/377,106
  misc_feature (1)..(105): truncation of Public GI no. 2264382 from Arabidopsis thaliana
  misc_feature (1)..(105): Score of 248.0 for HMM of FIGURE 2 of USSN 12/377,106.
  misc_feature (1)..(105): Functional Homolog of Ceres CLONE ID no. 977067
MEDGIGGLRHMLATVFLSAFAGFMVVPVITDVTVAAVCSGPDDSCSLAVYLTGFQQVAIGMGTMIMMPVIGNLSDRYGIKTILTLPMCLSIVPPVILGYRRDIKF

SEQ ID NO: 2930 - protein, 105 aa, Artificial
  misc_feature (1)..(105): useful for making plants with increased salt tolerance as described in USSN 12/377,106
  misc_feature (1)..(105): truncation of Ceres Clone 298099 from Zea mays
  misc_feature (1)..(105): Score of 260.2 for HMM of FIGURE 2 of USSN 12/377,106.
  misc_feature (10)..(96): Pfam Name: MFS_1 Pfam Description: Major Facilitator Superfamily
  misc_feature (1)..(105): Functional Homolog of Ceres CLONE ID no. 977067
MKDLAGLAHLFVVSFLFHFASFMVIPAVTDVTMEAACPGRDECSVAIYLSGFQNAVTGMGALVVTPIVGNLSDRYGRKALMTLPVTVAIAPLFILACGRSEVYFY

SEQ ID NO: 2931 - protein, 105 aa, Artificial
  misc_feature (1)..(105): useful for making plants with increased salt tolerance as described in USSN 12/377,106
  misc_feature (1)..(105): truncation of Public GI no. 92871443 from Medicago truncatula
  misc_feature (1)..(105): Score of 254.5 for HMM of FIGURE 2 of USSN 12/377,106.
  misc_feature (1)..(105): Functional Homolog of eres CLONE ID no. 977067
MSWWSGFFELRPLFHLLLPLSIHWIAEEMTVSVLVDVTTTALCPQQSSCSKAIYINGLQETIAGIFKMMVLPLLGQLSDDHGRKPFLLLTMSTTIFPFALLAWNQ

SEQ ID NO: 2932 - protein, 106 aa, Artificial
  misc_feature (1)..(106): useful for making plants with increased salt tolerance as described in USSN 12/377,106
  misc_feature (1)..(106): truncation of Public GI no. 62732717 from Oryza sativa subsp. japonica
  misc_feature (1)..(106): Score of 254.0 for HMM of FIGURE 2 of USSN 12/377,106.
  misc_feature (1)..(106): Functional Homolog of eres CLONE ID no. 977067
MEQLKPLMHLLLGLVMYWVAEEMTVPVLVDVTTRALCPGADIACPEAIYLTGLHQTVGGIFRAVGYTLMGQLADEYGRKPLLLLTASTSIIPYGVLACNKSKIAVY

SEQ ID NO: 2933 - protein, 105 aa, Artificial
  misc_feature (1)..(105): useful for making plants with increased salt tolerance as described in USSN 12/377,106
  misc_feature (1)..(105): truncation of Ceres CLONE ID no. 1725891 from Panicum varigatum
  misc_feature (1)..(105): Score of 265.2 for HMM of FIGURE 2 of USSN 12/377,106.
  misc_feature (10)..(96): Pfam Name: MFS_1 Pfam Description: Major Facilitator Superfamily
  misc_feature (1)..(105): Functional Homolog of Ceres CLONE ID no. 977067
MKDFAGLGHLFVVSFLFYFSSFMVIPAITDVTMEAVCPGRDECSVAIYLSGFQNAVTGLGALVVTPVVGNLSDRYGRKALLTLPVTVAILPLFILACNRSDLYFY

SEQ ID NO: 2934 - DNA, 507 bp, Arabidopsis thaliana; identical to SEQ ID NO: 2190
  misc_feature (1)..(507): useful for making plants with increased salt tolerance as described in USSN 12/377,106
  misc_feature (1)..(507): Ceres LOCUS ID At1g26710
  misc_feature (1)..(507): Ceres SEED LINE ME12485

SEQ ID NO: 2935 - protein, 168 aa, Arabidopsis thaliana; identical to SEQ ID NO: 2191
  misc_feature (1)..(168): useful for making plants with increased salt tolerance as described in USSN 12/377,106
  misc_feature (1)..(168): Ceres SEED LINE ME12485

SEQ ID NO: 2936 - protein, 168 aa, Arabidopsis thaliana; identical to SEQ ID NO: 2438
  misc_feature (1)..(168): useful for making plants with increased salt tolerance as described in USSN 12/377,106
  misc_feature (1)..(168): Public GI no. 21593648
  misc_feature (1)..(168): Functional Homolog of  Ceres LOCUS ID no. At1g26710

SEQ ID NO: 2937 - protein, 169 aa, Arabidopsis thaliana; identical to SEQ ID NO: 2441
  misc_feature (1)..(169): useful for making plants with increased salt tolerance as described in USSN 12/377,106
  misc_feature (1)..(169): Public GI no. 15223328
  misc_feature (1)..(169): Functional Homolog of  Ceres LOCUS ID no. At1g26710

SEQ ID NO: 2938 - DNA, 875 bp, Triticum aestivum
  misc_feature (1)..(875): useful for making plants with increased salt tolerance as described in USSN 12/377,106
  misc_feature (1)..(875): Ceres CLONE ID no. 918760
actagtgcctaccggaagtccacaacacacctttgccgtctcccctctccttttatatttgtctcatgcaagcttataatcgctcaaagacaagacgagaagagcaagaagagaagcatatgacgcagatggaggagctcgtgcaccagtgcgacatggaggtcatgaagatggccatgctcaagcacgagcagacattcaggcagcaggtgcatgatctacaccggctgtaccgagtccagaagcagctcatgggcgaccagagcgggcgcccgtcggtgccaccctgccatcaggtgcagcggcgcagggagcacccccgccggccggagctgagcctgcagctccctgtcgacgacgacgagtacgccgtcgtcagcggcggcacaggccgcctagcgacgccgccgtccatggagagcgaggacgagctggagctgacgctggccgtcggcggcggcggcgggaacggcggcagcagccggagccagaggaggaggcgggagagtgcgacggactgctccggcagaagaagcccacagacgccgtcttcgtcgaccgactccgacgacgcgctccgcacggtgccgcaccaccagagggcgacggcgtgtgatctccggggaggggtgatggtgtcgaagcagccgcaatggctggtgcgctgtctcagccttaggatggcttgatcgatttcacgacgagacctctactgtagacttttgttaaattgctaccggtttccccgcgtggttactggtactccctcctctgtcccataatagcgttttttacactacactagtgtcaaaaacactcttatattataagacggagggaatagtaaattagattgatcaaaaaaaaaaaaaaaa

SEQ ID NO: 2939 - DNA, 806 bp, Panicum virgatum; identical to SEQ ID NO: 1961
  misc_feature (1)..(806): useful for making plants with increased salt tolerance as described in USSN 12/377,106
  misc_feature (1)..(806): Ceres CLONE ID no. 1775586

SEQ ID NO: 2940 - DNA, 685 bp, Gossypium hirsutum; identical to SEQ ID NO: 2035
  misc_feature (1)..(685): useful for making plants with increased salt tolerance as described in USSN 12/377,106
  misc_feature (1)..(685): Ceres CLONE ID no. 1840844

SEQ ID NO: 2941 - protein, 148 aa, Gossypium hirsutum; identical to SEQ ID NO: 2036
  misc_feature (1)..(148): useful for making plants with increased salt tolerance as described in USSN 12/377,106
  misc_feature (1)..(148): Ceres CLONE ID no. 1840844
  misc_feature (1)..(148): Score of 143.7 for HMM of FIGURE 1 of USSN 12/377,106.
  misc_feature (1)..(148): Functional Homolog of Ceres LOCUS ID no. At5g67390

SEQ ID NO: 2942 - DNA, 1370 bp, Gossypium hirsutum; identical to SEQ ID NO: 2037
  misc_feature (1)..(1370): useful for making plants with increased salt tolerance as described in USSN 12/377,106
  misc_feature (1)..(1370): Ceres CLONE ID no. 1853364

SEQ ID NO: 2943 - protein, 200 aa, Gossypium hirsutum; identical to SEQ ID NO: 2038
  misc_feature (1)..(200): useful for making plants with increased salt tolerance as described in USSN 12/377,106
  misc_feature (1)..(200): Ceres CLONE ID no. 1853364
  misc_feature (1)..(200): Score of 224.2 for HMM of FIGURE 1 of USSN 12/377,106.
  misc_feature (1)..(200): Functional Homolog of Ceres LOCUS ID no. At5g67390

SEQ ID NO: 2944 - DNA, 679 bp, Panicum virgatum
  misc_feature (1)..(679): useful for making plants with increased salt tolerance as described in USSN 12/377,106
  misc_feature (1)..(679): Ceres CLONE ID no. 2029721
aagtgcctctctaaccctacccctcctcctgcaccagaaagtgccccctgttgcatggttcttcgaggcctcgatcccgataagcatccaagtgtgagaggtgcctgtctccacttcttgacttgttcttctgttgctacaacatgtcaagatatcatctgaagcagtatgagaaggatcacatgaagatggccatgctgaagcaggaacagacattcaagcagcaggttcaagaactgcatcgactgtaccgggtccagaagctactgatgaccgacgcggcgaacgcagcagcaatgcccgcggccacccgatgcgacctcgaggacgagaggcgcgccgcggagaaccacgccggctcgagcaagtcgggggacggctcctactcggagcaggggaaggccaccgctccccagctcgccctacaagagagcgagctcgagctgacgctgtctctagggtgcttcgggacggccgggaagaaggcagccaagaaggaggtgtcgtcgagcgtggactccaggacgagcatttcgtcgtcgtcgacggagtccggtagccccgactgcagggtcgccctgcctgctccgtcgctgatcgggtccgcggctgctggtagcgtggggcagcgtctggagcaggacggcctgcagcagcctccttggctccacagtgtctg

SEQ ID NO: 2945 - protein, 183 aa, Panicum virgatum; identical to SEQ ID NO: 2062
  misc_feature (1)..(183): useful for making plants with increased salt tolerance as described in USSN 12/377,106
  misc_feature (1)..(183): Ceres CLONE ID no. 2029721
  misc_feature (1)..(183): Score of 113.1 for HMM of FIGURE 1 of USSN 12/377,106.
  misc_feature (1)..(183): Functional Homolog of Ceres LOCUS ID no. At5g67390

SEQ ID NO: 2946 - DNA, 974 bp, Zea mays; identical to SEQ ID NO: 2048
  misc_feature (1)..(974): useful for making plants with increased salt tolerance as described in USSN 12/377,106
  misc_feature (1)..(974): Ceres CLONE ID no. 388717

SEQ ID NO: 2947 - protein, 225 aa, Zea mays; identical to SEQ ID NO: 2049
  misc_feature (1)..(225): useful for making plants with increased salt tolerance as described in USSN 12/377,106
  misc_feature (1)..(225): Ceres CLONE ID no. 388717
  misc_feature (1)..(225): Score of 83.5 for HMM of FIGURE 1 of USSN 12/377,106.
  misc_feature (1)..(225): Functional Homolog of Ceres LOCUS ID no. At5g67390

SEQ ID NO: 2948 - DNA, 874 bp, Glycine max
  misc_feature (1)..(874): useful for making plants with increased salt tolerance as described in USSN 12/377,106
  misc_feature (1)..(874): Ceres CLONE ID no. 523448
attagtgtctcaatgtcattgtaaccatgctttcattgaaccaccttattttctatataaaagcttttcagttttcaatttttcatcctatcctgtctgaattttctctcttaatatatataacttacatatgaaggtagagtgatatcatgaagaagcaagtctgagtacaagtttcataaaaagaggagttacctttgtatcactagttcaaagttcaccttctcagaagctacatagatacactgatggagaagcttgtaaggtcctgtgacaaagaatatatgaggatggccatgttaaaacacgaagaaactttcaaagagcaggtatatgagcttcatcgtttgtaccaaattcagaagatactgatgcaaaacatggatgccagaagaggaattgaagtgaccaaagaagaatggtacttcaagaatgcgatcggtttaacttgcaaaggggcacaagaaaagcctcaaatgaaaatcgacctcgaaaggcctgcagaggagcacattgcagaatcagaagatggggtgctagaggtcatagatgagactgagattgagctgacattagccccctcaagtthcmaccgtaggaagaaagtcgagacmccgctaacttcarawtcaggacmcagcttgtyttyttyttytagtggatccagccatgtaaacaagacaagatgtcatggcactcacacaacaagagaaaactcaagtggaagcataattcgcctcgtygaggkgccgggttytaccccagcataccaaagtggaattagaaacagttttgatattgaagaacaattaagacaaragagattaaaacagtcaccttggcttttccaagtgttgaatytgaacatgacttg

SEQ ID NO: 2949 - protein, 208 aa, Glycine max; identical to SEQ ID NO: 2042
  misc_feature (1)..(208): useful for making plants with increased salt tolerance as described in USSN 12/377,106
  misc_feature (1)..(208): Ceres CLONE ID no. 523448
  misc_feature (1)..(208): Score of 402.9 for HMM of FIGURE 1 of USSN 12/377,106.
  misc_feature (1)..(208): Functional Homolog of Ceres LOCUS ID no. At5g67390

SEQ ID NO: 2950 - protein, 230 aa, Oryza sativa subsp. japonica
  misc_feature (1)..(230): useful for making plants with increased salt tolerance as described in USSN 12/377,106
  misc_feature (1)..(230): Public GI ID no. 115455513
  misc_feature (1)..(230): Score of 70.8 for HMM of FIGURE 1 of USSN 12/377,106.
  misc_feature (1)..(230): Functional Homolog of Ceres LOCUS ID no. At5g67390
MTMPMEQVFEHYDKDTLKMAMLKHEETFRQQVHELHRLYRIQKLLMRDLKRELKNQSNMSTSSPNGFAEYSRAALDAMRSYEQCYGAATRRGAAVHHAAAAARAALSLVPAVEYAQSPEEEDAEETDDEEEAAAAELELTLAVGDAASAKKRYSRNEHHSPGQSFSSSSTESDVLVTGVRDADAASPPYHHKRRPGPAAAFDVVQVDDGAVQAAPPPPPLLFHWLSLRMA

SEQ ID NO: 2951 - protein, 197 aa, Oryza sativa subsp. indica; identical to SEQ ID NO: 2065
  misc_feature (1)..(197): useful for making plants with increased salt tolerance as described in USSN 12/377,106
  misc_feature (1)..(197): Public GI ID no. 125537171
  misc_feature (1)..(197): Score of 140.8 for HMM of FIGURE 1 of USSN 12/377,106.
  misc_feature (1)..(197): Functional Homolog of Ceres LOCUS ID no. At5g67390

SEQ ID NO: 2952 - protein, 228 aa, Oryza sativa subsp. japonica
  misc_feature (1)..(228): useful for making plants with increased salt tolerance as described in USSN 12/377,106
  misc_feature (1)..(228): Public GI ID no. 17027268
  misc_feature (1)..(228): Score of 70.8 for HMM of FIGURE 1 of USSN 12/377,106.
  misc_feature (1)..(228): Functional Homolog of Ceres LOCUS ID no. At5g67390
MPMEQVFEHYDKDTLKMAMLKHEETFRQQVHELHRLYRIQKLLMRDLKRELKNQSNMSTSSPNGFAEYSRAALDAMRSYEQCYGAATRRGAAVHHAAAAARAALSLVPAVEYAQSPEEEDAEETDDEEEAAAAELELTLAVGDAASAKKRYSRNEHHSPGQSFSSSSTESDVLVTGVRDADAASPPYHHKRRPGPAAAFDVVQVDDGAVQAAPPPPPLLFHWLSLRMA

SEQ ID NO: 2953 - DNA, 645 bp, Populus balsamifera subsp. trichocarpa; identical to SEQ ID NO: 2039
  misc_feature (1)..(645): useful for making plants with increased salt tolerance as described in USSN 12/377,106
  misc_feature (1)..(645): Ceres ANNOT ID no. 1451488

SEQ ID NO: 2954 - protein, 214 aa, Populus balsamifera subsp. trichocarpa; identical to SEQ ID NO: 2040
  misc_feature (1)..(214): useful for making plants with increased salt tolerance as described in USSN 12/377,106
  misc_feature (1)..(214): Ceres ANNOT ID no. 1451488
  misc_feature (1)..(214): Score of 423.1 for HMM of FIGURE 1 of USSN 12/377,106.
  misc_feature (1)..(214): Functional Homolog of Ceres LOCUS ID no. At5g67390

SEQ ID NO: 2955 - protein, 105 aa, Gossypium hirsutum
  misc_feature (1)..(105): useful for making plants with increased salt tolerance as described in USSN 12/377,106
  misc_feature (1)..(105): Ceres CLONE ID no. 1934786
  misc_feature (1)..(105): Score of 254.7 for HMM of FIGURE 2 of USSN 12/377,106.
  misc_feature (10)..(104): Pfam Name: MFS_1 Pfam Description: Major Facilitator Superfamily
  misc_feature (1)..(105): Functional Homolog of Ceres CLONE ID no. 977067
MGKLSGLRHLFMTLFLHNFASFMVIPAITDVTMAALCPGRDECSLAIYISGFQQAIIGLGSFVMMPLVGNLSDKYGRKALLTVPITLTIFPLAILAYSRTRSFFY

SEQ ID NO: 2956 - protein, 108 aa, Arabidopsis thaliana
  misc_feature (1)..(108): useful for making plants with increased salt tolerance as described in USSN 12/377,106
  misc_feature (1)..(108): Public GI ID no. 110737241
  misc_feature (1)..(108): Score of 239.8 for HMM of FIGURE 2 of USSN 12/377,106.
  misc_feature (13)..(107): Pfam Name: MFS_1 Pfam Description: Major Facilitator Superfamily
  misc_feature (1)..(108): Functional Homolog of Ceres CLONE ID no. 977067
MEETTTFHGLGHLFITIFLYCFSSFIVAPVITDISMAALCPGKDECSLAIYLSGFQQVITGVGSLIMMPLVGSLSDKHGRKCLLTLPMTLNILPLVTLAYSRGATIFY

SEQ ID NO: 2957 - protein, 105 aa, Oryza sativa subsp. indica
  misc_feature (1)..(105): useful for making plants with increased salt tolerance as described in USSN 12/377,106
  misc_feature (1)..(105): Public GI ID no. 125540608
  misc_feature (1)..(105): Score of 248.9 for HMM of FIGURE 2 of USSN 12/377,106.
  misc_feature (10)..(96): Pfam Name: MFS_1 Pfam Description: Major Facilitator Superfamily
  misc_feature (1)..(105): Functional Homolog of Ceres CLONE ID no. 977067
MKDLAVLGHLFVAAFMFHFASYMVIPAITDVTMDAVCPGRDECSVAIYLSGFQSAITGMGALVVTPIVGNLSDKYGRKALMTLPVTVAILPLFILACNRSKVYFY

SEQ ID NO: 2958 - protein, 101 aa, Oryza sativa subsp. japonica
  misc_feature (1)..(101): useful for making plants with increased salt tolerance as described in USSN 12/377,106
  misc_feature (1)..(101): Public GI ID no. 125583188
  misc_feature (1)..(101): Score of 179.5 for HMM of FIGURE 2 of USSN 12/377,106.
  misc_feature (10)..(83): Pfam Name: MFS_1 Pfam Description: Major Facilitator Superfamily
  misc_feature (1)..(101): Functional Homolog of Ceres CLONE ID no. 977067
MKDLAVLGHLFVAAFMFHFASYMVIPAITDVTMDAVCPGRDECSVAIYLSGFQSAITGMGALVVTPIVGNLSDKYGRKALMTLPLYWPATAPRCTSTCTTS

SEQ ID NO: 2959 - DNA, 1374 bp, Populus balsamifera subsp. trichocarpa
  misc_feature (1)..(1374): useful for making plants with increased salt tolerance as described in USSN 12/377,106
  misc_feature (1)..(1374): Ceres ANNOT ID no. 1450608
atggagaagctaacagaactgagccacctccttgtgacagtattcctctccagctttgctagtttaatggtgatcccggccataaccgatgtcaccatggtagcagtttgtcctggaaaagatgagtgctctcttgcgatttacctctccgggttccagcaagctatcatcggactggggacagttgtgatgatgccgctaataggaaatctatcagaccagtatggaaggaaagccttgctcacactccctatgactctctccattattcctttagttatactggcatacagtaggacaaccaacttcttctatgcctactatgtgctcaggaccctcacggctatgatctgtgaaggcagcatcaactgccttgctcttgcttatgtggcagacaacgttttagagagacagagaacatcagcatttggaattctatctggcatagccacagccgcatttgtctgtggaaccttagctgctcgtttcctctccactgctttaacgtttcaggtggctgcgttggtgtcaatgcttgctgctgtgtacatgagaattttcctcgaagagagtctaccaaatggcgaaaatttgacgcagccaatcttgaagagcggacaggatgatcactgtcaagatggtgatttatcaaggaaggcgccggtattgaagaagatcccatcaattcaggatatcattggcttgctgaagagcagggtaacattttcgcaagcagcagttgttgcattcttcaatagtcttgcagaaggtggaatgcaagctagcatcatgtactacttgaaggctcgttttcacttcagcaaaaaccattatgctgatctgatgctacttcttggcattgcgggaatggcctcacagctggttttcatgcccttgttggcaccacatgtagcagaggaaaaactgctggcaatagggcttttagggggcatcgcagatgtcccatatgccaccaccatttttgcggtttttattgtttgcgtgcctccatgtttacgcagcattgcatcgaaacaagtagggccaactgagcaggggaaggctcaaggatgcatttcaggaataatctccttcgcaaacatcatctcccccttaatctttagtcctctgacagatgattgcattctttcagagtgttctcatgaggggtcctcctcctgtttcaagtcacaaaatcagctgcaacagcttggtagcctagacctagttcagatcgaaatgaccaatttaaggtacaaggaggaagcctctctaaacccttcatttaccataagggtgatcttgctatttggggagaccctcgtaagaaagattagaacagccttaatgaaatcttcagtattatacgcgtaa

SEQ ID NO: 2960 - protein, 457 aa, Populus balsamifera subsp. trichocarpa
  misc_feature (1)..(457): useful for making plants with increased salt tolerance as described in USSN 12/377,106
  misc_feature (1)..(457): Ceres ANNOT ID no. 1450608
  misc_feature (1)..(457): Score of 1154.8 for HMM of FIGURE 3 of USSN 12/377,106.
  misc_feature (10)..(379): Pfam Name: MFS_1 Pfam Description: Major Facilitator Superfamily
  misc_feature (1)..(457): Functional Homolog of Ceres CLONE ID no. 977067
MEKLTELSHLLVTVFLSSFASLMVIPAITDVTMVAVCPGKDECSLAIYLSGFQQAIIGLGTVVMMPLIGNLSDQYGRKALLTLPMTLSIIPLVILAYSRTTNFFYAYYVLRTLTAMICEGSINCLALAYVADNVLERQRTSAFGILSGIATAAFVCGTLAARFLSTALTFQVAALVSMLAAVYMRIFLEESLPNGENLTQPILKSGQDDHCQDGDLSRKAPVLKKIPSIQDIIGLLKSRVTFSQAAVVAFFNSLAEGGMQASIMYYLKARFHFSKNHYADLMLLLGIAGMASQLVFMPLLAPHVAEEKLLAIGLLGGIADVPYATTIFAVFIVCVPPCLRSIASKQVGPTEQGKAQGCISGIISFANIISPLIFSPLTDDCILSECSHEGSSSCFKSQNQLQQLGSLDLVQIEMTNLRYKEEASLNPSFTIRVILLFGETLVRKIRTALMKSSVLYA

SEQ ID NO: 2961 - DNA, 1911 bp, Zea mays
  misc_feature (1)..(1911): useful for making plants with increased salt tolerance as described in USSN 12/377,106
  misc_feature (1)..(1911): Ceres CLONE ID no. 298099
aaacgcatgcaatctatcaccgcctcagctcgtgctctctgctctgcactatctaccaaagaaagatgaaggacttggcggggctggcgcacctgttcgtggtgtccttcctgttccacttcgcctccttcatggtgatcccggcggtcaccgacgtcaccatggaggccgcctgccccggccgcgacgagtgctccgtcgccatctacctcagcggcttccagaacgcagtcaccgggatgggggcgctcgtcgtcacccccatcgtcgggaacctgtcggacaggtacggccggaaggcgctcatgacgctgccggtcaccgtagccatcgcgccgctgtttatactggcatgcggccgctcggaggtgtacttctacgtgtactacgtggccaagatcatcgccggggtcttctgcgagggcaccatgcattgtctctgccttgcctacgtggctgaccacgtgggccccaggcgtcgcgcggcggcgttcggcctcctctccggcgtgtcggcagccgggttcgtgtcggggaccttgaccgcgcgcttcctcccgaccgcatccaccttccaggtcgccgccgccgtggccgtggcggcagcgctctacctcagggccttcctccccgacgctggcggcagcgtctcctgcgccgacgaagcctgcgaccctctcctccaggattcgtcctgcgcctcttccacatcatcctccgatgaagagctctcgcctcggctgccgccgcataagagaggcctgccgtctctgtccgacatggtcgcgcttctcactggcagtctggccttgtcaggggcagcaaccatcactttcttctacagtctaggtgaacatgggcttcagactgcattgctgtactacttgaaggcacaatttggttacaacaaagatgagtttgctaatctacttctaattgtcggtgctgccgggatgctatcacagctcactgtaatgcctatcttggctccgattctgggtgaagagatgctgcttattgttgggcttctaggtggatgtactcatgttttcttgtatggcattgcatggtcatattgggtaccttattttgctgcggcatttgtaattttgagtgcttttgttcacccatctataagaaccaatgtatcaaaaaatgtcggatcaaatgagcagggaattgctcaaggatgtatatctgggattagttcttttgcaagcatattaggtcccctcatctttactcccttaaccgcgtggtttctttctgaaacagagcccttcaacttcaaaggtttcagtattttgtgtgctggcttctgcacccttattgcgtttgttatcagtttgaggatgcctggtgctcgatctagtacgtgcaagaagaccgcagttcagcatgagcaagcatgacagaatatagtatagtgccacctactcttttttattctgcccaagtgcatagacagaaaaggacaggatgggaaaaaagtgacttcgagaaaaaggaaaaggtatagtgacaggaagtgctggagaaacatgctcgatttcgtatgttcaaagagaaggggttatcctatgcaactagacatttttatccttcactggaatgttgagcattgcagaattgacaattgctatgccatcgagcaagttcagtcgtttgtaaatatgctcctagtaggaagtaactgaattattcgcaaaaaaaggaagtggctgaactattgtgccttttgcacgatgcttcgtttcaaggattagccatgaattaacgtttatgtactctaagaggaggtgatttgcatctcaactaaacatttgagtatgcagttaagttgatttgtccagttaaatatgtagaacatgttcctccttcataggtcatccttttgagttctactttgcg

SEQ ID NO: 2962 - protein, 448 aa, Zea mays
  misc_feature (1)..(448): useful for making plants with increased salt tolerance as described in USSN 12/377,106
  misc_feature (1)..(448): Ceres CLONE ID no. 298099
  misc_feature (1)..(448): Score of 1135.6 for HMM of FIGURE 3 of USSN 12/377,106.
  misc_feature (10)..(397): Pfam Name: MFS_1 Pfam Description: Major Facilitator Superfamily
  misc_feature (1)..(448): Functional Homolog of Ceres CLONE ID no. 977067
MKDLAGLAHLFVVSFLFHFASFMVIPAVTDVTMEAACPGRDECSVAIYLSGFQNAVTGMGALVVTPIVGNLSDRYGRKALMTLPVTVAIAPLFILACGRSEVYFYVYYVAKIIAGVFCEGTMHCLCLAYVADHVGPRRRAAAFGLLSGVSAAGFVSGTLTARFLPTASTFQVAAAVAVAAALYLRAFLPDAGGSVSCADEACDPLLQDSSCASSTSSSDEELSPRLPPHKRGLPSLSDMVALLTGSLALSGAATITFFYSLGEHGLQTALLYYLKAQFGYNKDEFANLLLIVGAAGMLSQLTVMPILAPILGEEMLLIVGLLGGCTHVFLYGIAWSYWVPYFAAAFVILSAFVHPSIRTNVSKNVGSNEQGIAQGCISGISSFASILGPLIFTPLTAWFLSETEPFNFKGFSILCAGFCTLIAFVISLRMPGARSSTCKKTAVQHEQA

SEQ ID NO: 2963 - protein, 452 aa, Oryza sativa subsp. indica
  misc_feature (1)..(452): useful for making plants with increased salt tolerance as described in USSN 12/377,106
  misc_feature (1)..(452): Public GI ID no. GI_125540608
  misc_feature (1)..(452): Score of 1115.1 for HMM of FIGURE 3 of USSN 12/377,106.
  misc_feature (10)..(400): Pfam Name: MFS_1 Pfam Description: Major Facilitator Superfamily
  misc_feature (1)..(452): Functional Homolog of Ceres CLONE ID no. 977067
MKDLAVLGHLFVAAFMFHFASYMVIPAITDVTMDAVCPGRDECSVAIYLSGFQSAITGMGALVVTPIVGNLSDKYGRKALMTLPVTVAILPLFILACNRSKVYFYVYYVVKVLAGIFCEGSMHCLLLAYVADQVGARRRAAAFGLLSGVSAAGFVSGTLTARFLQTSTTFQVAAAVAAATAIYLRAVVPDSGGANSFVDEACDPFLQGSSCSAATSSSSSSDEEISPRLPPHKGGVPSLSDMVSLLTGSLTLSGAAIVTFFYSLGEHGLQTALLYYLKAQFGYSKDEFANLLLIAGAAGMLSQLTVMPVLARFVGEDILLIIGLLGGCTHVFLYGIAWSYWVPYLSAVFIILSAFVHPSIRTNVSKSVGSNEQGIAQGCISGISSFASILAPLIFTPLTAWVLSETAPFKFKGFSIMCAGFCTLIAFIISMRMRAGQSGASEKLAIVQHEQA

SEQ ID NO: 2964 - protein, 444 aa, Oryza sativa subsp. japonica
  misc_feature (1)..(444): useful for making plants with increased salt tolerance as described in USSN 12/377,106
  misc_feature (1)..(444): Public GI ID no. 125583188
  misc_feature (1)..(444): Score of 1062.4 for HMM of FIGURE 3 of USSN 12/377,106.
  misc_feature (10)..(392): Pfam Name: MFS_1 Pfam Description: Major Facilitator Superfamily
  misc_feature (1)..(444): Functional Homolog of Ceres CLONE ID no. 977067
MKDLAVLGHLFVAAFMFHFASYMVIPAITDVTMDAVCPGRDECSVAIYLSGFQSAITGMGALVVTPIVGNLSDKYGRKALMTLPLYWPATAPRCTSTCTTSLRSSPASSARAACIASCSPTWPTKSAPGGERRRSGSSPGVSAAGFVSGTLTARFLQTSTTFQVAAAVAAATAIYLRAVVPDSGGANSFVDEACDPFLQGSSCSAATSSSSSSDEEISPRLPPHKGGVPSLSDMVSLLTGSLTLSGAAIVTFFYSLGEHGLQTALLYYLKAQFGYSKDEFANLLLIAGAAGMLSQLTVMPVLARFVGEDILLIIGLLGGCTHVFLYGIAWSYWVPYLSAVFIILSAFVHPSIRTNVSKSVGSNEQGIAQGCISGISSFASILAPLIFTPLTAWVLSETAPFKFKGFSIMCAGFCTLIAFIISMRMRAGQSGASEMLAIVQHEQA

SEQ ID NO: 2965 - protein, 418 aa, Arabidopsis thaliana
  misc_feature (1)..(418): useful for making plants with increased salt tolerance as described in USSN 12/377,106
  misc_feature (1)..(418): Public GI ID no. 2264382
  misc_feature (1)..(418): Score of 1002.6 for HMM of FIGURE 3 of USSN 12/377,106.
  misc_feature (11)..(365): Pfam Name: MFS_1 Pfam Description: Major Facilitator Superfamily
  misc_feature (1)..(418): Functional Homolog of Ceres CLONE ID no. 977067
MEDGIGGLRHMLATVFLSAFAGFMVVPVITDVTVAAVCSGPDDSCSLAVYLTGFQQVAIGMGTMIMMPVIGNLSDRYGIKTILTLPMCLSIVPPVILGYRRDIKFFYVFYISKILTSMAVNIHGSTRISAFGILAGIKTIAGLFGTLVARFLPIALTFQVSAISFFVGLVYMRVFLKEKLNDDEDDDLHHGTYHQEDHDSINTTMLAEPILNDRPIKTQVFHKKYSSLKDMISLMKTRYYFLKARFGFDKKQFADLLLLITIVGSISQLFVLPRFASAIGECKLLSTGLFMEFINMAIVSISWAPWVPYLTTVFVPGALFVMPSVCGIASRQVGPGEQGKVQGCISGVRSFGKVVAPFVFSPLTALFLSKNAPFYFPGFSLLCISLSSLIGFFQSLLIKDVPTPPLNKAINKTSGEEV

SEQ ID NO: 2966 - protein, 441 aa, Medicago truncatula
  misc_feature (1)..(441): useful for making plants with increased salt tolerance as described in USSN 12/377,106
  misc_feature (1)..(441): Public GI ID no. 92871443
  misc_feature (1)..(441): Score of 1055.5 for HMM of FIGURE 3 of USSN 12/377,106.
  misc_feature (61)..(386): Pfam Name: MFS_1 Pfam Description: Major Facilitator Superfamily
  misc_feature (1)..(441): Functional Homolog of Ceres CLONE ID no. 977067
MSWWSGFFELRPLFHLLLPLSIHWIAEEMTVSVLVDVTTTALCPQQSSCSKAIYINGLQETIAGIFKMMVLPLLGQLSDDHGRKPFLLLTMSTTIFPFALLAWNQSEEFVYAYYVLRTISYIISKGSIFCISVAYVADVVNENKRAAVFGWITGLFSASHVVGNVLARFLPQNYIFVVSIALLIFCPVYMQFFLVETVKLAPRKNQELGFCSKVSYVVSRRYKSMRNAAEIVIFSPALRGMALVSFFYELGMSGITTVLLYYLKAVFGFNKNQFSELLMMVGIGSIFSQIVLLPILNPLVGEKVILCSALLASIAYAWLSGLAWAPWVPYLSASFGIIYVLVKPATYAIISRASSSTNQGKAQTFIAGAQSISDLLSPIVMSPLTSLFLSSDAPFECKGFSILCASVCMMISLIFACMLNPNTPSSYDLEDNIEDPLLNHS

SEQ ID NO: 2967 - DNA, 618 bp, Arabidopsis thaliana
  misc_feature (1)..(618): useful for making plants with increased phosphate use efficiency as described in USSN 12/541,607
  misc_feature (1)..(618): clone34035_inplanta_experimental_L42
gcttaaagtctctggtcaaatgggaaatagtgtaagaagcaatctaagagacatcagaggacgacgatcgatggatcctcggatgtggcacaaagtcgccgctatttccggtatggctgctcttggtttgggaacttatggtgctcatgtctttaaaccagagaacccttcttacaaacaggtgtggcaaacggcttcactttaccatttggttcacactgctgctcttgtttctgctcctagcaccaaatatcccaacatttttggtggcttgttgactgctggaattgtagccttttccggcacgtgttatatggtagcgctgcgggaggacagaaagttttcgacattggcaccattcggaggctttgcgttcattgctgcatgggcaactttacttttctaaacaatctcataaccatctatattgtcaagtttgtggtcaagcttatcctacatatgaactcactgtttttttttgtttacctaagagattgcttaataacaattctgtgtcgacaaccattaagcatcttcctttacttgttcagtttgttgctaaagggattatgtaaatgacgaccatattaatgtaatcttattaccatacaatttacc

SEQ ID NO: 2968 - protein, 128 aa, Arabidopsis thaliana
  misc_feature (1)..(128): useful for making plants with increased phosphate use efficiency as described in USSN 12/541,607
  misc_feature (1)..(128): peptide_clone34035_inplanta_experimental_L42
MGNSVRSNLRDIRGRRSMDPRMWHKVAAISGMAALGLGTYGAHVFKPENPSYKQVWQTASLYHLVHTAALVSAPSTKYPNIFGGLLTAGIVAFSGTCYMVALREDRKFSTLAPFGGFAFIAAWATLLF

SEQ ID NO: 2969 - protein, 111 aa, Brassica napus
  misc_feature (1)..(111): useful for making plants with increased phosphate use efficiency as described in USSN 12/541,607
  misc_feature (1)..(111): CeresClone:872428
MDPRIWHKVAAVSGMAALGLGTYGAHVFKPENPSYKQVWQTASLYHLVHTAALVSAPSTKYPNIFGGLLTAGIVAFSGTCYMVALREDRKFSTLAPFGGFAFIAAWATLLF

SEQ ID NO: 2970 - protein, 113 aa, Brassica napus
  misc_feature (1)..(113): useful for making plants with increased phosphate use efficiency as described in USSN 12/541,607
  misc_feature (1)..(113): CeresClone:972918
MGNCVRSNLRDLGGRRSMDPRIWHKVAAVSGMAALGLGTYGAHVFKPENPSYKQVWQTASLYHLVHTAALVSAPSTKYPNIFGGLLTAGIVAFSGTYEYAKSFVFVNVVGVTW

SEQ ID NO: 2971 - protein, 111 aa, Glycine max
  misc_feature (1)..(111): useful for making plants with increased phosphate use efficiency as described in USSN 12/541,607
  misc_feature (1)..(111): CeresClone:566573
MDPQLWHKVAAISGLAALGLGTYGAHVFKPQNPAYNDVWHTASLYHLVHTAALVAAPITKHPNVFGGLLTAGILAFSGTCYTVAFLEDRKYSTMAPFGGFAFIAAWGSLFF

SEQ ID NO: 2972 - protein, 111 aa, Glycine max
  misc_feature (1)..(111): useful for making plants with increased phosphate use efficiency as described in USSN 12/541,607
  misc_feature (1)..(111): CeresClone:588155
MDPQVWHKVAAISGVAALGLGTYGAHVFKPQNPAYKDVWHTASLYHLVHTAALVAAPITKHPNVFGGLLTAGILAFSGTCYTVAFLEDRKYSTMAPFGGFAFIAAWGSLFF

SEQ ID NO: 2973 - protein, 115 aa, Triticum aestivum
  misc_feature (1)..(115): useful for making plants with increased phosphate use efficiency as described in USSN 12/541,607
  misc_feature (1)..(115): CeresClone:678257
MVMPTDPMLWHKVAAVSGVVALGLGTYGAHMFRPQNPRYKEIWQTASLYHLVHTAALLGAPMTKRPNIFGGLLTTGIVLFSGTCYTVAYLEDRKFSSPAPIGGFAFIAAWASLLF

SEQ ID NO: 2974 - protein, 115 aa, Zea mays
  misc_feature (1)..(115): useful for making plants with increased phosphate use efficiency as described in USSN 12/541,607
  misc_feature (1)..(115): CeresClone:289088
MLAATDPMLWHKVAAVSGVAALGLGTYGAHMFRPKNPAYKEVWHTASLYHLVHTAALLGAPITKRPNVFGGLLTAGIVLFSGTCYTVAYLEDRKFSSPAPLGGFAFIAAWASLLF

SEQ ID NO: 2975 - protein, 93 aa, Psathyrostachys juncea
  misc_feature (1)..(93): useful for making plants with increased phosphate use efficiency as described in USSN 12/541,607
  misc_feature (1)..(93): gi|7963694
MLWHKVAAVSGVAALGLGTYGAHMFRPQNPKYKEIWQTAFLYHLVHTAALLGAPMTKRPNIFGGLLTTGIVLFSGTCYTVAYLEDRKFSSPAP

SEQ ID NO: 2976 - protein, 106 aa, Agropyron cristatum
  misc_feature (1)..(106): useful for making plants with increased phosphate use efficiency as described in USSN 12/541,607
  misc_feature (1)..(106): gi|7963702
MVMPTDPMLWHKVAAVSGVAALGLGTYGAHMFRPQNPRYKEIWQTASLYHLVHTAALLGAPMTKRPNIFGGLLTTGIVLFSGTCYTVAYLEDRKFSSPAPIGGFAF

SEQ ID NO: 2977 - protein, 120 aa, Oryza sativa subsp. japonica
  misc_feature (1)..(120): useful for making plants with increased phosphate use efficiency as described in USSN 12/541,607
  misc_feature (1)..(120): gi|50918749
MAAAAAMAMKDPSLWHKVAAISGVAALGLGTYGAHMFRPKNPAYKEVWHTASLYHLVHTAALLGAPITKRPDVFGGLLTAGIVLFSGTCYTVAYLEDRKYSSTAPLGGFAFIAAWASLLF

SEQ ID NO: 2978 - DNA, 689 bp, Arabidopsis thaliana
  misc_feature (1)..(689): useful for making plants with increased phosphate use efficiency as described in USSN 12/541,607
  misc_feature (1)..(689): clone40781_inplanta_experimental_L43
ataaacgaatccaaatttcaagaggagaagaaaaatcttcaagtccacgacgaaacttttcatcgatcttcaaattccagaaaaaactcgatgaatcttcaagctgtttcttgtagcttcggattcctttcgagtccacttggtgtcactcccagaacttcgtttcgtcgcttcgtaatccgagcgaaaacggaaccgtcggagaaatcagtagagattatgaggaaattctccgagcaatatgctcgtcgctctgggacttacttctgtgttgataaaggagttacttcagtcgttattaagggtttggctgagcataaagattcatatggtgcaccgctttgcccttgcagacactatgatgataaagctgctgaggttggacaaggcttttggaattgtccgtgtgttccaatgagagagaggaaggagtgccattgtatgcttttcttaactcctgataatgatttcgctggaaaagatcagacgattacatcggatgaaataaaagaaactacagctaacatgtgagagagctggttcttccatgttcatcacctctgttctttaggtaaaaaaaaagagagatatgtctcgccccaaatgcagtcttgtacattgataccccgagcatcttcttcgttcttctgtacaactctttcactcttaagataatattctttagtatg

SEQ ID NO: 2979 - protein, 146 aa, Arabidopsis thaliana
  misc_feature (1)..(146): useful for making plants with increased phosphate use efficiency as described in USSN 12/541,607
  misc_feature (1)..(146): peptide_clone40781_inplanta_experimental_L43
MNLQAVSCSFGFLSSPLGVTPRTSFRRFVIRAKTEPSEKSVEIMRKFSEQYARRSGTYFCVDKGVTSVVIKGLAEHKDSYGAPLCPCRHYDDKAAEVGQGFWNCPCVPMRERKECHCMLFLTPDNDFAGKDQTITSDEIKETTANM

SEQ ID NO: 2980 - protein, 148 aa, Spinacia oleracea
  misc_feature (1)..(148): useful for making plants with increased phosphate use efficiency as described in USSN 12/541,607
  misc_feature (1)..(148): gi|505189
MKALQASTSYSFFSKSSSATLQRRTHRPQCVILSKVEPSDKSVEIMRKFSEQYARKSGTYFCVDKGVTSVVIKGLAEHKDSLGAPLCPCRYYDDKAAEATQGFWNCPCVPMRERKECHCMLFLTPENDFAGKDQTIGLDEIREVTANM

SEQ ID NO: 2981 - protein, 143 aa, Brassica napus
  misc_feature (1)..(143): useful for making plants with increased phosphate use efficiency as described in USSN 12/541,607
  misc_feature (1)..(143): CeresClone:1127455
  misc_feature (36)..(36): Xaa is any aa, unknown or other
  misc_feature (63)..(63): Xaa is any aa, unknown or other
MNPQAVSCSFGFVSAPLVSPRTSRFVVQAKSEPSEXSVEIMRKFSEQYARRSGTYFCVDKGVXSVVIKGLAEHKDSYGAPLCPCRHYDDKAAEVGQGFWNCPCVPMRERKECHCMLFLTPDNDFAGKDQTITSDEIKETTAHM

SEQ ID NO: 2982 - protein, 144 aa, Glycine max
  misc_feature (1)..(144): useful for making plants with increased phosphate use efficiency as described in USSN 12/541,607
  misc_feature (1)..(144): CeresClone:470939
MTTQASTFAVAVPSVATPFRRHRNPFVVRAQAEPSDKSVEIMRKFSEQYARKSGTYFCVDKGVTSVVIKGLADHKDTLGAPLCPCRHYDDKAAEVAQGFWNCPCVPMRERKECHCMLFLTPDNDFAGNEQTITLDEIKESTANM

SEQ ID NO: 2983 - protein, 148 aa, Solanum tuberosum
  misc_feature (1)..(148): useful for making plants with increased phosphate use efficiency as described in USSN 12/541,607
  misc_feature (1)..(148): gi|14275859
MRTLQASTSYSVGFGISSFATRPKPSTHRCLTVAKMEPSEKSVEIMRKFSEQYARRSETYFCMDKGVTSVVIKGLAEHKDTLGAPLCPCRHYDDKAAEAQQGFWNCPCVPMRERKECHCMLFLTPDNDFAGEEQTISMEEIKETTANM

SEQ ID NO: 2984 - protein, 152 aa, Zea mays
  misc_feature (1)..(152): useful for making plants with increased phosphate use efficiency as described in USSN 12/541,607
  misc_feature (1)..(152): CeresClone:295783
MTSTVTTTVGCGGLPVRPLSTATRGRPRRCAVRAQAAGADASNDKSVEVMRKFSEQYARRSNTFFCADKTVTAVVIKGLADHRDTLGAPLCPCRHYDDKAAEVAQGFWNCPCVPMRERKECHCMLFLTPDNDFAGKDQVISFEEIKEATSKF

SEQ ID NO: 2985 - protein, 146 aa, Oryza sativa subsp. japonica
  misc_feature (1)..(146): useful for making plants with increased phosphate use efficiency as described in USSN 12/541,607
  misc_feature (1)..(146): gi|50898984
MMSMASTTASPFCPSPMPRGRKCTVRVQAGAAGADASDKSLEIMRKFSEQYARRSNTFFCSEKSVTAVVIKGLADHKDQLGAPLCPCRHYDDKAAEVAQGFWNCPCVPMRERKECHCMLFLTPDNDFAGQDQAITLEEIKDATSKI

SEQ ID NO: 2986 - DNA, 1016 bp, Arabidopsis thaliana
  misc_feature (1)..(1016): useful for making plants with increased phosphate use efficiency as described in USSN 12/541,607
  misc_feature (1)..(1016): clone126592_expected_L44
gttgaatcaaaaataatcagtaacgctttgagtgaagatgatgaatgttgcagtgacagccactccctcgtctctcttgtactctcctctgcttcttccttctcaagggccaaaccggcgaatgcaatggaaaagaaacggaaagagacggttagggacaaaggtggctgtttccggtgttatcacagctggatttgagctgaagccacctccatatcctcttgatgctctggaaccgcatatgagccgggaaaccttggattatcactggggcaaacatcacaaaacttatgtagagaacctgaacaagcaaatcttaggcacggatctagatgcattatccttggaagaagttgtgcttctttcatacaacaaaggcaatatgcttcctgctttcaacaacgctgcacaggcttggaaccacgagttcttctgggagtctatccaacctggaggtggaggaaagccaactggagagctcctcagattaatagaaagagattttgggtctttcgaagagtttttggaaaggttcaagtcggctgcagcttcgaattttggttcgggttggacatggcttgcatataaggcgaatagacttgacgttgcaaatgccgttaatcctctcccaaaggaggaagacaagaaacttgttatagtgaagacgcccaatgcagtaaatccgctcgtatgggattattctccacttctcaccattgatacctgggagcacgcttactatctggattttgagaaccgaagagctgaatacataaatacattcatggaaaagcttgtgtcatgggaaactgtaagcacaaggttggaatccgcaattgctcgagcagtgcaaagagaacaagaaggaacagagacagaagatgaagagaatccagatgatgaagtaccagaggtctatttagatagtgacatcgatgtatctgaggttgactaaaacttgtgaagcaataacattagcatcttaaatgttaattacacagagcaaatttttttgc

SEQ ID NO: 2987 - protein, 305 aa, Arabidopsis thaliana
  misc_feature (1)..(305): useful for making plants with increased phosphate use efficiency as described in USSN 12/541,607
  misc_feature (1)..(305): peptide_clone126592_expected_L44
MMNVAVTATPSSLLYSPLLLPSQGPNRRMQWKRNGKRRLGTKVAVSGVITAGFELKPPPYPLDALEPHMSRETLDYHWGKHHKTYVENLNKQILGTDLDALSLEEVVLLSYNKGNMLPAFNNAAQAWNHEFFWESIQPGGGGKPTGELLRLIERDFGSFEEFLERFKSAAASNFGSGWTWLAYKANRLDVANAVNPLPKEEDKKLVIVKTPNAVNPLVWDYSPLLTIDTWEHAYYLDFENRRAEYINTFMEKLVSWETVSTRLESAIARAVQREQEGTETEDEENPDDEVPEVYLDSDIDVSEVD

SEQ ID NO: 2988 - DNA, 1016 bp, Arabidopsis thaliana
  misc_feature (1)..(1016): useful for making plants with increased phosphate use efficiency as described in USSN 12/541,607
  misc_feature (1)..(1016): clone126592_inplanta_experimental_L44
gttgaatcaaaaataatcagtaacgctttgagtgaagatgatgaatgttgcagtgacagccactccctcgtctctcttgtactctcctctgcttcttccttctcaagggccaaaccggcgaatgcaatggaaaagaaacggaaagagacggttagggacaaaggtggctgtttccggtgttatcacagctggatttgagctgaagccacctccatatcctcttgatgctctggaaccgcatatgagccgggaaaccttggattatcactggggcaaacatcacaaaacttatgtagagaacctgaacaagcaaatcttaggcacggatctagatgcattatccttggaagaagttgtgcttctttcatacaacaaaggcaatatgcttcctgctttcaacaacgctgcacaggcttggaaccacgagttcttctgggagtctatccaacctggaggtggaggaaagccaactggagagctcctcagattaatagaaagagattttgggtctttcgaagagtttttggaaaggttcaagtcggctgcagcttcgaattttggttcgggttggacatggcttgcatataaggcgaatagacttgacgttgcaaatgccgttaatcctctcccaaaggaggaagacaagaaacttgttatagtgaagacgcccaatgcagtaaatccgctcgtatgggattattctccacttctcaccattgatacctgggagcacgcttactatctggattttgagaaccgaagagctgaatacataaatacattcatggaaaagcttgtgtcatgggaaactgtaagcacaaggttggaatccgcaattgctcgagcagtgcaaagagaacaagaaagaacagagacagaagatgaagagaatccagatgatgaagtaccagaggtctatttagatagtgacatcgatgtatctgaggttgactaaaacttgtgaagcaataacattagcatcttaaatgttaattacacagagcaaatttttttgc

SEQ ID NO: 2989 - protein, 305 aa, Arabidopsis thaliana
  misc_feature (1)..(305): useful for making plants with increased phosphate use efficiency as described in USSN 12/541,607
  misc_feature (1)..(305): peptide_clone126592_inplanta_experimental_L44
MMNVAVTATPSSLLYSPLLLPSQGPNRRMQWKRNGKRRLGTKVAVSGVITAGFELKPPPYPLDALEPHMSRETLDYHWGKHHKTYVENLNKQILGTDLDALSLEEVVLLSYNKGNMLPAFNNAAQAWNHEFFWESIQPGGGGKPTGELLRLIERDFGSFEEFLERFKSAAASNFGSGWTWLAYKANRLDVANAVNPLPKEEDKKLVIVKTPNAVNPLVWDYSPLLTIDTWEHAYYLDFENRRAEYINTFMEKLVSWETVSTRLESAIARAVQREQERTETEDEENPDDEVPEVYLDSDIDVSEVD

SEQ ID NO: 2990 - protein, 158 aa, Brassica napus
  misc_feature (1)..(158): useful for making plants with increased phosphate use efficiency as described in USSN 12/541,607
  misc_feature (1)..(158): CeresClone:970125
MMMTTTSSLLSPCSLLPSQGPNRQTQWKRHEKRQFSRKVVVSGVVRAGFELKPPPYPLDALEPHMSRETMDYHWGKHHRTYVENLNKQILGTDLDGLSLEEVVLLSYNRGNMLPVFNNAAQAWNHEFFWESIQPGGGGKPSGDLLRLIERDFGSFDDF

SEQ ID NO: 2991 - protein, 313 aa, Glycine max
  misc_feature (1)..(313): useful for making plants with increased phosphate use efficiency as described in USSN 12/541,607
  misc_feature (1)..(313): CeresClone:624535
MNLLSQSTAPSTSLSPSCFLPRHPHGSTWFSSGTFKFLKKESRCLRKAGRTKITAKFELKPPPYPLSALEPIMSQETLEYHWGKHHRTYVDNLNRQIDGTDLDGNSLENTIVITYNKGDILPAFNNAAQAWNHDFFWESMKPGGGGRPSGDLLNLIERDFGSFEKFLDEFKTAASTQFGSGWAWLAYKESRLDVENAVNPLQSDEDKKLVVVKTPNAVNPLVWNYYHPLLTIDVWEHAYFIDFQNQRRDYISVFMDKLVSWDAVSSRLEQAKALIKEREREAERKRREEEEKRTSSEAIPEIYSDGDADLDAE

SEQ ID NO: 2992 - protein, 313 aa, Medicago sativa
  misc_feature (1)..(313): useful for making plants with increased phosphate use efficiency as described in USSN 12/541,607
  misc_feature (1)..(313): gi|16974682
MKLLSPSATSSTHVSSSAFLPNVAGFQNLGSSSVTTFKFSKKQGRCIRRAGGTQITAKFELKPPPYPLNASEPIMSQNTFEYHWGKHHRAYVDNLNKQIEGTDLDGKSLEETIIMSYNNGDILPAFNNAAQVWNHDFFWESMKPGGGGKPSGELLKLIERDFGSFEKFVEQFKLAASTQFGSGWAWLAYKESRLDVGNAVNPLATEEDKKLVVLKSPNAVNPLVWNHHHPLLTIDVWEHAYYLDYQNRRPEYISVFMDKLVSWEAVSSRLEKAKAVIAEREKEEERKRREEEEKSTTGEDTPAPEIFADSDTD

SEQ ID NO: 2993 - protein, 220 aa, Zea mays
  misc_feature (1)..(220): useful for making plants with increased phosphate use efficiency as described in USSN 12/541,607
  misc_feature (1)..(220): CeresClone:278210
MSLGQMMLASFNEGREQPHPPFFHAAQVWNHDFYWRSMKPGGGGKPPERLLKFINRDFGSYEGMIRQFMDAALTQFGSGWVWLSYKGSGLPYVKSRSPIPSDNHGRLVISKTPNAINPLVWGHSPLLAIDVWEHAYYLDYEDRRADYVSAILEKLVSWETVESRLAKAVARAVERDEHLRRRILRKQRLAQANGQSRARSRARQGRQGDQEVARSRPVEA

SEQ ID NO: 2994 - DNA, 870 bp, Arabidopsis thaliana
  misc_feature (1)..(870): useful for making plants with increased phosphate use efficiency as described in USSN 12/541,607
  misc_feature (1)..(870): Ceres cDNA 12333678
aaaaagtacgaaaggaaaatatgagtgaggagaagaggaagcaacacttcgtgctagtacatggtgcgtgccacggcgcatggtgctggtacaaggttaagcctcttctcgaggctttgggccatcgtgtaaccgccttagacctagctgcttccggtatagacacaaccaggtcaatcactgacatttctacatgtgaacaatattctgagccattgatgcagctaatgacttcattgccgaatgatgagaaggttgtactcgttggtcatagctttggaggtttgagtttagccttagccatggataagtttcccgataaaatctctgtctctgtcttcgtgactgcattcatgcccgacaccaaacactcaccatcgttcgtcgaggaaaagtttgcaagcagcatgacaccagaaggatggatgggctctgagctcgagacatatggttcagataattccggcttgtctgtgttcttcagcaccgacttcatgaagcaccgtctctaccaactttctcctgtggaggatcttgagcttggattgcttctaaagaggcctagttcattgtttattaatgaattatcgaagatggagaacttttctgagaaagggtatggatctgttcctcgagcttacattgtgtgcaaagaggacaacattatctcggaagaccatcaacgatggatgatccataattatccggcgaatttagtgattgagatggaagagacggatcatatgccaatgttttgcaaacctcaagtactaagtgaccatctattggcaatcgctgacaatttctcttaaataatattttgatgaaaatgtatttggagtggatacaataaaaatgtgttctaaatgg

SEQ ID NO: 2995 - protein, 263 aa, Arabidopsis thaliana
  misc_feature (1)..(263): useful for making plants with increased phosphate use efficiency as described in USSN 12/541,607
  misc_feature (1)..(263): Peptide Ceres cDNA 12333678
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQVLSDHLLAIADNFS

SEQ ID NO: 2996 - protein, 267 aa, Citrus sinensis
  misc_feature (1)..(267): useful for making plants with increased phosphate use efficiency as described in USSN 12/541,607
  misc_feature (1)..(267): gi|14279437
MEEVVGMEEKHFVLVHGVNHGAWCWYKLKARLVAGGHRVTAVDLAASGINMKRIEDVHTFHAYSEPLMEVLASLPAEEKVILVGHSLGGVTLALAGDKFPHKISVAVFVTAFMPDTTHRPSFVLEQYSEKMGKEDDSWLDTQFSQCDASNPSHISMLFGREFLTIKIYQLCPPEDLELAKMLVRPGSMFIDNLSKESKFSDEGYGSVKRVYLVCEEDIGLPKQFQHWMIQNYPVNEVMEIKGGDHMAMLSDPQKLCDCLSQISLKYA

SEQ ID NO: 2997 - protein, 263 aa, Arabidopsis thaliana
  misc_feature (1)..(263): useful for making plants with increased phosphate use efficiency as described in USSN 12/541,607
  misc_feature (1)..(263): CeresClone:1010900
MSEEKRKQHFVLVHGSCHGAWCWYKVKPLLEAVGHRVTAVDLAASGIDTTRSITDIPTCEQYSEPLTKLLTSLPNDEKVVLVGHSFGGLNLAIAMEKFPEKISVAVFLTAFMPDTEHSPSFVLDKFGSNMPQEAWMGTEFEPYGSDNSGLSMFFSPDFMKLGLYQLSPVEDLELGLLLMRPGSLFINDLSKMKNFSDEGYGSVPRVFIVCKEDKAIPEERQRWMIDNFPVNLVMEMEETDHMPMFCKPQQLSDYFLKIADKFV

SEQ ID NO: 2998 - protein, 263 aa, Arabidopsis thaliana; identical to SEQ ID NO: 2997
  misc_feature (1)..(263): useful for making plants with increased phosphate use efficiency as described in USSN 12/541,607
  misc_feature (1)..(263): gi|20196998

SEQ ID NO: 2999 - protein, 263 aa, Arabidopsis thaliana
  misc_feature (1)..(263): useful for making plants with increased phosphate use efficiency as described in USSN 12/541,607
  misc_feature (1)..(263): gi|27754457
MSEEKRKQHFVLVHGSCHGAWCWYKVKPLLEAVGHRVTAVDLAASGIDTTRSITDIPTCEQYSEPLTKLLTSLPNDEKVVLVGHSFGGLNLAIAMEKFPKKISVAVFLTAFMPDTEHSPSFVLDKFGSNMPQEAWMGTEFEPYGSDNSGLSMFFSPDFMKLGLYQLSPVEDLELGLLLMRPGSLFINDLSKMKNFSDEGYGSVPRVFIVCKEDKAIPEERQRWMIDNFPVNLVMEMEETDHMPMFCKPQQLSDYFLKIADKFV

SEQ ID NO: 3000 - protein, 257 aa, Hevea brasiliensis
  misc_feature (1)..(257): useful for making plants with increased phosphate use efficiency as described in USSN 12/541,607
  misc_feature (1)..(257): gi|50513520
MAFAHFVLIHTICHGAWIWHKLKPLLEALGHKVTALDLAASGVDPRQIEEIGSFDEYSEPLLTFLEALPPGEKVILVGESCGGLNIAIAADKYCEKIAAAVFHNSVLPDTEHCPSYVVDKLMEVFPDWKDTTYFTYTKDGKEITGLKLGFTLLRENLYTLCGPEEYELAKMLTRKGSLFQNILAKRPFFTKEGYGSIKKIYVWTDQDEIFLPEFQLWQIENYKPDKVYKVEGGDHLLQLTKTKEIAEILQEVADTYN

SEQ ID NO: 3001 - protein, 257 aa, Hevea brasiliensis
  misc_feature (1)..(257): useful for making plants with increased phosphate use efficiency as described in USSN 12/541,607
  misc_feature (1)..(257): gi|6435646
MAFAHFVLIHTICHGAWIWHKLKPLLEALGHKVTALDLAASGVDPRQIEEIGSFDEYSEPLLTFLEALPPGEKVILVGESCGGLNIAIAADKYCEKIAAAVFHNSVLPDTEHCPSYVVDKLMEVFPDWKDTTYFTYTKDGKEITGLKLGFTLLRENLYTLCGPEEYELAKMLTRKGSLFQNILAKRPFFTKEGYGSIKKIYVWTDQDEIFLPEFQLWQIENYKPDKVYKVEGGDHKLQLTKTKEIAEILQEVADTYN

SEQ ID NO: 3002 - protein, 258 aa, Manihot esculenta
  misc_feature (1)..(258): useful for making plants with increased phosphate use efficiency as described in USSN 12/541,607
  misc_feature (1)..(258): gi|2780225
MAVVDFVLIHTICHGAWIWYKLKPVLEAAGHKVTALDLAASGVDPRQIEQINSFDEYSEPLLTFMESLPQGEKVILVGESCGGLNIAIAADKYPEKIAAAVFQNSLLPDTKHKPSYVVDKLMEVFPDWKDTEYFEFSNSNGETITGMVLGLKLMRENLYTICPPEDYELAKMLTRRGSLFQSILAQREKFTEKGYGSIKKIYVWTGDDKIFLPEFQLWQIENYKPDLVFRVMGGDHKLQLTKTNEIAGILQKVADIYA

SEQ ID NO: 3003 - protein, 258 aa, Catharanthus roseus
  misc_feature (1)..(258): useful for making plants with increased phosphate use efficiency as described in USSN 12/541,607
  misc_feature (1)..(258): gi|53830670
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 3004 - protein, 264 aa, Rauvolfia serpentina
  misc_feature (1)..(264): useful for making plants with increased phosphate use efficiency as described in USSN 12/541,607
  misc_feature (1)..(264): gi|6651393
MHSAANAKQQKHFVLVHGGCLGAWIWYKLKPLLESAGHKVTAVDLSAAGINPRRLDEIHTFRDYSEPLMEVMASIPPDEKVVLLGHSFGGMSLGLAMETYPEKISVAVFMSAMMPDPNHSLTYPFEKYNEKCPADMMLDSQFSTYGNPENPGMSMILGPQFMALKMFQNCSVEDLELAKMLTRPGSLFFQDLAKAKKFSTERYGSVKRAYIFCNEDKSFPVEFQKWFVESVGADKVKEIKEADHMGMLSQPREVCKCLLDISDS

SEQ ID NO: 3005 - protein, 262 aa, Lycopersicon esculentum
  misc_feature (1)..(262): useful for making plants with increased phosphate use efficiency as described in USSN 12/541,607
  misc_feature (1)..(262): gi|41814856
MEKGDKNHFVLVHGACHGAWCWYKVVTILRSEGHKVSVLDMAASGINPKHVDDLNSMADYNEPLMEFMNSLPQLERVVLVGHSMGGINISLAMEKFPQKIVVAVFVTAFMPGPDLNLVALGQQYNQQVESHMDTEFVYNNGQDKAPTSLVLGPEVLATNFYQLSPPEDLTLATYLVRPVPLFDESILLANTTLSKEKYGSVHRVYVVCDKDNVLKEQQFQKWLINNNPPDEVQIIHNADHMVMFSKPRDLSSCLVMISQKYY

SEQ ID NO: 3006 - protein, 260 aa, Nicotiana tabacum
  misc_feature (1)..(260): useful for making plants with increased phosphate use efficiency as described in USSN 12/541,607
  misc_feature (1)..(260): gi|40549303
MKEGKHFVLVHGACHGGWSWYKLKPLLEAAGHKVTALDLAASGTDLRKIEELRTLYDYTLPLMELMESLSADEKVILVGHSLGGMNLGLAMEKYPQKIYAAVFLAAFMPDSVHNSSFVLEQYNERTPAENWLDTQFLPYGSPEEPLTSMFFGPKFLAHKLYQLCSPEDLALASSLVRPSSLFMEDLSKAKYFTDERFGSVKRVYIVCTEDKGIPEEFQRWQIDNIGVTEAIEIKGADHMAMLCEPQKLCASLLEIAHKYN

SEQ ID NO: 3007 - protein, 262 aa, Solanum tuberosum
  misc_feature (1)..(262): useful for making plants with increased phosphate use efficiency as described in USSN 12/541,607
  misc_feature (1)..(262): gi|56392765
MEKGNKNHFVLVHGACHGAWCWYKVVTILRSEGHKVSVLDMAASGINPKHVEDLNSMADYNEPLMEFMNSLPQQERVVLVGHSMGGINISLAMEKFPHKIAVAVFVSASMPGPDLNLVAVTQQYSQQVETPMDTEFVYNNGLDKGPTSVVLGPKVLATIYYQFSPPEDLTLATYLVRPVPLFDESVLLTNTTLSKEKYGSVHRVYVVCDKDKVLKEEQFQRWLIKNNPPNEVQMIHDAGHMVMFSKPRELCSCLVMISQKYH

SEQ ID NO: 3008 - protein, 266 aa, Triticum aestivum
  misc_feature (1)..(266): useful for making plants with increased phosphate use efficiency as described in USSN 12/541,607
  misc_feature (1)..(266): CeresClone:644331
MEACAGQASSAHIVLVHGACLGGWSWFKVATRLRSAGHRVSTPDLAASGVDPRPLREVPTFRDYTKPLLDLLESLPSGEKVVLVGHSLGGVNVALACELFPEKIAAAVFVAAFMPDHRSPPSYVLEKFVEGRTLDWMDTEFKPQDPEGKLPTSMLFGPLVTRAKFFQLCSPEDLTLGRSLMRVNSMFVDDLRLQPPHTEARYGSVRKAYVVFKDDHAIVEQFQRWMVHNYPVDEVMEIDGADHMALLSTPTELARCLADIAVKYAA

SEQ ID NO: 3009 - protein, 265 aa, Triticum aestivum
  misc_feature (1)..(265): useful for making plants with increased phosphate use efficiency as described in USSN 12/541,607
  misc_feature (1)..(265): CeresClone:936068
MEGSSSGKHFILIHGLCHGAWCWYKLVPMLRAAGHRVTALDMAASGAHPARMDEVPSFEDYSWPLLDAVAAAPAGERLVLVGHSLGGLNIALAMERFPRKVAAAVFLAACMPCVGRHMGATTEEIMRRIKPDFFMDMKRMVLNTSQGPRPALVFGPKILAAKLYDRSSGEDQTLATMLVRPGCQFLDDPTMKDEALLTEAKYGSVKKVYVVAMADASNSEEMQRWMVDMSPGTEAEEIAGADHMAMCSKPRELCDVLLRIADKYE

SEQ ID NO: 3010 - protein, 268 aa, Oryza sativa subsp. japonica
  misc_feature (1)..(268): useful for making plants with increased phosphate use efficiency as described in USSN 12/541,607
  misc_feature (1)..(268): gi|34907176
MEISSSSKKHFILVHGLCHGAWCWYRVVAALRAAGHRATALDMAASGAHPARVDEVGTFEEYSRPLLDAVAAAAAPGERLVLVGHSHGGLSVALAMERFPDKVAAAVFVAAAMPCVGKHMGVPTEEFMRRTAPEGLLMDCEMVAINNSQGSGVAINLGPTFLAQKYYQQSPAEDLALAKMLVRPGNQFMDDPVMKDESLLTNGNYGSVKKVYVIAKADSSSTEEMQRWMVAMSPGTDVEEIAGADHAVMNSKPRELCDILIKIANKYE

SEQ ID NO: 3011 - protein, 262 aa, Oryza sativa (japonica cultivar-group)
  misc_feature (1)..(262): useful for making plants with increased phosphate use efficiency as described in USSN 12/541,607
  misc_feature (1)..(262): gi|57899620
MEGSSSSSKHFILVHGLCHGAWCWYKVVTMLRSEGHRVTALDLAASGVHPARVDEVHSFEEYSQPLLDAVAEAPAGERLILVGHSFGGLSIALAMERFPEKIAVAVFVAAAVPCVGKRIIPELIREKAPKDMLLDSKMIPINNKQGPGTAILLGPNFLAEKGYPLSPAEDLTLAKLLVRPTSQFVDDPTMKDDRLLTSANYGSVKRVCLMAMEDDLKEVHRYMITLSPGVEVEEIAGADHAVMCSRPRELSDLLAKIGSKYD

SEQ ID NO: 3012 - protein, 265 aa, Capsella rubella
  misc_feature (1)..(265): useful for making plants with increased phosphate use efficiency as described in USSN 12/541,607
  misc_feature (1)..(265): gi|15866583
MGGDGGAEQPVIHFVFVHGASHGAWCWYKLTSLLETAGFKTTSVDLTGAGISVTDSNTVLESDQYNRPLFSLLSDLPPSHKVILVGHSIGGGSVTDALCRFTDKISMAIYLAASMVKPGSVPSPHVSDMHADAREENIWEYTYGEGTDKPPTGVIMKQEFLRQYYYSQSPLEDVSLATKLLRPAPMRAFQDLDKSPPNPEVEKVPRVYIKTGKDNLFSSVRQDLLVKNWPPSQFYVLEESDHSAFFSVPTTLFVYLLRAVSFLHK

SEQ ID NO: 3013 - protein, 265 aa, Lycopersicon hirsutum f. glabratum
  misc_feature (1)..(265): useful for making plants with increased phosphate use efficiency as described in USSN 12/541,607
  misc_feature (1)..(265): gi|56393011
  misc_feature (46)..(46): Xaa is any aa, unknown or other
MEKSMSPFVKKHFVLVHTAFHGAWCWYKIVALMRSSGHNVTALDLXASGINPKQALQIPNFSDYLSPLMEFMASLPANEKIILVGHALGGLAISKAMETFPEKISVAVFLSGLMPGPNIDATTVCTKAGSAVLGQLDNCVTYENGPTNPPTTLIAGPKFLATNVYHLSPIEDLALATALVRPLYLYLAEDISKEVVLSSKRYGSVKRVFIVATENDALKKEFLKLMIEKNPPDEVKEIEGSDHVTMMSKPQQLFTTLLSIANKYK

SEQ ID NO: 3014 - DNA, 577 bp, Arabidopsis thaliana
  misc_feature (1)..(577): useful for making plants with increased drought tolerance as described in USSN 13/184,361
  misc_feature (1)..(577): clone11830_inplanta_experimental_L18
aaacttcctaactagatagatcagatctggatctctctgcaccactcattgccttctctagaaacatgtcaactttcttgataaggatacttcttcctttgcttatcatagcaatgactcttcctcgacgttcagaggcagagtcggaacaatggtgcatagcggatgaacaaacgccagacgatgagttgcaagcagccttagactgggcttgcggaaaaggtggagcagactgcagcaaaatgcagcaggaaaaccagccttgcttcttgcctaacacaatcagagatcatgcctcctttgctttcaacagttactaccaaacttataaaaacaaaggtggttcttgttacttcaaaggagctgccatgatcactgagcttgaccccagccatggttcttgccagtatgagtataacccctgattcaaacgacacagcaaagacaagatacagcaagatgaaaagctatgattttgcatttatacgttttctctatgtaatgttttcattccaaagcagtatccatgtactgttctcccattacactccagtctgagataaaaatttcttcaacg

SEQ ID NO: 3015 - protein, 119 aa, Arabidopsis thaliana
  misc_feature (1)..(119): useful for making plants with increased drought tolerance as described in USSN 13/184,361
  misc_feature (1)..(119): peptide_clone11830_inplanta_experimental_L18
MSTFLIRILLPLLIIAMTLPRRSEAESEQWCIADEQTPDDELQAALDWACGKGGADCSKMQQENQPCFLPNTIRDHASFAFNSYYQTYKNKGGSCYFKGAAMITELDPSHGSCQYEYNP

SEQ ID NO: 3016 - protein, 118 aa, Glycine max
  misc_feature (1)..(118): useful for making plants with increased drought tolerance as described in USSN 13/184,361
  misc_feature (1)..(118): CeresClone:1058242
MATFMLKLVLPLLFLFMIPPKTAYAEFEQWCVADEQTTESELQAALDWACGKGGADCSKIQVNQPCYLPNTLKDHASYAFNSYYQKFKHSGGSCYFRGAAITTEVDPSHGSCHYDFIP

SEQ ID NO: 3017 - protein, 123 aa, Olea europaea
  misc_feature (1)..(123): useful for making plants with increased drought tolerance as described in USSN 13/184,361
  misc_feature (1)..(123): gi|29465664
MRGTAGVPDQPVPTPTPSVPTSSSPVPKPPTQGNKKWCVPKAEATDAQLQSNIDYVCSQSGMDCGPIQANGACFNPNTVRAHASYAMNSWYQSKGRNDFDCDFSGTGAITSSDPSNGSCSFLS

SEQ ID NO: 3018 - protein, 123 aa, Parthenium argentatum
  misc_feature (1)..(123): useful for making plants with increased drought tolerance as described in USSN 13/184,361
  misc_feature (1)..(123): CeresClone:1602924
MTTVTTPHFITVLFFFLLISGGIFGHAKAQAPGQGTWCVAKPATSDEDLQNNINYACTYVDCRIIRPGSVCFEPQKLVNRASVAMNLYYQTNGRNYWNCDFKGSGIIAVTDPSYGDCKYSYKQ

SEQ ID NO: 3019 - DNA, 703 bp, Arabidopsis thaliana
  misc_feature (1)..(703): useful for making plants with increased drought tolerance as described in USSN 13/184,361
  misc_feature (1)..(703): clone35743_inplanta_experimental_L19
caataaccacaaacaacaatacacttctcttgacgcctatctctttctcaccaccaccattaccttcgtcacttctctcttccaagcaatttaaaccttcaactaatccagaaatgcaaatgctaagaaacttaagcacgaggacgaggagtcgtcgcggcggatatgagcgtgtaagcgatgattccaccttcagcctacttggagcaaagctaaggaggtcaacgagcgttccatactatgctccatcgataaggcttggtggagattttcctgtgattttggaaaagcttccacgccaaaaaccaactaaaacagtggtgacaagcaaattaagccatccaatcttcagtttatttgatggttatcgccgccgtagcaagaagaaagcgacggccaaaccggagttctctagataccatgaataccttaaagaaagtggaatgtgggatttgagatctaatagtccggtcatctactttaagtagatatatatataacactatatatgttatgatttgtgttcatttattatattatttgtgacaattcttagtgatatgattgatcgatctataagagctatcttcagtttttatttttctcccccttgtaaatatttttttaattgatctataaatttaaacacaacgttttttggtcaacagtcttgtgttattctattgtaaacacaacgtttacc

SEQ ID NO: 3020 - protein, 124 aa, Arabidopsis thaliana
  misc_feature (1)..(124): useful for making plants with increased drought tolerance as described in USSN 13/184,361
  misc_feature (1)..(124): peptide_clone35743_inplanta_experimental_L19
MQMLRNLSTRTRSRRGGYERVSDDSTFSLLGAKLRRSTSVPYYAPSIRLGGDFPVILEKLPRQKPTKTVVTSKLSHPIFSLFDGYRRRSKKKATAKPEFSRYHEYLKESGMWDLRSNSPVIYFK

SEQ ID NO: 3021 - protein, 124 aa, Arabidopsis thaliana
  misc_feature (1)..(124): useful for making plants with increased drought tolerance as described in USSN 13/184,361
  misc_feature (1)..(124): gi|38603980
MQMLRNLSTRTRSRRGGYERVSDDSTFSLLGAKLRRSTSVPYYAPSIRLGGDFPVILEKLPRQKPTKTVVTSKLSHPIFSLFDGYRRHNKKKATAKPEFSRYHEYLKESGMWDLRSNSPVIYFK

SEQ ID NO: 3022 - protein, 118 aa, Brassica napus
  misc_feature (1)..(118): useful for making plants with increased drought tolerance as described in USSN 13/184,361
  misc_feature (1)..(118): CeresClone:963524
MQMLRSFSTRTRSRRGGYERVIDDSTFSLLGAKLRRSTSVPYYAPSIKLGAGGVPTILEELPRQKSKKVKPTSKFSHPIFSFLYGKKKKSTTRKPEFSRYLEYLKEGGMWDARTNTPV

SEQ ID NO: 3023 - DNA, 870 bp, Arabidopsis thaliana; identical to SEQ ID NO: 2994
  misc_feature (1)..(870): useful for making plants with increased drought tolerance as described in USSN 13/184,361
  misc_feature (1)..(870): clone26006_inplanta_experimental_L20

SEQ ID NO: 3024 - protein, 263 aa, Arabidopsis thaliana; identical to SEQ ID NO: 2995
  misc_feature (1)..(263): useful for making plants with increased drought tolerance as described in USSN 13/184,361
  misc_feature (1)..(263): peptide_clone26006_inplanta_experimental_L20

SEQ ID NO: 3025 - protein, 267 aa, Citrus sinensis; identical to SEQ ID NO: 2996
  misc_feature (1)..(267): useful for making plants with increased drought tolerance as described in USSN 13/184,361
  misc_feature (1)..(267): gi|14279437

SEQ ID NO: 3026 - protein, 263 aa, Arabidopsis thaliana; identical to SEQ ID NO: 2997
  misc_feature (1)..(263): useful for making plants with increased drought tolerance as described in USSN 13/184,361
  misc_feature (1)..(263): CeresClone:1010900

SEQ ID NO: 3027 - protein, 263 aa, Arabidopsis thaliana; identical to SEQ ID NO: 2997
  misc_feature (1)..(263): useful for making plants with increased drought tolerance as described in USSN 13/184,361
  misc_feature (1)..(263): gi|20196998

SEQ ID NO: 3028 - protein, 263 aa, Arabidopsis thaliana; identical to SEQ ID NO: 2999
  misc_feature (1)..(263): useful for making plants with increased drought tolerance as described in USSN 13/184,361
  misc_feature (1)..(263): gi|27754457

SEQ ID NO: 3029 - protein, 257 aa, Hevea brasiliensis; identical to SEQ ID NO: 3000
  misc_feature (1)..(257): useful for making plants with increased drought tolerance as described in USSN 13/184,361
  misc_feature (1)..(257): gi|50513520

SEQ ID NO: 3030 - protein, 257 aa, Hevea brasiliensis; identical to SEQ ID NO: 3001
  misc_feature (1)..(257): useful for making plants with increased drought tolerance as described in USSN 13/184,361
  misc_feature (1)..(257): gi|6435646

SEQ ID NO: 3031 - protein, 258 aa, Manihot esculenta; identical to SEQ ID NO: 3002
  misc_feature (1)..(258): useful for making plants with increased drought tolerance as described in USSN 13/184,361
  misc_feature (1)..(258): gi|2780225

SEQ ID NO: 3032 - protein, 258 aa, Catharanthus roseus; identical to SEQ ID NO: 3003
  misc_feature (1)..(258): useful for making plants with increased drought tolerance as described in USSN 13/184,361
  misc_feature (1)..(258): gi|53830670

SEQ ID NO: 3033 - protein, 264 aa, Rauvolfia serpentina; identical to SEQ ID NO: 3004
  misc_feature (1)..(264): useful for making plants with increased drought tolerance as described in USSN 13/184,361
  misc_feature (1)..(264): gi|6651393

SEQ ID NO: 3034 - protein, 262 aa, Lycopersicon esculentum; identical to SEQ ID NO: 3005
  misc_feature (1)..(262): useful for making plants with increased drought tolerance as described in USSN 13/184,361
  misc_feature (1)..(262): gi|41814856

SEQ ID NO: 3035 - protein, 260 aa, Nicotiana tabacum; identical to SEQ ID NO: 3006
  misc_feature (1)..(260): useful for making plants with increased drought tolerance as described in USSN 13/184,361
  misc_feature (1)..(260): gi|40549303

SEQ ID NO: 3036 - protein, 262 aa, Solanum tuberosum; identical to SEQ ID NO: 3007
  misc_feature (1)..(262): useful for making plants with increased drought tolerance as described in USSN 13/184,361
  misc_feature (1)..(262): gi|56392765

SEQ ID NO: 3037 - protein, 266 aa, Triticum aestivum; identical to SEQ ID NO: 3008
  misc_feature (1)..(266): useful for making plants with increased drought tolerance as described in USSN 13/184,361
  misc_feature (1)..(266): CeresClone:644331

SEQ ID NO: 3038 - protein, 265 aa, Triticum aestivum; identical to SEQ ID NO: 3009
  misc_feature (1)..(265): useful for making plants with increased drought tolerance as described in USSN 13/184,361
  misc_feature (1)..(265): CeresClone:936068

SEQ ID NO: 3039 - protein, 268 aa, Oryza sativa subsp. japonica; identical to SEQ ID NO: 3010
  misc_feature (1)..(268): useful for making plants with increased drought tolerance as described in USSN 13/184,361
  misc_feature (1)..(268): gi|34907176

SEQ ID NO: 3040 - protein, 262 aa, Oryza sativa (japonica cultivar-group); identical to SEQ ID NO: 3011
  misc_feature (1)..(262): useful for making plants with increased drought tolerance as described in USSN 13/184,361
  misc_feature (1)..(262): gi|57899620

SEQ ID NO: 3041 - protein, 265 aa, Capsella rubella; identical to SEQ ID NO: 3012
  misc_feature (1)..(265): useful for making plants with increased drought tolerance as described in USSN 13/184,361
  misc_feature (1)..(265): gi|15866583

SEQ ID NO: 3042 - protein, 265 aa, Lycopersicon hirsutum f. glabratum; identical to SEQ ID NO: 3013
  misc_feature (1)..(265): useful for making plants with increased drought tolerance as described in USSN 13/184,361
  misc_feature (1)..(265): gi|56393011
  misc_feature (46)..(46): Xaa is any aa, unknown or other

SEQ ID NO: 3043 - DNA, 412 bp, Arabidopsis thaliana
  misc_feature (1)..(412): useful for making plants with increased drought tolerance as described in USSN 13/184,361
  misc_feature (1)..(412): clone34419_inplanta_experimental_L21
aacaacgccacaatcatggctttgttcttatctcctaaaaccatcactcttctcttcttctccctctccctcgcactctactgcagcatcgatcctttccacactgcgccatttccgatttccccaatttcgtctctcacgaagttatctctccacgtcccgacgaagttccatgggagagagattcacaaaattcacttcagaaatcaaagattctgttttttaaccaaatccaaggtccagagagcgtcgcctttgattctctcggacgtggtccgtacacggcgttgctgatggtagggttttgttttgggatggagagaaatggattgatttcgcttatacttcgagtaatcgatcggagatttgtgatccgaagtataagcgaaatcaatccatttctctccatccc

SEQ ID NO: 3044 - protein, 92 aa, Arabidopsis thaliana
  misc_feature (1)..(92): useful for making plants with increased drought tolerance as described in USSN 13/184,361
  misc_feature (1)..(92): peptide_clone34419_inplanta_experimental_L21
MALFLSPKTITLLFFSLSLALYCSIDPFHTAPFPISPISSLTKLSLHVPTKFHGREIHKIHFRNQRFCFLTKSKVQRASPLILSDVVRTRRC

SEQ ID NO: 3045 - DNA, 1776 bp, Arabidopsis thaliana
  misc_feature (1)..(1776): useful for making plants with increased drought tolerance as described in USSN 13/184,361
  misc_feature (1)..(1776): cDNA12659859_inplanta_experimental_L22
gagcagaagaacttacttatagaaaaaaatgggaatttcaaaaccactccttctattttcgattttagtcctctatttttcactctacaccattacaccaacttcttcattagcctccctccaagatcaattcatcaactgtgtccaaagaaacacacatgtttacttcccacttgagaaaacgttctttgctcctacaaaaaatgtctctatgttcagccaagttcttgaatcgacggctcaaaatctccggttcttgaaaaaatccatgcctaaaccgggattcatattcagccctattcacgagtctcacgtacaagcttccatcatttgttccaagaaactccgaatgcatctccgtgtcagaagcggcggtcacgactacgaaggcttgtcttatgtctctcagatcgataaaccgtttatattgatggatctgtcaaagatgagacaggtcaacattaatattcaagacaacagtgcttgggttcaatctggtgccactgttggtgaactttattacaggattgcggagaagagcaaagtccatgggttcccggcgggtttgtgctcgagcttaggcataggaggacacataacaggcggtgcgtacggttccatgatgcggaaatatggtctaggtgcagacaatgttctagacgcaaagattgttgatgccaacggtaaattactcgatagagccgcgatgggtgaggatacattttgggctattagaggaggcgctggagggagttttgggataattctagcatggaagatcaagcttgttcctgttcctaagaccgtgaccgtctttaccgtcaccaaaacgttacaacaagacgtgggtaacaagattatctcaaagtggcaaagagttgcggacaagcttgttgaagagctattcatcagagtgctcttcaacgtagctggaaccggtgggaacaagactgtgacgacgtcgtacaatgctctgtttcttggcgggaaaggaacgctgatgaacgttatgaagaagagtttccccgagctagggctaacatttaaagattgtatcgaaatgagctggcttgaatccattgcttacatttctggattcccgacccacacgcctactaatgttttgcttcaagggaagtctccgttcccaaaggtcagcttcaaagccaaatcggatttcgtgaaaaccccgattcccgaatccgggcttcaagggatcttcaagaagctacttaaagaagatattccattgatgatatggaatccttacggaggaatgatggcgaaaatccccgaatcccaaatcccttttccgcatcgaaaaggagtcctcttcaaggttcagtacgtaacaagttggctagacagtgacaagagaccgagcagacacatcaactggatcagagatctctatagttacatgacgccttatgtctcaagtaacccacgagaagcttacgtgaactaccgtgatttagacctgggaaggaacacgaaagacgtgaaaacatgcatcaaacaagctcaagtctggggagctaactacttcaaaaacaatttcaacagattgatgatgattaaagcaaaggttgatccagagaacttctttagacacgagcagagcattccacctatgatgtaacgaggtcaatcaaataagaataaattagaagaaaatcagataatggttcttctgtatttcggaaaaatgttattctagctatgcttgtagtagtactatgtttcacctaaaattcgatatgttgcttcttagta

SEQ ID NO: 3046 - protein, 537 aa, Arabidopsis thaliana
  misc_feature (1)..(537): useful for making plants with increased drought tolerance as described in USSN 13/184,361
  misc_feature (1)..(537): peptide_cDNA12659859_inplanta_experimental_L22
MGISKPLLLFSILVLYFSLYTITPTSSLASLQDQFINCVQRNTHVYFPLEKTFFAPTKNVSMFSQVLESTAQNLRFLKKSMPKPGFIFSPIHESHVQASIICSKKLRMHLRVRSGGHDYEGLSYVSQIDKPFILMDLSKMRQVNINIQDNSAWVQSGATVGELYYRIAEKSKVHGFPAGLCSSLGIGGHITGGAYGSMMRKYGLGADNVLDAKIVDANGKLLDRAAMGEDTFWAIRGGAGGSFGIILAWKIKLVPVPKTVTVFTVTKTLQQDVGNKIISKWQRVADKLVEELFIRVLFNVAGTGGNKTVTTSYNALFLGGKGTLMNVMKKSFPELGLTFKDCIEMSWLESIAYISGFPTHTPTNVLLQGKSPFPKVSFKAKSDFVKTPIPESGLQGIFKKLLKEDIPLMIWNPYGGMMAKIPESQIPFPHRKGVLFKVQYVTSWLDSDKRPSRHINWIRDLYSYMTPYVSSNPREAYVNYRDLDLGRNTKDVKTCIKQAQVWGANYFKNNFNRLMMIKAKVDPENFFRHEQSIPPMM

SEQ ID NO: 3047 - protein, 543 aa, Glycine max
  misc_feature (1)..(543): useful for making plants with increased drought tolerance as described in USSN 13/184,361
  misc_feature (1)..(543): CeresClone:522974
NTRESRNQRTMKSLRSILATFVVLLSISLTISLPIEEAFNHCLTQHSQTPNQFPSSIYTYTNGSFTSILESTAQNLRYLLPSVPKPDFIFTPLDDSQVQAAVVCAKKLGIHMRVRSGGHDYEGLSYVSLIEKPFMILDLAKLRAVNVDIARNTAWIQAGATIGEVYYRISEKSAVHGFPAGLCTTLGIGGHITGGAYGSMMRKYGLGADNVLDARIVDANGKVLDRKAMGEDLFWAIRGGGGGSFGVILWWKIKLVPVPQTVTVFTVTKTLEQGGSKLLHRWQQVAPHIDENLFIRVIIQPGNGTVPGKRTVTTSYNALFLGGANRLLQVMKHGFPELGLTRKDCVETSWIESVLYIAGYPDGTAPEVLLQGKSTTKAYFKAKSDFVREVITEKSLNALWKIFLQDDGPLMIWNPYGGKMSRIAESATPFPHRKGVLYKIQHVTGWLDGEKSMAKHMNWMRKFYFYMAPYVSKYPRETYVNYRDLDIGMNQKNNTSLLKASSWGYRYFKGNFNRLVKVKTKVDPSNFFRHEQSIPLLPTGKKE

SEQ ID NO: 3048 - protein, 538 aa, Glycine max
  misc_feature (1)..(538): useful for making plants with increased drought tolerance as described in USSN 13/184,361
  misc_feature (1)..(538): CeresClone:561310
TETREIIVNMELSYCAVFLILLIPISRADATSVEKQFKECLLTQLDGNSEHIEKITFTSSSTLYPQVWDSLAQNPRWVNISSRKPLMILTPFHESEIQAAILCSKELKLQLRVRSGGHDYEGLSYLSDVPFVMVDLINIRSIEINLADETAWVQAGASIGELYYKISKASKVHGFPAGTCPSVGIGGHISGGGQGLMLRKHGLAADNVVDAYLIDANGKIHDRKSMGEDVFWAIRGGDASSFGVILAWKIKLVRVPPIVTGFNVPRTPEEGVTDLIHRWQYIAHDLHEDLVIRVIAQISGHDKSKKFRATFNSIFLGGVDRLIPLMNESFPELGLQAKDCTEMSWIQSVMFIAGYNIEDPLELLLNRTTMFKRSFKAKSDFFKEPVPKSGLEGAWKLLLEEEIAFLIMEPYGGRMNEISESEIPFPHRKGNLYNLQYLVNWEVNSDEASRRHLQWAKMVYKYMTPYVSKSPRAAYFNYKDLDLGKNKLDSTSYSEASVWGKKYFKGNFRRLAQIKTKFDPLNFFRNEQSIPLLNSHHS

SEQ ID NO: 3049 - protein, 535 aa, Vigna unguiculata; identical to SEQ ID NO: 577
  misc_feature (1)..(535): useful for making plants with increased drought tolerance as described in USSN 13/184,361
  misc_feature (1)..(535): gi|13161397

SEQ ID NO: 3050 - protein, 538 aa, Helianthus annuus; identical to SEQ ID NO: 578
  misc_feature (1)..(538): useful for making plants with increased drought tolerance as described in USSN 13/184,361
  misc_feature (1)..(538): gi|18652400

SEQ ID NO: 3051 - protein, 522 aa, Cynodon dactylon; identical to SEQ ID NO: 585
  misc_feature (1)..(522): useful for making plants with increased drought tolerance as described in USSN 13/184,361
  misc_feature (1)..(522): gi|41393750

SEQ ID NO: 3052 - protein, 540 aa, Lactuca sativa; identical to SEQ ID NO: 579
  misc_feature (1)..(540): useful for making plants with increased drought tolerance as described in USSN 13/184,361
  misc_feature (1)..(540): gi|18652398

SEQ ID NO: 3053 - protein, 545 aa, Cannabis sativa; identical to SEQ ID NO: 565
  misc_feature (1)..(545): useful for making plants with increased drought tolerance as described in USSN 13/184,361
  misc_feature (1)..(545): gi|26005814

SEQ ID NO: 3054 - protein, 535 aa, Oryza sativa subsp. japonica
  misc_feature (1)..(535): useful for making plants with increased drought tolerance as described in USSN 13/184,361
  misc_feature (1)..(535): gi|53792953
MSTTPTAASRRLVLILCTLAISCSSGIAGFAAGDDDAFIRCLAAAAVPPRLVHTPGSASYAPTLVSSIRNLRFVTPGTPRPLAIVAAAEAGHAQAAVRCGRRHGVRVRARSGGHDYEGLSYLSLDRRERFAVLDLAALRDVRVDADRAEAWVGSGATLGELYYAVGAASRTLAFPAGVCPTVGVGGHISGGGFGTLMRRYGLAADNVLDAVLVDADGRLLNRTTMGEGLFWAIRGGGGESFGVVLSWKLRLVRVPETVTVFTIRRPRNQSATDLITKWQEISPSLPRDVILRVVVQSQHAQFESLFLGRCRRLARLMRARFPELGMTQSDCEEITWIQSTVYFAFYSSSKPLELLLDRGTEPDRYFKAKSDYVQEPIPRHAWESTWPWLEEHDAGLLILDPYGGEMARVSPAATPFPHRKGNLYNLQYYSFWFEHGAETLERHLSWVRGLYGEMEPYVSKNPRTGYVNYRDMDLGRNEIEGNVTSYTKGKVWGEKYFRGNFERLAAVKAMVDPDDFFRNEQSIPPLPAAKGWSSI

SEQ ID NO: 3055 - protein, 542 aa, Helianthus annuus
  misc_feature (1)..(542): useful for making plants with increased drought tolerance as described in USSN 13/184,361
  misc_feature (1)..(542): gi|20563190
MNNSRSVFLLVLALSFCVSFGALSSIFDVTSTSEDFITCLQSNSNNVTTISQLVFTPANTSYIPIWQAAADPIRFNKSYIPKPSVIVTPTDETQIQTALLCAKKHGYEFRIRDGGHDFEGNSYTANAPFVMLDLVNMRAIEINVENRTALVQGGALLGELYYTISQKTDTLYFPAGIWAGVGVSGFLSGGGYGNLLRKYGLGADNVLDIRFMDVNGNILDRKSMGEDLFWALRGGGASSFGIVLQWKLNLVPVPERVTLFSVSYTLEQGATDIFHKYQYVLPKFDRDLLIRVQLNTEYIGNTTQKTVRILFHGIYQGNIDTLLPLLNQSFPELNVTREVCQEVRMVQTTLEFGGFNISTPTSVLANRSAIPKLSFKGKSDYVRTPIPRSGLRKLWRKMFENDNSQTLFMYTFGGKMEEYSDTAIPYPHRAGVLYQVFKRVDFVDQPSDKTLISLRRLAWLRSFDKTLEPYVTSNPREAYMNYNDLDLGFDSAAYEEASEWGERYWKRENFKKLIRIKAKVDPENFFRHPQSIPVFSRPLSDM

SEQ ID NO: 3056 - DNA, 1174 bp, Arabidopsis thaliana
  misc_feature (1)..(1174): useful for making plants with increased drought tolerance as described in USSN 13/184,361
  misc_feature (1)..(1174): cDNA12723147_L23
agtggctactgagtaaagctttgggccaccgagagaaaccattttctgagagcacactttcgttgacttctctttaaccaatgtctttaaccacagtccctacgctcgccatcagatccggaccatccggtcatcactcgatgccggttcttggttttggaaccgccgcttctccgctaccggaaccaacgatgctgaaagagacggtgattgaggctattaagcttggttatcgccatttcgacacctctccaaggtaccaaacggaggagccgatcggcgaagctttagcggaggcggtttcactcggcttagttcgatctcgatctgaattctttgtcactaccaaactttggtgtgctgatgctcatggtggtctcgtcgtaccggcgatcaaacggagtttgaaaaaccttaaactggactatcttgatctttatataattcattggccggttagctcgaaacctggtaaatacaagtttcctattgatgaagatgattttatgccaatggatttcgaagtagtgtggtctgaaatggaggagtgtcagagacttgggctcgcaaaatgcataggagtaagcaatttttcatgtaagaagcttcaacacatactctctatcgcgacaatcccgcctagcgtcaatcaagttgagatgagtccaatatggcaacaaagaaagctaagggagctttgtagatcgaacgacattgttgtcacagcgtactcggtgttgggatctagaggagctttttggggaactcccaaaattatggaatctgatgttctcaaagaaatagcagaagcaaaggaaaaaacagtggcccaggtgagtatgagatgggcttatgaacaaggagtgagcatggtagtgaagagctttaccaaagagagattagaagagaatctaaagatatttgattggtctttgacagaggatgagacacagagaatttcaactgagattcctcagttcagaaacgtccacggagaggtttatacctctaagaaaggtcccatcaaatctgtcgccgagatgtgggacggggagatctgatcactttgtgtgaaaatagcctattgaaaacggcacaattatcattcgtcacaatgattttcttgtcattctctctaataatgaaataatgaataatgaataaggactatctc

SEQ ID NO: 3057 - protein, 326 aa, Arabidopsis thaliana
  misc_feature (1)..(326): useful for making plants with increased drought tolerance as described in USSN 13/184,361
  misc_feature (1)..(326): peptide_cDNA12723147_L23
MSLTTVPTLAIRSGPSGHHSMPVLGFGTAASPLPEPTMLKETVIEAIKLGYRHFDTSPRYQTEEPIGEALAEAVSLGLVRSRSEFFVTTKLWCADAHGGLVVPAIKRSLKNLKLDYLDLYIIHWPVSSKPGKYKFPIDEDDFMPMDFEVVWSEMEECQRLGLAKCIGVSNFSCKKLQHILSIATIPPSVNQVEMSPIWQQRKLRELCRSNDIVVTAYSVLGSRGAFWGTPKIMESDVLKEIAEAKEKTVAQVSMRWAYEQGVSMVVKSFTKERLEENLKIFDWSLTEDETQRISTEIPQFRNVHGEVYTSKKGPIKSVAEMWDGEI

SEQ ID NO: 3058 - protein, 321 aa, Papaver somniferum
  misc_feature (1)..(321): useful for making plants with increased drought tolerance as described in USSN 13/184,361
  misc_feature (1)..(321): gi|6478216
MEIGGVPVVTLSSGRGMPILGMGTAENNLQGSERVKLAILKAIEVGYRHFDTAFVYQTEGSLGEAVAEALQNGLIKSRDELFITSKLWCADAYPDHVLPALQNSLRNLKLEYLDLYLIHWPVSLKPGKFVHPIPKDEIFPIDYKSVWAAMEKCQMLGLTKSIGVSNFSCKKLHYLMATANIPPAVNQVEMNPIWQQQKLRDYCKTNNIMVTAYSPLGAKGTMWGSSGVMDSEVLNQISQVRGKSVAQVSLRWVYEQGASLLVKSFNEERMKENLKIFDWELSPEDLKNISELPQRRVSTGDPFVSINGPFKSVEELWDDEV

SEQ ID NO: 3059 - protein, 327 aa, Arabidopsis thaliana
  misc_feature (1)..(327): useful for making plants with increased drought tolerance as described in USSN 13/184,361
  misc_feature (1)..(327): gi|5080825
MVASGHEVVTLTFPIGSVHHLMPVLALGTAASPPPEPIVLKRTVLEAIKLGYRHFDTSPRYQTEEPLGEALAEAVSLGLIQSRSELFVTSKLWCADAHGGLVVPAIQRSLETLKLDYLDLYLIHWPVSSKPGKYKFPIEEDDFLPMDYETVWSEMEECQRLGVAKCIGVSNFSCKKLQHILSIAKIPPSVNQVEMSPVWQQRKLRELCKSKGIVVTAYSVLGSRGAFWGTHKIMESDVLKEIAEAKGKTVAQVSMRWAYEEGVSMVVKSFRKDRLEENLKIFDWSLTEEEKQRISTEISQSRIVDGEVYISEKGPIKSVTEMWDGEI

SEQ ID NO: 3060 - protein, 320 aa, Arabidopsis thaliana
  misc_feature (1)..(320): useful for making plants with increased drought tolerance as described in USSN 13/184,361
  misc_feature (1)..(320): gi|15218958
MSALTFPIGSVHHLMPVLALGTAASPPPEPIVLKRTVLEAIKLGYRHFDTSPRYQTEEPLGEALAEAVSLGLIQSRSELFVTSKLWCADAHGGLVVPAIQRSLETLKLDYLDLYLIHWPVSSKPGKYKFPIEEDDFLPMDYETVWSEMEECQRLGVAKCIGVSNFSCKKLQHILSIAKIPPSVNQVEMSPVWQQRKLRELCKSKGIVVTAYSVLGSRGAFWGTHKIMESDVLKEIAEAKGKTVAQVSMRWAYEEGVSMVVKSFRKDRLEENLKIFDWSLTEEEKQRISTEISQSRIVDGEVYISEKGPIKSVTEMWDGEI

SEQ ID NO: 3061 - protein, 323 aa, Fragaria x ananassa
  misc_feature (1)..(323): useful for making plants with increased drought tolerance as described in USSN 13/184,361
  misc_feature (1)..(323): gi|53988164
MTATQIPEVVLESSNGRRTMPVLGFGTASNNLQPEVLIEAVLEAIKLGYRHFDTASIYGSEQTLGVAIAQALKLGLVASRDELFITSKLWPNDGHPNLVIPALKKSLQNLELEYLDLYLIHWPISAKPGKLSHALEEKDQMPMDFKGVWADMEEAQRLGLTKSIGISNFSTKKTQNLLSFATIPPSVNQVEMSPFWQQKKLRDFCKASGIVVTAFSPLGAIGTSWGTNHVLESKVLNEIAEAHGKTVAQVCIRWVYQVGATLAVKSYNKERLKQNVQVFDWELTEEDLEKINQIPQRKMMPREELVTATGPYKSLDDLWDGEY

SEQ ID NO: 3062 - protein, 319 aa, Fragaria x ananassa
  misc_feature (1)..(319): useful for making plants with increased drought tolerance as described in USSN 13/184,361
  misc_feature (1)..(319): gi|2792295
MAKVPSVTLSSCGDDIQTMPVIGMGTSSYPRADPETAKAAILEAIRAGYRHFDTAAAYGSEKDLGEAIAEALRLQLIKSRDELFITTKLWASFAEKDLVLPSIKASLSNLQVEYIDMYIIHWPFKLGKEVRTMPVERDLVQPLDIKSVWEAMEECKKLGLARGIGVSNFTSSMLEELLSFAEIPPAVNQLEMNPAWQLKKLRDFCKAKGIHVTAYSPLGAARTKWGDDRVLGSDIIEEIAQAKGKSTAQISLRWVYEQGVSIVTKSYNKERMRQNLDIFDFCLTEEELEKMSHLPQRKGVTFASILGPHDIVLEVDEEL

SEQ ID NO: 3063 - protein, 319 aa, Fragaria x ananassa
  misc_feature (1)..(319): useful for making plants with increased drought tolerance as described in USSN 13/184,361
  misc_feature (1)..(319): gi|50380153
MAKVPSVTLSSCGDDIQTMPVIGMGTSSYPRADPETAKAAILEAIRAGYRHFDTAAAYGSEKDLGEAIAEALRLQLIKSRDELFITTKLWASFAEKDLVLPSIKASLSNLQVEYIDMYIIHWPFKLGKEVRTMPVERDLVQPLDIKSVWEAMEECKKLGLARGIGVSNFTSSMLEELLSFAEIPPAVNQLEMNPAWQLKKLRDFCKAKGIHVTAYSPLGAARTKWGDDRVLGSDIIEEIAQAKGKSTAQISLRWVYEQGVSIVTKSYNKERMRQNLDIFDFCLTEEELEKMSHLPQRKGVTFASILGPHDIVLKVDEEL

SEQ ID NO: 3064 - protein, 314 aa, Glycine max
  misc_feature (1)..(314): useful for making plants with increased drought tolerance as described in USSN 13/184,361
  misc_feature (1)..(314): CeresClone:1074583
MGAGDKTAAGMPRIGMGTAVQGPKPDPIRRAVLRAIEVGYRHFDTAAHYETEAPIGEAAAEAVRSGAVASRDDLFITSKLWCSDAHRDRVVPALRQTLRNLQMEYVDLYLVHWPVSMKPGRFKAPFTAEDFVPFDMRAVWEAMEECHRLGLAKAIGVANFSCKKLETLLSFATIPPTVNQVEVNPVWQQRKLREFCRGKGIQLCAYSPLGAKGTHWGSDAVMDAGVLQEIAASRGKSVAQVCLRWVYEQGDCLIVKSFDEARMRENLDVDGWELTEEEHRRIAEIPQRKINLGKRYVSEHGPYKSLEELWDGEI

SEQ ID NO: 3065 - protein, 315 aa, Glycine max
  misc_feature (1)..(315): useful for making plants with increased drought tolerance as described in USSN 13/184,361
  misc_feature (1)..(315): gi|18728
MAAAIEIPTIVFPNSSAQQRMPVVGMGSAPDFTCKKDTKEAIIEAVKQGYRHFDTAAAYGSEQALGEALKEAIHLGLVSRQDLFVTSKLWVTENHPHLVLPALRKSLKTLQLEYLDLYLIHWPLSSQPGKFSFPIEVEDLLPFDVKGVWESMEECQKLGLTKAIGVSNFSVKKLQNLLSVATIRPVVDQVEMNLAWQQKKLREFCKENGIIVTAFSPLRKGASRGPNEVMENDVLKEIAEAHGKSIAQVSLRWLYEQGVTFVPKSYDKERMNQNLHIFDWALTEQDHHKISQISQSRLISGPTKPQLADLWDDQI

SEQ ID NO: 3066 - protein, 320 aa, Glycine max
  misc_feature (1)..(320): useful for making plants with increased drought tolerance as described in USSN 13/184,361
  misc_feature (1)..(320): CeresClone:473625
MEAKKIPEVILNSGKKMPVIGLGTASIPLPSHEALTSILIDAFEVGYRHFDTASLYESEESLGKAVAKALELGLINSREELFITSKLWSTDAHPDLVVPALKTSLQKLGLEYVDLYLIHWPVRLKPEAKGYHNILKENVLPSFDMKGIWEAMEECYRLGLAKSIGVSNFGIKKLSQLLENATIPPAVNQVEMSPTWQQGKLKEFCKQKGIHVSAWSPLGAYKSAQGTNAVMESPILKEIACERQKSMAQIALRWIYEQGAIAIVKSFNKERMKQNLDIFDWELSQEESQKFSQIPQRRMYRGITFVSENGPYKTLEELWD

SEQ ID NO: 3067 - protein, 322 aa, Glycine max
  misc_feature (1)..(322): useful for making plants with increased drought tolerance as described in USSN 13/184,361
  misc_feature (1)..(322): CeresClone:474019
  misc_feature (274)..(274): Xaa is any aa, unknown or other
MAGKKIPDVLLNSGHKMPVIGMGTSVENRPSNETLASIYVEAIEVGYRHFDTAAVYGTEEAIGLAVAKAIDKGLIKSRDEVFITSKPWNTDAHRDLIVPALKTTLKKLGTEYVDLYLIHWPVRLRHDLENPTVFTKEDVLPFDIEGTWKAMEECYKLGIAKSIGICNYGIKKLTKLLEIATIPPAVNQVEMNPSWQQGKLREFCKQKGIHVSAWSALGAYKIFWGSGAVMENPILQDIAKAKGKTIAQVALRWVYQQGSSAMAKSTNSERMKQXLDIFDFVLSEEDLERISQVPQRRQYTGDIWLSENGSCKTLEELWDGDV

SEQ ID NO: 3068 - protein, 312 aa, Medicago sativa
  misc_feature (1)..(312): useful for making plants with increased drought tolerance as described in USSN 13/184,361
  misc_feature (1)..(312): gi|563536
MGSVEIPTKVLTNTSSQLKMPVVGMGSAPDFTCKKDTKDAIIEAIKQGYRHFDTAAAYGSEQALGEALKEAIELGLVTRDELFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNAHGIVLTAFSPLRKGASRGPNEVMENDMLKEIADAHGKSVAQISLRWLYEQGVTFVPKSYDKERMNQNLRIFDWSLTKEDHEKIAQIKQNRLIPGPTKPGLNDLYDD

SEQ ID NO: 3069 - protein, 312 aa, Medicago sativa
  misc_feature (1)..(312): useful for making plants with increased drought tolerance as described in USSN 13/184,361
  misc_feature (1)..(312): gi|537298
MGSVEIPTKVLTNTSSQLKMPVVGMGSAPDFTCKKDTKDAIIEAIKQGYRHFDTAAAYGSEQALGEALKEAIELGLVTREELFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNANGIVLTAFSPLRKGASRGPNEVMENDMLKEIADAHGKSVAQISLRWLYEQGVTFVPKSYDKERMNQNLCIFDWSLTKEDHEKIDQIKQNRLIPGPTKPGLNDLYDD

SEQ ID NO: 3070 - protein, 312 aa, Medicago sativa
  misc_feature (1)..(312): useful for making plants with increased drought tolerance as described in USSN 13/184,361
  misc_feature (1)..(312): gi|563538
MDSVEIPTKVLTNTSSQLKMPVVGMGSAPDFTCKKDTKDAIIEAIKQGYRHFDTAAAYGSEQALGEALKEAIELGLVTREELFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNANGIVLTAFSPLRKGASRGPNEVMENDMLKEIADAHGKSVAQISLRWLYEQGVTFVPKSYDKERMNQNLCIFDWSLTKEDHEKIDQIKQNRLIPGPTKPGLNDLYDD

SEQ ID NO: 3071 - protein, 312 aa, Medicago sativa
  misc_feature (1)..(312): useful for making plants with increased drought tolerance as described in USSN 13/184,361
  misc_feature (1)..(312): gi|563540
MGSVEIPTKVLTNTSSQLKMPVVGMGSAPDFTCKKDTKDAIIEAIKQGYRHFDTAAAYGSEQALGEALKEAIELGLVTRDELFVTSKLWVTENHPHLVIPALQKSLKTLQLDYLDLYLIHWPLSSQPGKFTFPIDVADLLPFDVKGVWESMEESLKLGLTKAIGVSNFSVKKLENLLSVATVLPAVNQVEMNLAWQQKKLREFCNAHGIVLTAFSPLRKGASRGPNEVMENDMLKEIADAHGKSVAQISLRWLYEQGVTFVPKSYDKERMNQNLRIFDWSLTKEDHEKIDQIKQNRLIPGPTKPGLNDLYDD

SEQ ID NO: 3072 - protein, 312 aa, Medicago sativa
  misc_feature (1)..(312): useful for making plants with increased drought tolerance as described in USSN 13/184,361
  misc_feature (1)..(312): gi|537296
MGSVEIPTKVLTNTSSQLKMPVVGMGSAPDFTCKKDTKDAIIEAIKQGYRHFDTAAAYGSEQALGEALKEAIELGLVTRDDLFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNAHGIVLTAFSPVRKGASRGPNEVMENDMLKEIADAHGKSVAQISLRWLYEQGVTFVPKSYDKERMNQNLRIFDWSLTKEDHEKIAQIKQNRLIPGPTKPGLNDLYDD

SEQ ID NO: 3073 - protein, 314 aa, Pueraria lobata
  misc_feature (1)..(314): useful for making plants with increased drought tolerance as described in USSN 13/184,361
  misc_feature (1)..(314): gi|20147510
MAAIEIPTIVFPNSFAQHRVPVVEMGSAPDFTCKKDTKEAIIEAVKQGYRHFDTAAAYGSEQALGEALKEAVDLGLVSRQDLFVTSKLWVTDNHPHLVVSALRKSLKTLQLEYLDLYLIHWPLSSQPGKFSFPIEVEDLLPFDVKGVWEAMQECQKLGLTKAIGVSNFSVKKLQNLLSVATIRPVVNQVEMNLAWQQKKLREFCKENGIVITAFSPLRKGASRGPNEVMENDVLKEIADAHGKSIAQVSLRWLYEQGVTFVPKSYDKERMNQNLQIFDWALTQEDHHKISQISQSRLISGPTKPQLSDLWDDEI

SEQ ID NO: 3074 - protein, 322 aa, Sesbania rostrata
  misc_feature (1)..(322): useful for making plants with increased drought tolerance as described in USSN 13/184,361
  misc_feature (1)..(322): gi|2792155
MAEKKIPEVLLNSGHKMPVIGMGTSVESRPSNDVLASIFVDAIQVGYRHFDSASVYGTEEAIGMAVSKAIEQGLIKSRDEVFITSKPWNTDAHHDLIVPALKTTLKKLGMEYVDLYLIHWPVRLRHDLENPVIFSKEDLLPFDIEGTWKAMEECYRLGLAKSIGICNYGTKKLTKLLEIATIPPAVNQVEMNPSWQQGNLREFCKQKGIHVSAWSPLGAYKIFWGSGAVMENQILQDIATAKGKTIAQVALRWVYQQGSSAMAKSFNKERMKQNLEIFDFELSEEELEKIKQIPQRRQYTGDMWLSENGSCKTLEELWDGDV

SEQ ID NO: 3075 - protein, 315 aa, Digitalis purpurea
  misc_feature (1)..(315): useful for making plants with increased drought tolerance as described in USSN 13/184,361
  misc_feature (1)..(315): gi|13160397
MAEEIRFFKLNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFIPTDIPGTWKAMEALYDSGKARAIGVSNFTLKKLSDLLDVARIPPAVNQVGCHPSCAQTKLRAFCKSKGVHLSGYSPLGSPGTPWVKHDVLENPILVDVAEKLGKTPAQVAIRWGLQMGHSVLPKSVHESRIKENIDVFSWCIPDDLFAKFSEIEQVSPGKPEFPVHPEISQYKTVEEMWDGGI

SEQ ID NO: 3076 - protein, 315 aa, Digitalis purpurea
  misc_feature (1)..(315): useful for making plants with increased drought tolerance as described in USSN 13/184,361
  misc_feature (1)..(315): gi|13160399
MAEEIRFFELNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFVPTDIPGTWKAMEALYDSGKARAIGVSNFTLKKLSDLLDVARIPPAVNQVGCHPSCAQTKLRAFCKSKGIHLSGYSPLGSPGTPWVKHDVLENPILVDVAEKLGKTPAQVALRWGLQMGHSVLPKSVHESRIKENIDVFSWCIPDVLFAKFSEIEQVSPGKPEFPVHPEISQYKTVEEMWDGGI

SEQ ID NO: 3077 - protein, 319 aa, Avena fatua
  misc_feature (1)..(319): useful for making plants with increased drought tolerance as described in USSN 13/184,361
  misc_feature (1)..(319): gi|1155213
MASAKAMGQGEQDRFVLKSGHAIPAVGLGTWRAGSDTAHSVQTAITEAGYRHVDTAAQYGIEKEVDKGLKAAMEAGIDRKDLFVTSKIWRTNLAPERARPALENTLKDLQLDYIDLYLIHWPFRLKDGAHQPPEAGEVLEFDMEGVWKEMEKLVKDGLVKDIDVCNFTVTKLNRLLRSANIPPAVCQMEMHPGWKNDKIFEACKKHGIHVTAYSPLGSSEKNLVHDPVVEKVANKLNKTPGQVLIKWALQRGTSVIPKSSKDERIKENIQAFGWEIPEDDFQVLCSIKDEKRVLTGEELFVNKTHGPYKSASEVWDHEN

SEQ ID NO: 3078 - protein, 320 aa, Hordeum vulgare
  misc_feature (1)..(320): useful for making plants with increased drought tolerance as described in USSN 13/184,361
  misc_feature (1)..(320): gi|728592
MASAKATMGQGEQDHFVLKSGHAMPAVGLGTWRAGSDTAHSVRTAITEAGYRHVDTAAEYGVEKEVGKGLKAAMEAGIDRKDLFVTSKIWCTNLAPERVRPALENTLKDLQLDYIDLYHIHWPFRLKDGAHMPPEAGEVLEFDMEGVWKEMENLVKDGLVKDIGVCNYTVTKLNRLLRSAKIPPAVCQMEMHPGWKNDKIFEACKKHGIHITAYSPLGSSEKNLAHDPVVEKVANKLNKTPGQVLIKWALQRGTSVIPKSSKDERIKENIQVFGWEIPEEDFKVLCSIKDEKRVLTGEELFVNKTHGPYRSARDVWDHEN

SEQ ID NO: 3079 - protein, 321 aa, Oryza sativa subsp. japonica
  misc_feature (1)..(321): useful for making plants with increased drought tolerance as described in USSN 13/184,361
  misc_feature (1)..(321): gi|31429855
MATIPEVPASELIQTMPRVGMGTAAFPFTSSEDTTAAMLRAIELGYRHFDTARIYATEGCVGEAVAEAVRRGLIASRADVFVTSKIWCSDLHAGRVVPAARETLRNLGMDYVDLLLVHWPVSLTPGNYDFPFPKEVILPSFDMEGVWRGMEECHRLGLARAIGVSNFSAKKLEQLLSLAAVRPAVNQVEVNPMWQQRTLREVCRREGVQLCGYSPLGAKGTPWGSAAVMDSGVLQEIAGAKGKTLAQICLRWLYEQGDVLLVKTYNEKRMKENLDIFNWELTDEERERISQLPQLRGLPGLEFISDHGPYKSVEDLWDGDV

SEQ ID NO: 3080 - protein, 322 aa, Oryza sativa subsp. japonica
  misc_feature (1)..(322): useful for making plants with increased drought tolerance as described in USSN 13/184,361
  misc_feature (1)..(322): gi|31429856
MAMATIPEVPASALLPTMPRIGMGTAAFPFTSSEETTAALLRAIELGYRHFDTARLYATEGCVSEAVAEAVRRGLVASRADVFVTSKLWCSDLHAGRVVPAARETLRNLGMDYVDLLLVHWPATVAPGSYDFPFPKEEMAPAFDMEGVWRGMEECHRLGLARAIGVSNFSAKKLEQLLSFAVVRPAANQVEMNPMWQQRTLREVCRREGVQLCGYSPLGAKGTPWGSAAVMDSGVLHDIAQTKGKTLAQICLRWMYEQGDVLLVKTYNENRMKENLDIFDWELTEEERDKISKLPQQRGLTGMQFVCDNGPYKCVEDLWDGA

SEQ ID NO: 3081 - protein, 314 aa, Triticum aestivum
  misc_feature (1)..(314): useful for making plants with increased drought tolerance as described in USSN 13/184,361
  misc_feature (1)..(314): CeresClone:677995
MGAGDKTAAGMPRIGMGTAVQGPKPDPIRRAVLRAIEVGYRHFDTAAHYETEAPIGEAAAEAVRSGAVASRDDLFITSKLWCSDAHRDRVVPALRQTLRNLQMEYVDLYLVHWPVSMKPGRFKAPFTAEDFVPFDMRAVWEAMEECHRLGLAKAIGVANFSCKKLETLLSFATIPPTVNQVEVNPVWQQRKLREFCRGKGIQLCTYSPLGAKGTHWGSDAVMDAGVLQEIAASRGKSVAQVCLRWVYEQGDCLIVKSFDEARMRENLDVDGWELTEEEHRRIAEIPQRKINLGKRYVSEHGPYKSLEELWDGEI

SEQ ID NO: 3082 - protein, 329 aa, Zea mays
  misc_feature (1)..(329): useful for making plants with increased drought tolerance as described in USSN 13/184,361
  misc_feature (1)..(329): CeresClone:290117
MASAGTTAVVPEVALRSGNARTAMPMVGMGTASFPLVHEAVKDAVLSAIEVGFRHFDTASMYGTEKPLGDAVAEALRRGTLRSREDLFVTSKLWCSQNHPDLVLPSLRETLKNLQMEYVDLYLIHWPVCLKPGPPELPTRKENAVPLDLAGVWRAMEECQRLGLAKAIGVSNFTTRHLDGVLAVATVPPAVNQVELNPAWQQRTLRAYCADRGIHVAAYSPLGGQNWDGQGSAVLDSEVLAAIAKARGKTVAQVALRWIHEQGVTCIVKSYSKERLRQNLGIFDWELTDEERLKISQIPQRKVVQTSSLFSQEGEFTAVDPAELNILEE

SEQ ID NO: 3083 - protein, 320 aa, Bromus inermis
  misc_feature (1)..(320): useful for making plants with increased drought tolerance as described in USSN 13/184,361
  misc_feature (1)..(320): gi|543632
MASAKAMMGQERQDHFVLKSGHAIPAVGLGTWRAGSDTAHSVQTAITEAGYRHVDTAAEYGVEKEVGKGLKAAMEAGIDRKDLFVTSKLWCTDLVPDRVRPALEKTLKDLQLDYLDLYLIHWPFRLKDGAHKPPEAGEVLEFDMEGVWKEMENLVKDGLVKDIGVCNYTVTKLNRLLQSAKIAPAVCQMEMHPGWKNDKILEACKKHGIHATAYSPLCSSEKNLAHDPVVEKVANKLNKTPGQVLIKWALQRGTIVIPKSSKDERIKENIQVFGWEIPEEDFQVLCSIKDEKRVLTGEELFVNKTHGPYKSASEVWDNEN

SEQ ID NO: 3084 - protein, 321 aa, Hydrangea macrophylla
  misc_feature (1)..(321): useful for making plants with increased drought tolerance as described in USSN 13/184,361
  misc_feature (1)..(321): gi|40781601
MAFTIPEVPLSSGGRKMPVLGLGTAADPPVDPETVRKAVTEALKLGYRHFDTAALYNSEQPLGDAIAEALGEGLIKSRDELFITSKLWCSDAHRENVEPALQKTLKNLKLEYIDMYLIHWPVSSKPGNYEYPIKKEDFLQMDYKSVWEAMEECQKLGLTKAIGVSNFSCKKLSDVLANAKVPPAVNQVEVNPCWQQKQLTEFCKSNGILVVAYAALGAVGTFYGTNRVMGSEVLNEIARIRGNTVAQVCLRWAYEQGIGVLVKSFNKERMEQNLQIFNWTLSDDESKKISEIPQGRACLGTDYTSVHGPFKTIEELWDGEF

SEQ ID NO: 3085 - protein, 321 aa, Oryza sativa subsp. japonica
  misc_feature (1)..(321): useful for making plants with increased drought tolerance as described in USSN 13/184,361
  misc_feature (1)..(321): gi|50920555
MSDGGAGAKGAGFGMPRVGMGTAVQGPRPEPIRRAVLKAIEAGYRHFDTAAHYETEAPIGEAAAEAVRSGAIASRADLFITSKLWCSDAHRDRVLPALRQTLWNLQMEYVDLYLVHWPVSMKPGRYKAPFTADDFVPFDMRAVWEAMEECHRLGLAKAIGVCNFSCKKLDTLLSFATIPPAVNQVEVNPVWQQRKLRELCREKGVQICAYSPLGASGTHWGSDSVMASAVLRDIAQSKGKTVAQARHVCLRWVYEQGDCLIVKSFDEARMRENLDIVGWELTEEERQRIAGIPQRKINRALRFVSDHGPYKSLDDLWDGEI

SEQ ID NO: 3086 - protein, 323 aa, Oryza sativa subsp. japonica
  misc_feature (1)..(323): useful for making plants with increased drought tolerance as described in USSN 13/184,361
  misc_feature (1)..(323): gi|50900440
MAAVPEVALRHGAGRPMPAVGVGTADSAATSPETKRGAALAALEVGFRHFDTAALYGTEAPLGEAIAEATRRGLVASREEVFVTTKLWCTQCHPGLVLPSLRESLRNLQMEYVDLYLVHWPISVKPGPPMLPVKREDAVPFDFEGVWRAMEECHRLGLAKAIGVSNFTTKHLDKLLAVATIPPAVNQVEMNPVWQQRTVREYCAAKGIRVAAYSPLGGQNWIGEGNDVMESPVLADIARARGKSIAQVSLRWIHEQGVTPIPKSYNKERLKQNLEIFDWELTKEDRLKISQIPQKKIVTAARMFSPDGEFASVDLSDMEIVEE

SEQ ID NO: 3087 - protein, 323 aa, Oryza sativa subsp. japonica
  misc_feature (1)..(323): useful for making plants with increased drought tolerance as described in USSN 13/184,361
  misc_feature (1)..(323): gi|50900438
MAVVVPEAVLRHGDARPMPAVGMGVAEYPSTPERTRDAVLAALEAGFRHFDTASLYRTEAPLGEAIAEATRRGLLASREEAFVTTKLWCTQCHPDLVLPSLRESLRNLQMEYVDLYLIHLPISVKPGPMVFPVKKEDVVPFDFGGVWRAMEECHRLGLAKAIGVSNFTTKHIDKLLAVATILPAVNQVEMNPTWQQRTVREYCDAKGIRVTAYSPLGGQNWGGSANYVMESSVLTEIARARGKSIAQVSLRWIYEQGVTPIAKSYRKERLKENLEIFDWELTDEDRLKISQIPQRKRVTAASLFSPDGEFTSVDLPDIEIVEE

SEQ ID NO: 3088 - protein, 316 aa, Glycyrrhiza glabra
  misc_feature (1)..(316): useful for making plants with increased drought tolerance as described in USSN 13/184,361
  misc_feature (1)..(316): gi|1514979
MAAAAIEIPTKVLPNSTCELRVPVIGMGSAPDFTCKKDTKEAIIEAIKQGYRHFDTAAAYGSETALGEALKEARDLGLVTREDLFVTSKLWVTENHPHLVVPALRKSLETLQLEYLDLYLIHWPLSSQPGKFSFPIQAEDLLPFDVKGVWESMEESLKLGLTKAIGVSNFSVKKLQNLLSVATIRPAVNQVEMNLAWQQKKLREFCNANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEI

SEQ ID NO: 3089 - protein, 315 aa, Glycyrrhiza glabra
  misc_feature (1)..(315): useful for making plants with increased drought tolerance as described in USSN 13/184,361
  misc_feature (1)..(315): gi|1514981
MAAAIEIPTKVLPNSTCELRVPVIGMGSAPDFTCKKDTKEAIIEAIKQGYRHFDTAAAYGSETALGEALKEARDLGLVTREDLFVTSKLWVTENHPHLVVPALRKSLETLQLEYLDLYLIHWPLSSQPGKFSFPIQAEDLLPFDVKGVWESMEESLKLGLTKAIGVSNFSVKKLQNLLSVATIRPAVNQVEMNLAWQQKKLREFCNANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEI

SEQ ID NO: 3090 - DNA, 1133 bp, Arabidopsis thaliana
  misc_feature (1)..(1133): useful for making plants with increased drought tolerance as described in USSN 13/184,361
  misc_feature (1)..(1133): clone125039_inplanta_experimental_L24
aagtttttgatttcagagtccaccgttgagcctgttcaattaaatcgttgaatctcgcggtgcgttttactttgattctttcgaattttttttatatggatgttgccgcgatggcgagatgtgtgggaaggtgctacgtttcgccggcgttcggtgagtctgaatcgcaccggttatcggagcggcggtttctgaaattgtctagctccacgaattcggatcccgccggtagtaaaagtttgaagcttcgcgggaaaattcatcggagaatgagctacttccgtccgatcatggcaaaagatgaatccatttcatcgcggtccggtgaaacgaagcaaatcaatggaaagcaaaagaacattgtctggcatgattgtcccgttactaaatccgacaggcaagaattaattaagcataagggatgtgtgatttggattactggcttaagtggttcaggtaaaagtagtctggcatgtgctcttagtcgagctttgcacaatcgtggaaagctttcgtatatacttgatggtgacaatgttcgacatggtttaaacagcgatcttagtttcgaagcagatgatcgagctgaaaacattcgaagagttggtgaagtggctaaactgtttgcagattctggtattatctgtattgcaagtttaatatctccttaccggatagaacgagctgcctgccgtgcattattaccacaaggagatttcattgaggtatttatggatgtgccactccatgtttgtgaagctagagatccaaagggcttatacaaacgtgcacgcgctggtaaaatcaaaggttttacaggagtagatgatccatatgaagcgcctttggattgcgagattgtaatacaaaacagtagagacaaggggctttcttcttcatcttcatcttcatcttcaccttcatcttcgtcttcttctctgtgtgaaatggcagatattgttgtgtcgtacttggaccaaaatggatacctgaagaaacactccacaaaatcacgtgattgtatgtaaatgtaatattaatatcattgttgtaacgtttcttaaacctattttacctatggacgattaaattgtgaaaacataaatgtaattcacaatctgcaaagagttggc

SEQ ID NO: 3091 - protein, 310 aa, Arabidopsis thaliana
  misc_feature (1)..(310): useful for making plants with increased drought tolerance as described in USSN 13/184,361
  misc_feature (1)..(310): peptide_clone125039_inplanta_experimental_L24
MDVAAMARCVGRCYVSPAFGESESHRLSERRFLKLSSSTNSDPAGSKSLKLRGKIHRRMSYFRPIMAKDESISSRSGETKQINGKQKNIVWHDCPVTKSDRQELIKHKGCVIWITGLSGSGKSSLACALSRALHNRGKLSYILDGDNVRHGLNSDLSFEADDRAENIRRVGEVAKLFADSGIICIASLISPYRIERAACRALLPQGDFIEVFMDVPLHVCEARDPKGLYKRARAGKIKGFTGVDDPYEAPLDCEIVIQNSRDKGLSSSSSSSSSPSSSSSSLCEMADIVVSYLDQNGYLKKHSTKSRDCM

SEQ ID NO: 3092 - protein, 271 aa, Enteromorpha intestinalis
  misc_feature (1)..(271): useful for making plants with increased drought tolerance as described in USSN 13/184,361
  misc_feature (1)..(271): gi|3329471
MLRAIAQRARGSALQCAAPGTEWASCVRGSSGFTAYDVGESTNIKWHETMVSRGDKERLLNQRGCVLWFTGLSGSGKSTVACTLEHALNARGKMTALLDGDNVRHGLNSNLTFTAEDRTEHPPHRRSEQALCRRWRPPLRELHLRPIAPTRPVRERCAGDFVECYMKIPIELCEQRDPKGLYKKARAGLMKGFTGIDDPYEEPLEPELTITVREEGSDMNSPEAMAKQIFDYLEAKGFLKGPAVASSGGSCARVARWGGHGRRRGRQRLAW

SEQ ID NO: 3093 - protein, 290 aa, Arabidopsis thaliana
  misc_feature (1)..(290): useful for making plants with increased drought tolerance as described in USSN 13/184,361
  misc_feature (1)..(290): gi|9757873
MARCVGRCYVSPAFGESESHRLSERRFLKLSSSTNSDPAGSKSLKLRGKIHRRMSYFRPIMAKDESISSRSGETKQINGKQKNIVWHDCPVTKSDRQELIKQKGCVIWITGLSGSGKSSLACALSRALHNRGKLSYILDGDNVRHGLNSDLSFEADDRAENIRRVGEVAKLFADSGIICIASLISPYRIERAACRALLPQGDFIEVFMDVPLHVCEARDPKGLYKRARAGKIKGFTGVDDPYEAPLDCEVHIISNFSSSSSLCEMADIVVSYLDQNGYLKKHSTKSRNCM

SEQ ID NO: 3094 - protein, 312 aa, Catharanthus roseus
  misc_feature (1)..(312): useful for making plants with increased drought tolerance as described in USSN 13/184,361
  misc_feature (1)..(312): gi|2832300
MIGSVKRPVVSCVLPEFDFTESTGLGKKSSSVKLPVNFGAFGSGGGEVKLGFLAPIKATEGSKTSSFQVNGKVDNFRHLQPSDCNSNSDSSLNNCNGFPGKKILQTTTVGNSTNILWHKCAVEKSERQEPLQQRGCVIWITGLSGSGKSTLACALSRGLHAKGKLTYILDGDNVRHGLNSDLSFKAEDRAENIRRIGEVAKLFADAGVICIASLISPYRKPPDACRSLLPEGDFIEVFMDVPLKVCEARDPKGLYKLARAGKIKGFTGIDDPYEPPLKSEIVLHQKLGMCDSPCDLADIVISYLEENGYLKA

SEQ ID NO: 3095 - protein, 275 aa, Zea mays
  misc_feature (1)..(275): useful for making plants with increased drought tolerance as described in USSN 13/184,361
  misc_feature (1)..(275): CeresClone:300011
MLARAPPPRPCSSGVCIARAHPRAAAVAARPGTTRTTTTVAAAAAEAASNGSAAAAVAGISSSSSALVTSTVGKSTNILWHECAIGQKERQGLLNQKGCVVWITGLSGSGKSTLACALSRELHGRGHLTYVLDGDNLRHGLNRDLSFGAEDRAENIRRVGEVAKLFADAGLVCIASLISPYRSDRSACRDLLPKHSFIEVFLDVPLQVCEARDPKGLYKLARAGKIKGFTGIDDPYEPPSDCEIVIQCKVGDCPSPESMAGHVVSYLETNGFLQD

SEQ ID NO: 3096 - protein, 345 aa, Oryza sativa subsp. japonica
  misc_feature (1)..(345): useful for making plants with increased drought tolerance as described in USSN 13/184,361
  misc_feature (1)..(345): gi|50938537
MEASLPFHHHHPAASSTAAHHAARLTPPPPPRDPRATARWVPPAAAPVRSRSPANLGLPPHPPRRLRLRLAPPRITAAVTGGPRRPRRRAPPPLECAGGSSSSLRRPREEEEEEEEEERSSTAHAGVSLVGENKVLQMSSIVPKASNIFWHDCAVGQADRQKLLKQKGCVVWITGLSGSGKSTLACTLDRELHTRGKLSYVLDGDNLRHGLNKDLGFKAEDRAENIRRVGEVAKLFADAGLVCIASFISPYRRDRESCRALLSDGSFIEVFLNMPLELCESRDPKGLYKLARAGKIKGFTGIDDPYESPLNSEIEIKEVDGVCPSPSDMAGQVVTYLEEKGFLHD

SEQ ID NO: 3097 - DNA, 497 bp, Arabidopsis thaliana
  misc_feature (1)..(497): useful for making plants with increased drought tolerance as described in USSN 13/184,361
  misc_feature (1)..(497): 10044_13489782_L33
aagaactcacctaacacacaaacaaaggaacttcacttttttttcccacaccacatcacaccatgtttagagccatgagcacaaggaaagtccatggtggctacgaaaagctcggcgatgaagaagcgagactgaagagggtctctagcgttccggctagtgtttatggtcattcaagaaacccggttcaagaagtgaagaagacaccgacagcgaaaccaaccggtggttctgttcatcctttgtttagtttctttgacgttcattttcaaagaaagaagaagaagacgacgaagaagaagagtttagcaacggcgaaaccagagtttgctaggtatatggagtatgtgagagaaggaggtgtatgggatccgagttctaacgcaccagtgattcattacagatagattcgtcaaggaaaatgaataaaagatttgtatatcgtcttttttttcaaatatataatctatgagaaagccaaacaatccttgattcgg

SEQ ID NO: 3098 - protein, 114 aa, Arabidopsis thaliana
  misc_feature (1)..(114): useful for making plants with increased drought tolerance as described in USSN 13/184,361
  misc_feature (1)..(114): peptide_10044_13489782_L33
MFRAMSTRKVHGGYEKLGDEEARLKRVSSVPASVYGHSRNPVQEVKKTPTAKPTGGSVHPLFSFFDVHFQRKKKKTTKKKSLATAKPEFARYMEYVREGGVWDPSSNAPVIHYR

SEQ ID NO: 3099 - protein, 114 aa, Arabidopsis thaliana
  misc_feature (1)..(114): useful for making plants with increased drought tolerance as described in USSN 13/184,361
  misc_feature (1)..(114): gi|4835241
MFRAMSTRKIHGGYEKLGDEEARLKRVSSVPASVYGHSRNPVQEVKKTPTAKPTGGSVHPLFSFFDVHFQRKKKNTAKKKSLATAKPEFARYMEYVREGGVWDPSSNAPVIHYR

SEQ ID NO: 3100 - protein, 113 aa, Brassica napus
  misc_feature (1)..(113): useful for making plants with increased drought tolerance as described in USSN 13/184,361
  misc_feature (1)..(113): CeresClone:1068483
MFRAMSTRKVHGGYEKLVEDEPKLKRVTSVPASVYGNSRNPVQEEVKKTPTVKPTGGSVHPLLSFFDVRFQKKKKKTKKSLATAKPEFARYMAYVKEGGVWDPNSNAPVIHYR

SEQ ID NO: 3101 - protein, 118 aa, Glycine max
  misc_feature (1)..(118): useful for making plants with increased drought tolerance as described in USSN 13/184,361
  misc_feature (1)..(118): CeresClone:584111
MFRSMTTRRGYERLGKESATTALLHEGFKRSTSLPSWGSNSSRKMALGSTYGEINLKRNPTKKGNNNSDKKSHPLLSFLALRRKKKTTARPEFARYLEYLKEGGMWDFNSNKPVMYYE

SEQ ID NO: 3102 - DNA, 913 bp, Arabidopsis thaliana
  misc_feature (1)..(913): useful for making plants with increased drought tolerance as described in USSN 13/184,361
  misc_feature (1)..(913): 10987_3769_L34
aaaaatctggaacggataaaataatttgctcggcttcctcagctccaatggcggcgacgatgatcggaattaacctctcctgcttcaaatcaacatcgttcttctcaccggacctcaattctctccaatcaaagctctctctcctatctctcaaaccctctccaacacagccacggaaatcaacagtcatccgtatgggcggtggtccgagaactttccccggcggtgtatcaaaatggcaatggaaaaggatgcaagcgaagaaacagaaacagcttctcaaagcaaggttatgcagagaacgtcagatctacgagatgcgaaaacgcgccgagctaaaagcggcggtggctgagctagaacgaccatgggaaccgattcataaaccaccgaatctattctcagtttgtgctgatgagcaagttaaagtactcgcggatcggtttcagaaacctggtggatttgatttatggactgatagagatggtcctcaattgtttgagagtgttgatgatttgccttctgctaggttttttcctaaaggtgttgttcatagtgttaaaccttatggtagattatcatctagctctgttgttgatgatggtgatgagagtgaggttaaagatgaagaaattgggaagaagttacgtggtcgtagggtgaggaagagaggtgatgatggaggtaagaggaggactgaaaatcgtggtaatggtgggagattgagaaatggagggtcttcttcttctcaggtgtatgatatgactttgcagaatgatgggagatatgaaattggatcttaggtatgagttcttctttgttgtgtttggatcattgatgtctctgaacataatttgtatgtaatctggaatagtttgattgtgattatgcaagttttcagttttagggaagc

SEQ ID NO: 3103 - protein, 251 aa, Arabidopsis thaliana
  misc_feature (1)..(251): useful for making plants with increased drought tolerance as described in USSN 13/184,361
  misc_feature (1)..(251): peptide_10987_3769_L34
MAATMIGINLSCFKSTSFFSPDLNSLQSKLSLLSLKPSPTQPRKSTVIRMGGGPRTFPGGVSKWQWKRMQAKKQKQLLKARLCRERQIYEMRKRAELKAAVAELERPWEPIHKPPNLFSVCADEQVKVLADRFQKPGGFDLWTDRDGPQLFESVDDLPSARFFPKGVVHSVKPYGRLSSSSVVDDGDESEVKDEEIGKKLRGRRVRKRGDDGGKRRTENRGNGGRLRNGGSSSSQVYDMTLQNDGRYEIGS

SEQ ID NO: 3104 - DNA, 1252 bp, Arabidopsis thaliana
  misc_feature (1)..(1252): useful for making plants with increased drought tolerance as described in USSN 13/184,361
  misc_feature (1)..(1252): cdna13500101_clone17206_L35
atcattcgtgtactaattttaccttcatagacttaattaagatacgatcatggcgtcgtttgtctttgtgatttctcttcttcttctctctttttcgtcggctgttttctccgatgatgcttcttttcagaaacttccggtgcctgacaagaggtcaggccctgaatctttcgcctttgactctaccggcggattctacaccggagtctccggtggtaaaatcctcaagtacgttcctgggaagggttatgtcgattttgcccagatcacagattcctcgaactcggcatggtgcaacggagcattaggaaccgctttcgccggaaagtgtggtcgaccagcgggaatagccttaaacagcaaaacaggtgatctctatgtcgccgatgctccgttgggtcttcacgttatctctcccgcaggaggtttggccacaaagctggccgacagtgttgacggaaagcctttcaagtttcttgacggtcttgatgttgatcccaccaccggcgtcgtctacttcacttccttcagttccaagtttggaccccgggaagtgttaatcgcagtgggattaaaagacgcgagcggaaagctgttcaaatacgacccagcgaccaaagccgtgactgagttaatggaaggtctaagtggtgctgctggttgtgcagtgagctcagatggttcattcgtgctagttagcgagttcataaagagtaacatcaagaaatattggattaaagggcccaaagctggaactattgaagacttctcaagtcttgtctcgaaccccgacaacatcaggagggtaggttctaccggaaatttctgggtcgcctctgtcgtgaacaaggttgttatgcctaccgaccctagggcggtcaaactagacgctaatggaaaagtgctccagaccattttcctcaagaatgagtttgggaatactttgcttagtgaagtcaacgagttcaacggccatctttacatcggaactcttactggacctttcgccggagtcatgaaactttaaattggtatcaactatatggttctttggtgattaccatttttgatatcattttgaaaggtctgtttacagttattttaaccataataatatcccctcaaatgtcctgcttgttacgtgggtgacacatttgttcggtgattccttgaataggctactactacttattgtttcatattttcgaagagattatctctagttcttaaggctttggttttctttgtttcc

SEQ ID NO: 3105 - protein, 325 aa, Arabidopsis thaliana
  misc_feature (1)..(325): useful for making plants with increased drought tolerance as described in USSN 13/184,361
  misc_feature (1)..(325): peptide_cdna13500101_clone17206_L35
MASFVFVISLLLLSFSSAVFSDDASFQKLPVPDKRSGPESFAFDSTGGFYTGVSGGKILKYVPGKGYVDFAQITDSSNSAWCNGALGTAFAGKCGRPAGIALNSKTGDLYVADAPLGLHVISPAGGLATKLADSVDGKPFKFLDGLDVDPTTGVVYFTSFSSKFGPREVLIAVGLKDASGKLFKYDPATKAVTELMEGLSGAAGCAVSSDGSFVLVSEFIKSNIKKYWIKGPKAGTIEDFSSLVSNPDNIRRVGSTGNFWVASVVNKVVMPTDPRAVKLDANGKVLQTIFLKNEFGNTLLSEVNEFNGHLYIGTLTGPFAGVMKL

SEQ ID NO: 3106 - protein, 335 aa, Arabidopsis thaliana
  misc_feature (1)..(335): useful for making plants with increased drought tolerance as described in USSN 13/184,361
  misc_feature (1)..(335): gi|17104523
MTSFCSMISLLLLLSLSSAVFSDDASFQKLPVPETRSGPEAFAFDSTGKGFYTGVSGGKILKYLPETGYVDFAQITESSNSSWCDGTIGTALAGRCGRPAGIAFNEKTGDLYVADAPLGLHVISPAGGLATKITDSVDGKPFKFLDGLDVDPTTGVVYFTSFSSRFSPIQVLIALGLKDATGKLYKYDPSTKVVTVLMEGLSGSAGCAVSSDGSFVLVSQFTKSNIKRYWIKGPKAGSSEDFTNSVSNPDNIKRIGSTGNFWVASVVNKIIVPTNPSAVKVNSNGEVLQTIPLKDKFGDTLLSEVNEFEGNLYIGTLTGPFAGILKLEKGSCPAT

SEQ ID NO: 3107 - protein, 335 aa, Arabidopsis thaliana
  misc_feature (1)..(335): useful for making plants with increased drought tolerance as described in USSN 13/184,361
  misc_feature (1)..(335): gi|1754985
MTSFCSMISLLLLLSLSSPVFSDDASFQKLPVPETRSGPEAFAFDSTGKGFYTGVSGGKILKYLPETGYVDFAQITESSNSSWCDGTIGTALAGRCGRPAGIAFNEKTGDLYVADAPLGLHVISPAGGLATKITDSVDGKPFKFLDGLDVDPTTGVVYFTSFSSRFSPIQVLIALGLKDATGKLYKYDPSTKVVTVLMEGLSGSAGCAVSSDGSFVLVSQFTKSNIKRYWIKGPKAGSSEDFTNSVSNPDNIKRIGSTGNFWVASVVNKIIVPTNPSAVKVNSNGEVLQTIPLKDKFGDTLLSEVNEFEGNLYIGTLTGPFAGILKIEKGSCPAT

SEQ ID NO: 3108 - protein, 338 aa, Arabidopsis thaliana
  misc_feature (1)..(338): useful for making plants with increased drought tolerance as described in USSN 13/184,361
  misc_feature (1)..(338): CeresClone:124660
  misc_feature (102)..(102): Xaa is any aa, unknown or other
MTSFCSMISLLLLLLLLSLSSAVISDDASFQKLPVPETRSGPEAFAFDSTGKGFYTGVSGGKILKYLPETGYVDFAQITESSNSSWCDGTIGTALAGRCGRXAGIAFNEKTGDLYVADAPLGLHVISPAGGLATKITDSVDGKPFKFLDGLDVDPTTGVVYFTSFSSRFSPIQVLIALGLKDATGKLYKYDPSTKVVTVLMEGLSGSAGCAVSSDGSFVLVSQFTKSNIKRYWIKGPKAGSSEDFTNSVSNPDNIKRIGSTGNFWVASVVNKIIVPTNPSAVKVNSNGEVLQTIPLKDKFGDTLLSEVNEFEGNLYIGTLTGPFAGILKLEKGSCPAT

SEQ ID NO: 3109 - protein, 344 aa, Rauvolfia serpentina
  misc_feature (1)..(344): useful for making plants with increased drought tolerance as described in USSN 13/184,361
  misc_feature (1)..(344): gi|62903513
MAKLSDSQTMALFTVFLLFLSSSLALSSPILKEILIEAPSYAPNSFTFDSTNKGFYTSVQDGRVIKYEGPNSGFVDFAYASPYWNKAFCENSTDAEKRPLCGRTYDISYNLQNNQLYIVDCYYHLSVVGSEGGHATQLATSVDGVPFKWLYAVTVDQRTGIVYFTDVSTLYDDRGVQQIMDTSDKTGRLIKYDPSTKETTLLLKELHVPGGAEVSADSSFVLVAEFLSHQIVKYWLEGPKKGTAEVLVKIPNPGNIKRNADGHFWVSSSEELDGNMHGRVDPKGIKFDEFGNILEVIPLPPPFAGEHFEQIQEHDGLLYIGTLFHGSVGILVYDKKGNSFVSSH

SEQ ID NO: 3110 - DNA, 1150 bp, Arabidopsis thaliana
  misc_feature (1)..(1150): useful for making plants with increased drought tolerance as described in USSN 13/184,361
  misc_feature (1)..(1150): clone104691_L45
acgactacaaagtacaagaaagtctcatttgagaataattgagcgataaagaaacggtatgacgtcgttttgctccatgatttctcttcttcttcttctctctctttcatcggcggttttctccgatgacgcttctttccagaaacttccggtgccggaaactaggtcaggtcccgaagctttcgcttttgattccaccggtaaagggttctataccggtgtctccggtggtaaaatcctcaagtacctccccgagacgggttatgttgactttgcccagatcactgaatcctcgaactcttcatggtgcgatggtactattggaacggctttagccggacgctgtggtcgaccagcaggaatagcattcaacgagaaaacaggtgatctttacgtcgccgatgctccgttgggtcttcacgttatttctcccgccggtggtttggctacgaagatcaccgacagtgttgacggaaagcctttcaagtttcttgacggtcttgacgttgatcccactactggtgtcgtctacttcacttccttcagctcacgcttctccccaatccaagtgttgattgcattggggttaaaggacgcgaccggaaagctctacaaatacgacccatcgaccaaagtcgtgactgtactgatggaagggctaagtggttcagccgggtgtgcagtgagctcagatggttcgtttgtgctggttagtcagttcacaaaaagtaacatcaagaggtattggatcaagggacccaaagctggttcttctgaagacttcaccaactcagtctcaaaccctgacaatatcaaaagaattggctctactggaaacttttgggtcgcttcagtggtgaacaagatcatcgtacctacgaacccatcagcagtcaaagttaactctaatggtgaagttcttcaaacaattcctctcaaagataaatttggagacactctgctcagcgaagtcaacgaattcgagggcaatttatatataggaactctcaccggaccatttgctggaattcttaagctcgaaaagggttcttgtcctgccacttagatctcttatttgaatgcatccgatgtgttacaataatatatatatatgagctttttatttatttctgaataaaataaccactta

SEQ ID NO: 3111 - protein, 335 aa, Arabidopsis thaliana; identical to SEQ ID NO: 3106
  misc_feature (1)..(335): useful for making plants with increased drought tolerance as described in USSN 13/184,361
  misc_feature (1)..(335): peptide_clone104691_L45

SEQ ID NO: 3112 - protein, 325 aa, Arabidopsis thaliana; identical to SEQ ID NO: 3105
  misc_feature (1)..(325): useful for making plants with increased drought tolerance as described in USSN 13/184,361
  misc_feature (1)..(325): CeresClone:17206

SEQ ID NO: 3113 - protein, 325 aa, Arabidopsis thaliana; identical to SEQ ID NO: 3105
  misc_feature (1)..(325): useful for making plants with increased drought tolerance as described in USSN 13/184,361
  misc_feature (1)..(325): gi|30984544

SEQ ID NO: 3114 - protein, 328 aa, Arabidopsis thaliana
  misc_feature (1)..(328): useful for making plants with increased drought tolerance as described in USSN 13/184,361
  misc_feature (1)..(328): gi|30698979
MRSFVSLISLLLLLSFSSSVLSTKKSSFQKLPVPGNRTGPEAFAFDSTGKGFYTGVTGGKILKYLPKKGYVDFAQITNSSKSSLCDGALGTTNVEKCGRPAGIAFNTKTGDLYVADAALGLHVIPRRGGLAKKIADSVGGKPFLFLDGLDVDPTTGVVYFTSFSSTFGPRDVLKAVATKDSTGKFFKYDPSKKVVTVLMEGLSGSAGCAVSSDGSFVLVGQFTKSNIKRYWIKGSKAGTSEDFTNSVSNPDNIKRIGSTGNFWVASVVNSATGPTNPSAVKVSSAGKVLQTIPLKDKFGDTLVSEVNEYKGQLYIGALFGPFAGILKL

SEQ ID NO: 3115 - protein, 329 aa, Arabidopsis thaliana
  misc_feature (1)..(329): useful for making plants with increased drought tolerance as described in USSN 13/184,361
  misc_feature (1)..(329): gi|12325143
MMRSFVSLISLLLLLSFSSSVLSTKKSSFQKLPVPGNRTGPEAFAFDSTGKGFYTGVTGGKILKYLPKKGYVDFAQITNSSKSSLCDGALGTTNVEKCGRPAGIAFNTKTGDLYVADAALGLHVIPRRGGLAKKIADSVGGKPFLFLDGLDVDPTTGVVYFTSFSSTFGPRDVLKAVATKDSTGKFFKYDPSKKVVTVLMEGLSGSAGCAVSSDGSFVLVGQFTKSNIKRYWIKGSKAGTSEDFTNSVSNPDNIKRIGSTGNFWVASVVNSATGPTNPSAVKVSSAGKVLQTIPLKDKFGDTLVSEVNEYKGQLYIGALFGPFAGILKL

SEQ ID NO: 3116 - protein, 347 aa, Glycine max
  misc_feature (1)..(347): useful for making plants with increased drought tolerance as described in USSN 13/184,361
  misc_feature (1)..(347): CeresClone:621848
MKLSTLFLFLFHLAHAALSDEATFIRDGLKSYSQLDLPHSVFGSESVAFDCHGKGPYVGVSDGRILKWHETKREWIDFAVTSPHRNKKLCDGLTNDKMESMCGRPLGLKFNTLTCELYIADAYFGLLVVGPGGGVAKQLATSAEGVPFRFTNALDIDTKTGEVYFTDSSIMFQRRVYISIILSGDRTGRLLKYVPSTQSVHVLVKGLAFPNGVALSKDNSFIIVAESTTFKILKIQVRDSKTNNNNIEPFAQVPRSPDNIKRNAKGEFWVALNSGRGLIQKLENEIETTLPWNADPVAIKFDEKGRAIEVLDGEYGRQLDSVSEVEEHEGSLWIGSAVQPYIGLIKA

SEQ ID NO: 3117 - protein, 347 aa, Catharanthus roseus
  misc_feature (1)..(347): useful for making plants with increased drought tolerance as described in USSN 13/184,361
  misc_feature (1)..(347): gi|18222
MMAVFFMFFLLLLSSSSSSSSSSPILKKIFIESPSYAPNAFTFDSTDKGFYTSVQDGRVIKYEGPNSGFTDFAYASPFWNKAFCENSTDPEKRPLCGRTYDISYDYKNSQMYIVDGHYHLCVVGKEGGYATQLATSVQGVPFKWLYAVTVDQRTGIVYFTDVSSIHDDSPEGVEEIMNTSDRTGRLMKYDPSTKETTLLLKELHVPGGAEISADGSFVVVAEFLSNRIVKYWLEGPKKGSAEFLVTIPNPGNIKRNSDGHFWVSSSEELDGGQHGSVVSRGIKFDGFGNILQVIPLPPPYEGEHFEQIQEHDGLLYIGSLSHSSVGILVYDDHDNKGNSYVSQLVIN

SEQ ID NO: 3118 - protein, 352 aa, Catharanthus roseus
  misc_feature (1)..(352): useful for making plants with increased drought tolerance as described in USSN 13/184,361
  misc_feature (1)..(352): gi|18220
MANFSESKSMMAVFFMFFLLLLSSSSSSSSSSPILKKIFIESPSYAPNAFTFDSTDKGFYTSVQDGRVIKYEGPNSGFTDFAYASPFWNKAFCENSTDPEKRPLCGRTYDISYDYKNSQMYIVDGHYHLCVVGKEGGYATQLATSVQGVPFKWLYAVTVDQRTGIVYFTDVSSIHDDSPEGVEEIMNTSDRTGRLMKYDPSTKETTLLLKELHVPGGAEISADGSFVVVAEFLSNRIVKYWLEGPKKGSAEFLVTIPNPGNIKRNSDGHFWVSSSEELDGGQHGRVVSRGIKFDGFGNILQVIPLPPPYEGEHFEQIQEHDGLLYIGSLFHSSVGILVYDDHDNKGNSYVSS

SEQ ID NO: 3119 - protein, 343 aa, Zea mays
  misc_feature (1)..(343): useful for making plants with increased drought tolerance as described in USSN 13/184,361
  misc_feature (1)..(343): CeresClone:316544
MAAAATRSLHSFLALLLLLAAAAAAAALSYETKSIDPGLVVMTLPEPVSGPESLAFDGRGGGPYSGVSDGRVLRWQGPLRGWTEFAYNSKHRSVALCAPDKKLVVPESLCGRPLGLQFHRQSGDLYVADAYLGLLRVAARGGLAQVVATEAAGGPFNFLNGLDVDQRTGDVYFTDSSATYRRSDYLLVVAMGDETGRLLRYERRTGRVGVLQAGLSYPNGVAVSADGTHVVVAHTALCELRRYWIRGARAGTSDTFAELPGYPDNLRADGRGGYWVALSSGVAADEAAAAPTVAVRVSRDGNVTEALDGFSFVSVSEVAQRGGALWVGSVDTPYAGQLKRRAS

SEQ ID NO: 3120 - protein, 364 aa, Oryza sativa subsp. japonica
  misc_feature (1)..(364): useful for making plants with increased drought tolerance as described in USSN 13/184,361
  misc_feature (1)..(364): gi|50899872
MRKGAAGMACTCSAAAAASALVKLLVLVAAVAATTSAGGGDEPTYETKSIDPSLAVMTLPAPVTGPESLAFDGRGDGPYTGGSDGRILRWRGGRLGWTEFAYNSRHKSVGVCSPEKKLVVPESVCGRPLGLQFHHASGDLYVADAYLGLLRVPARGGLAEVVATEAAGVPFNFLNGLDVDQRTGDVYFTDSSTTYRRSQYLLVVAMGDETGRLLRYDARRRRVTVLHSGLPYPNGVAVSDDGTHVVVAHTGLCELRRYWLRGPRAGKSETFAEVPGYPDNVRRDGDGGYWVALSRGADNDDVAPTVAVRVTAAGKKKGGGAAVVAEALAGFSFVTVSEVAEQNGTLWIGSVDTPYAGAAVRGRR

SEQ ID NO: 3121 - protein, 351 aa, Ophiorrhiza pumila
  misc_feature (1)..(351): useful for making plants with increased drought tolerance as described in USSN 13/184,361
  misc_feature (1)..(351): gi|13928598
MHSSEAMVVSILCALFLSSLSLVSSSPEFFEFIEAPSYGPNAYAFDSDGELYASVEDGRIIKYDKPSNKFLTHAVASPIWNNALCENNTNQDLKPLCGRVYDFGFHYETQRLYIADCYFGLGFVGPDGGHAIQLATSGDGVEFKWLYALAIDQQAGFVYVTDVSTKYDDRGVQDIIRINDTTGRLIKYDPSTEEVTVLMKGLNIPGGTEVSKDGSFVLVGEFASHRILKYWLKGPKANTSEFLLKVRGPGNIKRTKDGDFWVASSDNNGITVTPRGIRFDEFGNILEVVAIPLPYKGEHIEQVQEHDGALFVGSLFHEFVGILHNYKSSVDHHQEKNSGGLNASFKEFSSF

SEQ ID NO: 3122 - protein, 342 aa, Rauvolfia mannii
  misc_feature (1)..(342): useful for making plants with increased drought tolerance as described in USSN 13/184,361
  misc_feature (1)..(342): gi|21097
KLSDSQTMALFTVFLLFLSSSLALSSPILKEILIEAPSYAPNSFTFDSTNKGFYTSVQDGRVIKYEGPNSGFVDFAYASPYWNKAFCENSTDAEKRPLCGRTYDISYNLQNNQLYIVDCYYHLSVVGSEGGHATQLATSVDGVPFKWLYAVTVDQRTGIVYFTDVSTLYDDRGVQQIMDTSDKTGRLIKYDPSTKETTLLLKELHVPGGAEVSADSSFVLVAEFLSHQIVKYWLEGPKKGTAEVLVKIPNPGNIKRNADGHFWVSSSEELDGNMHGRVDPKGIKFDEFGNILEVIPLPPPFAGEHFEQIQEHDGLLYIGTLFHGSVGILVYDKKGNSFVSSH

SEQ ID NO: 3123 - DNA, 1153 bp, Arabidopsis thaliana
  misc_feature (1)..(1153): useful for making plants with increased nitrogen use efficiency as described in USSN 11/654,357
  misc_feature (1)..(1153): Ceres CLONE ID no. 154343
  misc_feature (1)..(1153): Also Known As Ceres ME02507
  misc_feature (1)..(1153): Also Known As Ceres  LEAD Number 82
  misc_feature (136)..(934): CDS
gacataacttgcaagctgttgagattttccatcctcaataactttattcttccatatctctcccatttcgctctctatttcacatccccatataacataatatacaatcacacatatcatttctatatagtatttaatggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctgacttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactacgaaagatgaggcctcttggagtgatagtaactttggtgttggtggaacattatatgaccacaatatctccggcgccgatgcagattttccgatatggtcaccggaaagaatcaatgacgagaagatgtttttggattattgtcaagactttggtgttcatgattttgggttttgactgttcaccattgacatattggcaactctatggagatgaacacaagcattgagttgtcatgtttatacatacgtggcatatacatatatatatatgtacattatatgtaaacatatacacgcatacaaatcataaacatgtaaggataataaatccatgtaaatcagtaagggtgcaccatggttttcaagtattattaattagggtttggtaggt

SEQ ID NO: 3124 - protein, 266 aa, Arabidopsis thaliana
  misc_feature (1)..(266): useful for making plants with increased nitrogen use efficiency as described in USSN 11/654,357
  misc_feature (1)..(266): Ceres CLONE ID no. 154343
  misc_feature (1)..(266): Also Known As Ceres ME02507
  misc_feature (1)..(266): Also Known As Ceres  LEAD Number 82
  misc_feature (14)..(61): Pfam Name: Myb_DNA-binding; Pfam Description: Myb-like DNA-binding domain
MGRQPCCDKLGVKKGPWTVEEDKKLINFILTNGHCCWRALPKLAGLRRCGKSCRLRWTNYLRPDLKRGLLSHDEEQLVIDLHANLGNKWSKIASRLPGRTDNEIKNHWNTHIKKKLLKMGIDPMTHQPLNQEPSNIDNSKTIPSNPDDVSVEPKTTNTKYVEISVTTTEEESSSTVTDQNSSMDNENHLIDNIYDDDELFSYLWSDETTKDEASWSDSNFGVGGTLYDHNISGADADFPIWSPERINDEKMFLDYCQDFGVHDFGF

SEQ ID NO: 3125 - protein, 127 aa, Glycine max
  misc_feature (1)..(127): useful for making plants with increased nitrogen use efficiency as described in USSN 11/654,357
  misc_feature (1)..(127): Ceres CLONE ID no. 643885
  misc_feature (1)..(127): Functional Homolog of  Ceres CLONE ID no. 154343 with e-value of 2.19E-63 and BLAST sequence percent identity of 90.5
MGRQPCCDKLGVKKGPWTAEEDKKLINFIFTNGQCCWRAVPKLAGLRRCGKSCRLRWTNYLRPDLKRGLLTQAEEQLVIDLHARLGNRWSKIAARLPGRTDNEIKNHWNTHIKKKLLKMGIDPLTHE

SEQ ID NO: 3126 - protein, 121 aa, Glycine max
  misc_feature (1)..(121): useful for making plants with increased nitrogen use efficiency as described in USSN 11/654,357
  misc_feature (1)..(121): Ceres CLONE ID no. 590304
  misc_feature (1)..(121): Functional Homolog of  Ceres CLONE ID no. 154343 with e-value of 8.30E-57 and BLAST sequence percent identity of 87.5
  misc_feature (121)..(121): Xaa is any aa, unknown or other
MGRQPCCDKVGLKKGPWTAEEDKKLINFILTNGQCCWRALPKLAGLLRCGKSCRLRWTNYLRPDLKRGLLSEYEEKMVIDLHAQLGNRWSKIASHLPGRTDNEIKNHWKSHIKKKLKKMGX

SEQ ID NO: 3127 - protein, 103 aa, Glycine max
  misc_feature (1)..(103): useful for making plants with increased nitrogen use efficiency as described in USSN 11/654,357
  misc_feature (1)..(103): Ceres CLONE ID no. 658946
  misc_feature (1)..(103): Also known as ME05213
  misc_feature (1)..(103): Functional Homolog of  Ceres CLONE ID no. 154343 with e-value of 5.19E-48 and BLAST sequence percent identity of 87.3
MGRQPCCDKVGLKKGPWTAEEDKKLINFILTNGQCCWRAVPKLAGLLRCGKSCRLRWTNYLRPDLKRGLLSEYEEKMVIDLHAQLGNRWSKIASHLPGRTDNE

SEQ ID NO: 3128 - protein, 273 aa, Zea mays
  misc_feature (1)..(273): useful for making plants with increased nitrogen use efficiency as described in USSN 11/654,357
  misc_feature (1)..(273): Ceres CLONE ID no. 280394
  misc_feature (1)..(273): Functional Homolog of  Ceres CLONE ID no. 154343 with e-value of 1.99E-62 and BLAST sequence percent identity of 82.9
MGRQPCCEKIGIKKGPWTAEEDQKLVTFLLSHGHCCWRLVPKLAGLLRCGKSCRLRWTNYLRPDLKRGLLSEEEEALVIDLHAQLGNRWSKIAARLPGRTDNEIKNHWNTHIKKKLKKMGIDPVTHGPLAPATQPLALAQQRDPPQVVREEERCDDDPSKQASSQGLAAGADEDDDVEETPASAAQPHGATTTSPASAAAGSVSPSCSSSASGADADAAAWPGPIDLFLEVDGIMDMDWAGILSGCGDDDAADISVDLFDHYAGDGFDEQVWM

SEQ ID NO: 3129 - protein, 100 aa, Zea mays
  misc_feature (1)..(100): useful for making plants with increased nitrogen use efficiency as described in USSN 11/654,357
  misc_feature (1)..(100): Ceres CLONE ID no. 237195
  misc_feature (1)..(100): Functional Homolog of  Ceres CLONE ID no. 154343 with e-value of 1.49E-43 and BLAST sequence percent identity of 82.0
MGRQPCCDKVGLKKGPWTAEEDQKLVSFILGNRQCCWRAVPKLAGLLRCGKSCRLRWTNYLRPDLKRGLLSDAEEKLVIDLHAQLGNRWSKIASHMPGRT

SEQ ID NO: 3130 - protein, 149 aa, Zea mays
  misc_feature (1)..(149): useful for making plants with increased nitrogen use efficiency as described in USSN 11/654,357
  misc_feature (1)..(149): Ceres CLONE ID no. 1490210
  misc_feature (1)..(149): Functional Homolog of  Ceres CLONE ID no. 154343 with e-value of 1.79E-61 and BLAST sequence percent identity of 80.5
  misc_feature (18)..(18): Xaa is any aa, unknown or other
  misc_feature (19)..(19): Xaa is any aa, unknown or other
MGRQPCCDKVGVKKGPWXXEEDQKLVGFLLTHGHCCWRVVPKLAGLLRCGKSCRLRWTNYLRPDLKRGLLSDDEERLVIDLHAQLGNRWSKIAAQLPGRTDNEIKNHWNTHIRKKLVRMGIDPVTHLPLQEPPAPAPAPAEQQEQSHRQ

SEQ ID NO: 3131 - protein, 309 aa, Gossypium hirsutum
  misc_feature (1)..(309): useful for making plants with increased nitrogen use efficiency as described in USSN 11/654,357
  misc_feature (1)..(309): Public GI no. 13346188
  misc_feature (1)..(309): Functional Homolog of  Ceres CLONE ID no. 154343 with e-value of 1.40E-54 and BLAST sequence percent identity of 70.3
MGRSPCCEKVGLKKGPWTPEEDQKLLAYIEQHGHGSWRALPLKAGLQRCGKSCRLRWINYLRPDIKRGKFSLQEEQTIIQLHALLGNRWSAIATHLPKRTDNEIKNYWNTHLKKRLTKMGIDPVTHKPKTDALGSTTGNPIDAANLSHMAQWESARLEAEARLVRESKLVPSNPPQSNHFTAVAPSPTPATRPQCLDVLKAWQGVVCGLFTFNMDNNNLQSPTSTLNFMENTTTLPMSSSSSVNGMFNENFGWNSSINPCESGDILKVEYGSDQIPELKERLDHPMELHEMDCSSEGTWFQELFGFNGL

SEQ ID NO: 3132 - protein, 106 aa, Brassica napus
  misc_feature (1)..(106): useful for making plants with increased nitrogen use efficiency as described in USSN 11/654,357
  misc_feature (1)..(106): Ceres CLONE ID no. 971474
  misc_feature (1)..(106): Functional Homolog of  Ceres CLONE ID no. 154343 with e-value of 4.70E-38 and BLAST sequence percent identity of 69.8
MGRSPCCDKDGLKKGPWTPEEDQKLLAYIEEHGHGSWRSLPEKAGLQRCGKSCRLRWTNYLRPDIKRGKFTVQEEQTIIQLHALLGNRWSAIATHLPKRTDNEIKN

SEQ ID NO: 3133 - protein, 112 aa, Brassica napus
  misc_feature (1)..(112): useful for making plants with increased nitrogen use efficiency as described in USSN 11/654,357
  misc_feature (1)..(112): Ceres CLONE ID no. 1069120
  misc_feature (1)..(112): Functional Homolog of  Ceres CLONE ID no. 154343 with e-value of 1.20E-41 and BLAST sequence percent identity of 69.6
  misc_feature (95)..(95): Xaa is any aa, unknown or other
MGRSPCCDKLGLKKGPWTQEEDQKLLAYIEEHGYGSWRSLPEKAGLHRCGKSCRLRWTNYLRPDIKRGKFNLQEEQTIIQLHALLGNRWSAIATXLPKRTDNEIKNYWNTHL

SEQ ID NO: 3134 - protein, 125 aa, Brassica napus
  misc_feature (1)..(125): useful for making plants with increased nitrogen use efficiency as described in USSN 11/654,357
  misc_feature (1)..(125): Ceres CLONE ID no. 970455
  misc_feature (1)..(125): Functional Homolog of  Ceres CLONE ID no. 154343 with e-value of 4.60E-47 and BLAST sequence percent identity of 69.6
MGRSPCCDKAGLKKGPWTPEEDQKLLAYIEEHGHGSWRSLPEKAGLQRCGKSCRLRWTNYLRPDIKRGKFTVQEEQTIIQLHALLGNRWSAIATHLAKRTDNEIKNYWNTHLKKRLVKMGIDPVT

SEQ ID NO: 3135 - protein, 121 aa, Triticum aestivum
  misc_feature (1)..(121): useful for making plants with increased nitrogen use efficiency as described in USSN 11/654,357
  misc_feature (1)..(121): Ceres CLONE ID no. 919950
  misc_feature (1)..(121): Functional Homolog of  Ceres CLONE ID no. 154343 with e-value of 8.90E-44 and BLAST sequence percent identity of 68.5
MGRSPCCEKEHTNKGAWTKEEDQRLIAYIRVNGEGCWRSLPKAAGLLRCGKSCRLRWMNYLRPDLKRGNFTDDEDELIIRLHSLLGNKWSLIAGQLPGRTDNEIKNYWNTHIKRKLLSRGM

SEQ ID NO: 3136 - protein, 139 aa, Triticum aestivum
  misc_feature (1)..(139): useful for making plants with increased nitrogen use efficiency as described in USSN 11/654,357
  misc_feature (1)..(139): Ceres CLONE ID no. 1020930
  misc_feature (1)..(139): Functional Homolog of  Ceres CLONE ID no. 154343 with e-value of 3.60E-47 and BLAST sequence percent identity of 68.2
MGRSPCCEKEHTNKGAWTKEEDQRLIAYIRANGEGCWRSLPKAAGLLRCGKSCRLRWMNYLRPDLKRGNFTDEEDELIIRLHSLLGNKWSLIAGQLPGRTDNEIKNYWNTHIKRKLLSRGMDPHTHRPLTAVDGGAASS

SEQ ID NO: 3137 - protein, 132 aa, Brassica napus
  misc_feature (1)..(132): useful for making plants with increased nitrogen use efficiency as described in USSN 11/654,357
  misc_feature (1)..(132): Ceres CLONE ID no. 1122673
  misc_feature (1)..(132): Functional Homolog of  Ceres CLONE ID no. 154343 with e-value of 4.49E-49 and BLAST sequence percent identity of 67.9
  misc_feature (86)..(86): Xaa is any aa, unknown or other
  misc_feature (118)..(118): Xaa is any aa, unknown or other
  misc_feature (129)..(129): Xaa is any aa, unknown or other
MGRSPCCDKMGLKKGPWTSEEDQKLLAYIDEHGHGSWRSLPEKAGLHRCGKSCRLRWTNYLRPDIKRGKFNLQEEQTIIQLHALLXNRWSAIATHLPKRTDNEIKNYWNTHLKKRLVXMGIDPVTHKPXNET

SEQ ID NO: 3138 - protein, 274 aa, Lycopersicon esculentum
  misc_feature (1)..(274): useful for making plants with increased nitrogen use efficiency as described in USSN 11/654,357
  misc_feature (1)..(274): Public GI no. 1430846
  misc_feature (1)..(274): Functional Homolog of  Ceres CLONE ID no. 154343 with e-value of 2.49E-64 and BLAST sequence percent identity of 67.7
MGRQPCCDKVGLKKGPWTAEEDKKLINFILNNGQCCWRAVPKLAGLLRCGKSCRLRWTNYLRPDLKRGLLSEYEEKMVIDLHAQLGNRWSKIASHLPGRTDNEIKNHWNTHIKKKLKKMGIDPITHKPLSTITIDHTNTLEQENQPIEEEKNQDILLAQMDIESSSIDQSTVAKIKSEDDNNNSNNNTMATNCTNNFDSTIVEVNNNGFCIDEVPLIEPHEILVQESTPSTSSSSFSSSSSSNILEDLKFLSSFDEWPLMENNNNNNVGIWMGN

SEQ ID NO: 3139 - protein, 114 aa, Triticum aestivum
  misc_feature (1)..(114): useful for making plants with increased nitrogen use efficiency as described in USSN 11/654,357
  misc_feature (1)..(114): Ceres CLONE ID no. 764797
  misc_feature (1)..(114): Functional Homolog of  Ceres CLONE ID no. 154343 with e-value of 5.09E-41 and BLAST sequence percent identity of 67.5
  misc_feature (74)..(74): Xaa is any aa, unknown or other
MGRSPCCEKEHTNKGAWTKEEDQRLVAYIRANGEGCWRSLPKAAGLLRCGKSCRLRWMNYLRPDLKRGNFTDDXDELIIRLHSLLGNKWSLIAGQLPGRTDNEIKNYWNTHIKR

SEQ ID NO: 3140 - protein, 118 aa, Triticum aestivum
  misc_feature (1)..(118): useful for making plants with increased nitrogen use efficiency as described in USSN 11/654,357
  misc_feature (1)..(118): Ceres CLONE ID no. 576284
  misc_feature (1)..(118): Functional Homolog of  Ceres CLONE ID no. 154343 with e-value of 1.89E-41 and BLAST sequence percent identity of 65.8
MGRSPCCEKAHTNKGAWTREEDERLVAHVRAHGEGCWRSLPGAAGLLRCGKSCRLRWINYLRPDLKRGNFTRDEDDLIVKLHSLLGNKWSLIAARLPGRTDNEIKNYWNTHIRRKLLG

SEQ ID NO: 3141 - protein, 265 aa, Triticum aestivum
  misc_feature (1)..(265): useful for making plants with increased nitrogen use efficiency as described in USSN 11/654,357
  misc_feature (1)..(265): Public GI no. 47680445
  misc_feature (1)..(265): Functional Homolog of  Ceres CLONE ID no. 154343 with e-value of 9.69E-47 and BLAST sequence percent identity of 65.4
MGRSPCCEKAHTNKGAWTKEEDDRLTAYIKAHGEGCWRSLPKAAGLLRCGKSCRLRWINYLRPDLKRGNFSDEEDELIIKLHSLLGNKWSLIAGRLPGRTDNEIKNYWNTHIRRKLTSRGIDPVTHRAINSDHAASNITISFETAQRDDKGAVFRRDAEPTKVAAAAAAITHVDHHHHHRSNPLHQMEWGQGKPLKCPDLNLDLCISPPSHEDPMVDTKPVVKREAVVGLCFSCSMGLPRSADCKCSSFMGLRTAMLDFRSIEMK

SEQ ID NO: 3142 - DNA, 813 bp, Populus balsamifera subsp. trichocarpa
  misc_feature (1)..(813): useful for making plants with increased nitrogen use efficiency as described in USSN 11/654,357
  misc_feature (1)..(813): Ceres ANNOT ID no. 1500277
atgggaaggcaaccttgctgtgacaaactcggggtcaagaaaggtccttggacagctgaagaggataaaaaactcattaacttcattctcaccaatggccaatgttgttggagggctgtccctaagctcgcaggactccgacgatgcggcaagagttgccggcttcgttggactaattatcttcgccctgacttgaagagagggcttcttacagaagcagaagaacagctggttattgatctccatgctcgtcttggcaataggtggtccaagattgctgctagattgccaggaaggacagacaatgagattaagaaccactggaacactcatataaagaagaagcttctgaagaggggaatcgatcctgttacacatgaaccgttacacaaagaagccaagcctgaggaaagctcatcatctcctgctgatcttttgccagaatccagtaacaacaatgatatgcaagaaaaggatggcatcgttattaactcggatgataattcaagatcaccgactgaaaattcttgtagtaccgaggattcgatcttgttagatagtatttgcaatgatgaaatgttactgaatagcttgtggatggatgagcctccgctagttgatgcatcatggaacaaaattattcctctggccgcagaaaatactaacaatgacatgggttatccatcatgggaggataactacacagggttatcggattgtcaagattttggcgttcacgatttcggattcgattgtttcgacaccattgaattaagcgcacttaacatattagagatggaactcaatcgctag

SEQ ID NO: 3143 - protein, 270 aa, Populus balsamifera subsp. trichocarpa
  misc_feature (1)..(270): useful for making plants with increased nitrogen use efficiency as described in USSN 11/654,357
  misc_feature (1)..(270): Ceres ANNOT ID no. 1500277
  misc_feature (1)..(270): Functional Homolog of  Ceres CLONE ID no. 154343 with e-value of 1.19E-78 and BLAST sequence percent identity of 63.2
MGRQPCCDKLGVKKGPWTAEEDKKLINFILTNGQCCWRAVPKLAGLRRCGKSCRLRWTNYLRPDLKRGLLTEAEEQLVIDLHARLGNRWSKIAARLPGRTDNEIKNHWNTHIKKKLLKRGIDPVTHEPLHKEAKPEESSSSPADLLPESSNNNDMQEKDGIVINSDDNSRSPTENSCSTEDSILLDSICNDEMLLNSLWMDEPPLVDASWNKIIPLAAENTNNDMGYPSWEDNYTGLSDCQDFGVHDFGFDCFDTIELSALNILEMELNR

SEQ ID NO: 3144 - protein, 294 aa, Petunia x hybrida
  misc_feature (1)..(294): useful for making plants with increased nitrogen use efficiency as described in USSN 11/654,357
  misc_feature (1)..(294): Public GI no. 68052409
  misc_feature (1)..(294): Functional Homolog of  Ceres CLONE ID no. 154343 with e-value of 6.49E-73 and BLAST sequence percent identity of 59.6
MGRQPCCDKLGVKKGPWTAEEDKKLISFILTNGQCCWRAVPKLAGLKRCGKSCRLRWTNYLRPDLKRGLLSDAEEKLVIDLHSRLGNRWSKIAARLPGRTDNEIKNHWNTHIKKKLLKMGIDPVTHEPLKKEANLSDQPTTESDQNKENGHQQVQVVPQSTNVTAAAATSTEFDNNSSFSSSASSSENSSCTTDESKLVFDNLSENDPLLSCLLEADTPLIDSPWEFPMSSTTTVEEPKSFDSIISNMTSWEDTFNWLSGYQEFGINDFGFDNCFNHVELDIFKTIDNVENRHG

SEQ ID NO: 3145 - protein, 262 aa, Oryza sativa subsp. japonica
  misc_feature (1)..(262): useful for making plants with increased nitrogen use efficiency as described in USSN 11/654,357
  misc_feature (1)..(262): Public GI no. 50948253
  misc_feature (1)..(262): Functional Homolog of  Ceres CLONE ID no. 154343 with e-value of 1.60E-62 and BLAST sequence percent identity of 58.4
MGRQPCCDKKKVKRGPWTAEEDKKLISFILTHGRCCWRAVPKLAGLLRCGKSCRLRWTNYLRPDLKRGLLTADEEQLVVDLHAKLGNRWSKIAAKLPGRTDNEIKNHWNTHIKKKLIKMGIDPATHQPLPNTKVVSQTRTSTLSTATTESAKSNGMAYPFDPEGGCSRDMSVPTDSMEQSSRNTSSHGLDPLVNWLLEAELPADEPWLNFTSSNEDDFSGIVKQSAWDGSTTDWLLDYQDFSMDDSSLIDGARVQNSDGLNF

SEQ ID NO: 3146 - protein, 285 aa, Oryza sativa subsp. japonica
  misc_feature (1)..(285): useful for making plants with increased nitrogen use efficiency as described in USSN 11/654,357
  misc_feature (1)..(285): Public GI no. 50725788
  misc_feature (1)..(285): Functional Homolog of  Ceres CLONE ID no. 154343 with e-value of 1.30E-65 and BLAST sequence percent identity of 57.2
MGRQPCCDKLGVKRGPWTAEEDKKLMSFILTNGHCCWRAVPKLAGLLRCGKSCRLRWTNYLRPDLKRGLLTDAEEQLVIDLHAKLGNRWSKIAAKLPGRTDNEIKNHWNTHIKKKLIKMGIDPVTHEPLDRKQESPATTSQSTVTAESSKSGEATRQQSRQLDDAVVRDMSVSAGGDSPPESSTNTASTAGGSSSSSSSHHQDPLVKWLLEEDLLPTGDEPWLNFTASNDVDEFSSIAATGATPALPWDVGMTTDWLLDYQDFGMGDSSLVVDASMVNSSNGSNF

SEQ ID NO: 3147 - DNA, 933 bp, Zea mays
  misc_feature (1)..(933): useful for making plants with increased nitrogen use efficiency as described in USSN 11/654,357
  misc_feature (1)..(933): Ceres CLONE ID no. 346992
  misc_feature (1)..(933): Also Known As Ceres ME10738
  misc_feature (1)..(933): Also Known As Ceres  LEAD Number 85
  misc_feature (378)..(519): CDS
cgtcttcgcagaagcagcaggaggactcgtcgtctgtctaggccctctgacatggagatggtgcgcagaagccagaagcagttcggttagctgttcccgctccgcctaatctgcaatatatagctgttgcacgtccgaccaagtggttgtagatacagtaacttctggcatcaagtcggccagtgacacatccagtaccagctgtagccagcattcatgcatgccagaacgtagtactgcggccatcgcccccatcgtcaccatgatgatttttttctggtaaatctgcggtcagcagaaggttgggtaaggcgaatggtctcttacccaattcgcccagctggcgaatcttaatattctaaaaagttttgggtttccatgcaaaataggcaggccacgtttaccagcaagcctccctcgtcggatcgagggaaaaagaaatacgggacgttcgatttacaacttttacctatactaggacaatgctcatgcgttgcaatgaaaacatataatattacataacttatgaacaaatgtgtattatactgttatgagatagaagatggtgtccttgagctgttcgggatgacgtcgaagcgaaactcagaccacggtcgagcgccaagcctgcggtgcgaggtcgcccgtctacgaggcacgcgaggtggagggtggcagtctcgggaaggaggcaatctccgagggacggtggtggagtagcgacacgcagtcgagaaggtgtacgtgggagccggcggatggacgacacagcgggcggtagagcagcgtcggggtcggtgtccgatggagcttcacgctgcggcgacggaagggagaggcaggtatatgcacgtgcgttgctacgaaatcaatatgataaaatacattgatatacaaaaactctaattgttattctatacttttattagcgtt

SEQ ID NO: 3148 - protein, 47 aa, Zea mays
  misc_feature (1)..(47): useful for making plants with increased nitrogen use efficiency as described in USSN 11/654,357
  misc_feature (1)..(47): Ceres CLONE ID no. 346992
  misc_feature (1)..(47): Also Known As Ceres ME10738
  misc_feature (1)..(47): Also Known As Ceres  LEAD Number 85
MQNRQATFTSKPPSSDRGKKKYGTFDLQLLPILGQCSCVAMKTYNIT

SEQ ID NO: 3149 - DNA, 585 bp, Glycine max
  misc_feature (1)..(585): useful for making plants with increased nitrogen use efficiency as described in USSN 11/654,357
  misc_feature (1)..(585): Ceres CLONE ID no. 560731
  misc_feature (1)..(585): Also Known As Ceres ME08309
  misc_feature (1)..(585): Also Known As Ceres  LEAD Number 92
  misc_feature (128)..(512): CDS
aatatgttgctactcatcactcactctcatcaccaacattttttaacagtcatttggaattatatcaccttacctctgatgttttaaaaatcttcatcatttgctccctctccacccttaaactggacatgctcgattctgtgcttctggcgcttttcttgccgtgcctcggcatgagcgccgttttcatcgtctacatgtgccttctctggtacgccaccaaccaccactccgaccccgcgctaccggccaagcctgtctccgacaccggaatctccccttcccagctcgacaagctccccagaatcaccggaaaggaccttctcatgggaaacgaatgcgccgtctgcctggacgagatcggaacagagcaaccggttcgggtggttcccggttgcaaccacgccttccatttggaatgcgccgacacctggctctccaagcaccctctctgccctctctgcagagccaaactcgacccttcgcttttctcttcttcccaaaatccatgctgaccaacaagctctagcgcaaagttggtagatgcatgacccagtttcttaaatatttcttgactgtatatac

SEQ ID NO: 3150 - protein, 128 aa, Glycine max
  misc_feature (1)..(128): useful for making plants with increased nitrogen use efficiency as described in USSN 11/654,357
  misc_feature (1)..(128): Ceres CLONE ID no. 560731
  misc_feature (1)..(128): Also Known As Ceres ME08309
  misc_feature (1)..(128): Also Known As Ceres  LEAD Number 92
  misc_feature (71)..(112): Pfam Name: zf-C3HC4; Pfam Description: Zinc finger, C3HC4 type (RING finger)
MLDSVLLALFLPCLGMSAVFIVYMCLLWYATNHHSDPALPAKPVSDTGISPSQLDKLPRITGKDLLMGNECAVCLDEIGTEQPVRVVPGCNHAFHLECADTWLSKHPLCPLCRAKLDPSLFSSSQNPC

SEQ ID NO: 3151 - DNA, 405 bp, Populus balsamifera subsp. trichocarpa
  misc_feature (1)..(405): useful for making plants with increased nitrogen use efficiency as described in USSN 11/654,357
  misc_feature (1)..(405): Ceres ANNOT ID no. 1506045
atgcttgtctctgtgtttttggcacttttcctaccatgcgcaggcatgagcgctgtgtttattgtctatatctgtctcttgtggtatactgctaataatcagccagagattcgtttgcctgtaaagactgtgacagagaagggattgtcttcttcggagttagagaagttgcctaaggttaccgggaaagagcttgtcttggggactgaatgtgctgtttgtcttgatgacattgaaagtgaacaggtggctaggatggttcctggctgcaatcatgggtttcatttggaatgtgctgatacttggcttactaagcgtcctgtttgtcctgtttgtagggccaagcttgatgctcagctcttcagcacccctcctcctcctgctcaagagaacaatacttgttag

SEQ ID NO: 3152 - protein, 119 aa, Populus balsamifera subsp. trichocarpa
  misc_feature (1)..(119): useful for making plants with increased nitrogen use efficiency as described in USSN 11/654,357
  misc_feature (1)..(119): Ceres ANNOT ID no. 1506045
  misc_feature (1)..(119): Functional Homolog of  Ceres CLONE ID no. 560731 with e-value of 4.70E-38 and BLAST sequence percent identity of 63.3
MSAVFIVYICLLWYTANNQPEIRLPVKTVTEKGLSSSELEKLPKVTGKELVLGTECAVCLDDIESEQVARMVPGCNHGFHLECADTWLTKRPVCPVCRAKLDAQLFSTPPPPAQENNTC

SEQ ID NO: 3153 - DNA, 402 bp, Populus balsamifera subsp. trichocarpa
  misc_feature (1)..(402): useful for making plants with increased nitrogen use efficiency as described in USSN 11/654,357
  misc_feature (1)..(402): Ceres ANNOT ID no. 1495397
atgcttgtctctgtgcttttcgcactttttctgccatgtgtaggtatgagcgtagtgttttttatctatatttgtctcctatggtatgctgctaataatcaaccagagaacattcctttaccggtaaaaactgtgacagagaagggtttgtcatcatcggagctcgagaagttgcctaaggtcaccgggaaagagcttgttttggggacagagtgtgctgtttgtctagatgacattgaaagtgaacagctggctaggatagttcctggctgcaatcatgggtttcatctggaatgtgctgatacttggctttccaagcaccctgtttgtcctgtttgtcgggcaaagcttgatgctcagttctccagtacttctgcttctccagagaacaatccttgttga

SEQ ID NO: 3154 - protein, 118 aa, Populus balsamifera subsp. trichocarpa
  misc_feature (1)..(118): useful for making plants with increased nitrogen use efficiency as described in USSN 11/654,357
  misc_feature (1)..(118): Ceres ANNOT ID no. 1495397
  misc_feature (1)..(118): Functional Homolog of  Ceres CLONE ID no. 560731 with e-value of 1.59E-37 and BLAST sequence percent identity of 62.5
MSVVFFIYICLLWYAANNQPENIPLPVKTVTEKGLSSSELEKLPKVTGKELVLGTECAVCLDDIESEQLARIVPGCNHGFHLECADTWLSKHPVCPVCRAKLDAQFSSTSASPENNPC

SEQ ID NO: 3155 - protein, 136 aa, Arabidopsis thaliana
  misc_feature (1)..(136): useful for making plants with increased nitrogen use efficiency as described in USSN 11/654,357
  misc_feature (1)..(136): Ceres CLONE ID no. 4267
  misc_feature (1)..(136): Also known as Ceres ME02730
  misc_feature (1)..(136): Functional Homolog of  Ceres CLONE ID no. 560731 with e-value of 2.20E-31 and BLAST sequence percent identity of 50.7
MIATVFMALLLPCVGMCIVFLIYLFLLWCSTRRRIERLRFAEPVKPVAGKGLSVLELEKIPKLTGRELAVIARSTECAVCLEDIESGQSTRLVPGCNHGFHQLCADTWLSNHTVCPVCRAELAPNLPQCNENQSPC

SEQ ID NO: 3156 - DNA, 432 bp, Arabidopsis thaliana
  misc_feature (1)..(432): useful for making plants with increased nitrogen use efficiency as described in USSN 11/654,357
  misc_feature (1)..(432): Ceres ANNOT ID no. 566305
  misc_feature (1)..(432): Also Known As Ceres ME10822
  misc_feature (1)..(432): Also Known As Ceres  LEAD Number 93
  misc_feature (1)..(429): CDS
atgaggaagaaacgagaggctaaagatgaaaatgaagaagaagaagaggagaagaagaagagactagagttgatgaaggcagctgcgcaggcttggctcagccactcccaaacctcaaaacatactgttttagagttcgatgcgcagagaaagcatgcttttgtcaaagggaaggcatcacgtttcaaaacggaagccttgtccgcaaagcatcatccgtcgtttttggattgggaattcggacagtcgctgtgggatccctacgagattctttcggtctctaagaaactggaacgcgaactcactttagaagaacaaaccttctcttcttcagataatgatggcctcaagaagatgaagaagaagaaaactagagacagcagaaacagccttaggagtttgttcactcgttcgtcttcaaagagattctaa

SEQ ID NO: 3157 - protein, 143 aa, Arabidopsis thaliana
  misc_feature (1)..(143): useful for making plants with increased nitrogen use efficiency as described in USSN 11/654,357
  misc_feature (1)..(143): Ceres ANNOT ID no. 566305
  misc_feature (1)..(143): Also Known As Ceres ME10822
  misc_feature (1)..(143): Also Known As Ceres  LEAD Number 93
MRKKREAKDENEEEEEEKKKRLELMKAAAQAWLSHSQTSKHTVLEFDAQRKHAFVKGKASRFKTEALSAKHHPSFLDWEFGQSLWDPYEILSVSKKLERELTLEEQTFSSSDNDGLKKMKKKKTRDSRNSLRSLFTRSSSKRF

SEQ ID NO: 3158 - DNA, 777 bp, Arabidopsis thaliana
  misc_feature (1)..(777): useful for making plants with increased nitrogen use efficiency as described in USSN 11/654,357
  misc_feature (1)..(777): Ceres CLONE ID no. 14432
  misc_feature (1)..(777): Also Known As Ceres ME07523
  misc_feature (1)..(777): Also Known As Ceres  LEAD Number 98
  misc_feature (85)..(553): CDS
ccttttccccttctaatctctctcgcatctctacattttgagatcattttaaattgtcctctcttttattttccggttaagcaccatgatgtctactatttccccggttttctcaaccgaaccgggtctattaacctctgtcctcccagcttttgaaaccagtttcactccatgggacatttcacacctcttctcggtcttcgattcatcaatcgatccaaaaccggtttcgacccatgactatggttcagtaaaccagatcggttcagacatgtctccgaccgacaataccgacgagcggaaaaagaaacggaaattatcgaaccgggaatcggctaagcggtcaagagagaagaaacaaaagcacttggaggagatgagtatccagctaaaccaactcaaaattcagaaccaagaattgaagaaccagcttcggtacgttttataccattgtcaacgaacgaagatggaaaatgatcgtctacttatggagcaccgtatactgcatgataagttgttgaacatcagacaagttttgatgtttcgtcaaacctaacgaagctcatcaaactgtgccacttggccttgtaataacagtactgttgttacggtccagcaagatccgtcgatcatgttatcataagttgaggtttctgaaattgtttcgacggtaaaatgggaacaatttgtaaaaacaattattgaaaaatgcatggatatacgttatcaaattagatttcgttttttatatattaataaataaataaataattaatt

SEQ ID NO: 3159 - protein, 156 aa, Arabidopsis thaliana
  misc_feature (1)..(156): useful for making plants with increased nitrogen use efficiency as described in USSN 11/654,357
  misc_feature (1)..(156): Ceres CLONE ID no. 14432
  misc_feature (1)..(156): Also Known As Ceres ME07523
  misc_feature (1)..(156): Also Known As Ceres  LEAD Number 98
  misc_feature (68)..(132): Pfam Name: bZIP_1; Pfam Description: bZIP transcription factor
MMSTISPVFSTEPGLLTSVLPAFETSFTPWDISHLFSVFDSSIDPKPVSTHDYGSVNQIGSDMSPTDNTDERKKKRKLSNRESAKRSREKKQKHLEEMSIQLNQLKIQNQELKNQLRYVLYHCQRTKMENDRLLMEHRILHDKLLNIRQVLMFRQT

SEQ ID NO: 3160 - DNA, 552 bp, Populus balsamifera subsp. trichocarpa
  misc_feature (1)..(552): useful for making plants with increased nitrogen use efficiency as described in USSN 11/654,357
  misc_feature (1)..(552): Ceres ANNOT ID no. 1470809
atggccagcaacccatttcagtccttcgagaacggctttacgccttgggactgtttcgaccccttttcaagctctcctcagtcaccaaaacctgttggttcgagttccggttcggataaatccaaccaggcaggccaaaaccctgacaactcgaactcaaactctggttccgacgacccaaaccctcaagcttcactcatagatgagaggaaacgcaggcggatggtatcaaaccgggagtcggcaaggcggtcacggatgcgaaagcagaagcacgtagaaaacctaaggaaccaggtgaaccggcttaggattgagaaccgggaactgacgaaccggttgcgctttgttttgtaccattcccatggtgtacggacagactacgaccgactccggtctgagtatagtacgctccgaaaaaagctgtcggacatacgccaaattttgatgatgaggcaactccaagaattgacgtccgcgtggccatgcaataatatgattaccaccaccaccaccaccgaacaaatagctccatcattaatcacttcataa

SEQ ID NO: 3161 - protein, 109 aa, Populus balsamifera subsp. trichocarpa
  misc_feature (1)..(109): useful for making plants with increased nitrogen use efficiency as described in USSN 11/654,357
  misc_feature (1)..(109): Ceres ANNOT ID no. 1470809
  misc_feature (1)..(109): Functional Homolog of  Ceres CLONE ID no. 14432 with e-value of 9.40E-17 and BLAST sequence percent identity of 53.8
MVSNRESARRSRMRKQKHVENLRNQVNRLRIENRELTNRLRFVLYHSHGVRTDYDRLRSEYSTLRKKLSDIRQILMMRQLQELTSAWPCNNMITTTTTTEQIAPSLITS

SEQ ID NO: 3162 - protein, 61 aa, Parthenium argentatum
  misc_feature (1)..(61): useful for making plants with increased nitrogen use efficiency as described in USSN 11/654,357
  misc_feature (1)..(61): Ceres CLONE ID no. 1604429
  misc_feature (1)..(61): Functional Homolog of  Ceres CLONE ID no. 14432 with e-value of 9.90E-6 and BLAST sequence percent identity of 52.5
MTSPKQKQIANLVSDGDLRYANLDERKRKRMISNRESARRSRAKKQQRLDELLGEISNYRM

SEQ ID NO: 3163 - protein, 426 aa, Pennisetum glaucum
  misc_feature (1)..(426): useful for making plants with increased nitrogen use efficiency as described in USSN 11/654,357
  misc_feature (1)..(426): Public GI no. 21435101
  misc_feature (1)..(426): Functional Homolog of  Ceres CLONE ID no. 14432 with e-value of 4.79E-9 and BLAST sequence percent identity of 51.3
MDDHANSMEEIIIPDPFWEDLPPPPEPPLVVSDGFTDGVVTNGGGEGTGATDQNQSPSEWSFERLLEEELLIDATPLENFSGSAPHADTTVVDEVDRATTMVPAAVSTVGDPMEYNNILKRKLDEDLATVAMWRASSVVHLEHSQDSNNHIGGDKNFVQNMLSISDSPIKRVRNTYSRARLASSSSSRDPSPSDDDDMDGEVEILGFNMPTEEKMRKRKESNRESARRSRYRKAAHLKEMEDQVAQLKVENSSLLRRLATLNQKYTDATVDNRVLKANMETLRTKVNMAEDALKRITGTMSSSQPLSRPSPLVPAAANADASGHILDNIIIDYLMNSTDATIDHSFELRTTAPPAPAFSQAETPAVGTNSAMISRMAAHHAVAVELLHKRLGGGAMPPATTFSGVAPPETAALPSDVVESTDMGIH

SEQ ID NO: 3164 - protein, 151 aa, Glycine max
  misc_feature (1)..(151): useful for making plants with increased nitrogen use efficiency as described in USSN 11/654,357
  misc_feature (1)..(151): Ceres CLONE ID no. 648620
  misc_feature (1)..(151): Functional Homolog of  Ceres CLONE ID no. 14432 with e-value of 4.90E-20 and BLAST sequence percent identity of 44.3
MPWDGLDSLGFKPTSPNPVTSSSGSGYPNRTHAEEKPASDKSNHVTSVMEERKRRRMISNRESARRSRIRKQRHLENLRNQMNLFRVENRKLNNGLQFLLHHCNRLRTENEWLLSERPMLRQKLANINQILLFRHLQPFSSAWPCNIVLAE

SEQ ID NO: 3165 - protein, 193 aa, Phaseolus vulgaris
  misc_feature (1)..(193): useful for making plants with increased nitrogen use efficiency as described in USSN 11/654,357
  misc_feature (1)..(193): Public GI no. 13430400
  misc_feature (1)..(193): Functional Homolog of  Ceres CLONE ID no. 14432 with e-value of 1.90E-9 and BLAST sequence percent identity of 41.7
MVPSEIRGVNYLAPENPFLVPPNFGLLQNDIPNLHLNTLLSNFPNCHFPPSGLEFVAPHSCLSSNSTSDEADEIQFNIIDERKHRRMISNRESARRSRMRKQKHLDELWSQVVRLRTENHNLIDKLNHMSDSHDRVLQENTRLKEEASDLRQMLADMQIGTSFACTMEELEDLPCNKPGPSNQLITPADMIHE

SEQ ID NO: 3166 - protein, 139 aa, Craterostigma plantagineum
  misc_feature (1)..(139): useful for making plants with increased nitrogen use efficiency as described in USSN 11/654,357
  misc_feature (1)..(139): Public GI no. 72398495
  misc_feature (1)..(139): Functional Homolog of  Ceres CLONE ID no. 14432 with e-value of 5.10E-9 and BLAST sequence percent identity of 39.7
MATNPRSTSPLSDIDGERQRKRKLSNRESARRSRMRKQQRLDELTAQATQLKEENKKLREMIDGSNQLYLSAASENSVLRAQAAELADRLKSLNTLLRIASDVSGLAFDIPDVPDALAEPWQMPCAVLPVAASADMFQY

SEQ ID NO: 3167 - protein, 139 aa, Craterostigma plantagineum
  misc_feature (1)..(139): useful for making plants with increased nitrogen use efficiency as described in USSN 11/654,357
  misc_feature (1)..(139): Public GI no. 72398497
  misc_feature (1)..(139): Functional Homolog of  Ceres CLONE ID no. 14432 with e-value of 5.10E-9 and BLAST sequence percent identity of 39.7
MATNPRSTSPLSDIDGERQRKRKLSNRESARRSRMRKQQRLDELTAQATQLKEENKKLREMIDGSNQLYLSVASENSVLRAQATELADRLKSLNALLRVASDVSGLAFDIPDVPDALAEPLQMPCSVLPITASADMFQY

SEQ ID NO: 3168 - protein, 193 aa, Phaseolus acutifolius
  misc_feature (1)..(193): useful for making plants with increased nitrogen use efficiency as described in USSN 11/654,357
  misc_feature (1)..(193): Public GI no. 12829956
  misc_feature (1)..(193): Functional Homolog of  Ceres CLONE ID no. 14432 with e-value of 3.10E-9 and BLAST sequence percent identity of 39.0
MVPSEIRGVHYLAPENPFLVPPNFGLLQNDIPNLHLNTLLSNFPNCHFPPSGLEFVAPHSCLSSNSTSDEADEIQFNIIDERKHRRMISNRESARRSRMRKQKHLDELWSQVVRLRTENHNLIDKLNHMSDSHDRVLQKNTRLKEEASDLRQMLADMQIGISFACTMEELEDLPCNKPGPSNQLITPADMIHE

SEQ ID NO: 3169 - protein, 157 aa, Secale cereale
  misc_feature (1)..(157): useful for making plants with increased nitrogen use efficiency as described in USSN 11/654,357
  misc_feature (1)..(157): Public GI no. 40019253
  misc_feature (1)..(157): Functional Homolog of  Ceres CLONE ID no. 14432 with e-value of 6.50E-9 and BLAST sequence percent identity of 39.0
MSSSSLSPGGGRLSGSDGDSGATFVAGDNRREKRRLSNRESARRSRLRKQQHLDELVQEVARLKAENARVLARANDITSQFVRVDQENTVLRARAAELGDRLRSVNQVLRVVEEFSGVAMDIQEECPPDDPLLRPWQIPYPATAMPIAATATHMLQY

SEQ ID NO: 3170 - DNA, 1894 bp, Arabidopsis thaliana
  misc_feature (1)..(1894): useful for making plants with increased nitrogen use efficiency as described in USSN 11/654,357
  misc_feature (1)..(1894): In planta sequence for Ceres CLONE ID no. 150823
  misc_feature (1)..(1894): Also Known As Ceres ME03926
  misc_feature (1)..(1894): Also Known As Ceres  LEAD Number 112
  misc_feature (80)..(1628): CDS
cacaaagcagcttctgcaacctattcgttggttggttaatagaagctctctttctctgtctgtctttctctctcagagaaatggctcttcttctagtttcttcttcctcctcctatgccctcagagtcaccattttcttgtctttcttcttctttctctgcaatggcttctcttaccctactacttcttctcttttcaacacccatcaccatcgtcaccacttggccaagcacaactacaaagatgctctcactaaatcaatcctcttctttgaaggccaaaggtcagggaaacttccttctaaccagagaatgagttggagaagagactctggtctctctgatggctctgctcttcatgtggatttggttggagggtactatgatgcaggagacaatatcaaatttggattcccaatggcattcacaaccacaatgctttcatggagtgtaattgaattcggtggactcatgaaatctgagttacaaaacgctaaaatagcgattcgttgggctactgattatctcctcaaagccacttcacaacctgacacaatctatgttcaagttggtgatgctaataaagaccattcttgttgggaaagaccagaagacatggatactgtaagaagtgtgtttaaagttgacaagaacactcctggttctgatgtcgccgctgaaaccgccgccgctctagccgccgccgccattgtattcagaaaatctgatccttcttactccaaagtcctcctcaaacgagccatcagtgtttttgcatttgcggacaaatacagaggaacttatagtgcaggattaaaacctgatgtttgtccattttattgctcttactctggttatcaggatgaattgttgtggggagctgcttggttacaaaacgcgacaaagaatttaaaatatttgaattacataaaaatcaatggacaaatccttggagctgctgaatatgataacacttttggttgggataacaagcacgctggtgccagaatccttcttacaaaggcatttttggttcagaatgtgaagacacttcatgaatacaaaggtcatgctgataatttcatctgctctgttattcctggagctcctttctcttctactcagtatacaccaggtggattattgtttaaaatggcagacgccaacatgcaatacgtgacgtcaacatcgttcttgctcttaacctatgccaaatacttaacctccgccaaaaccgtcgtccattgcggtggctccgtctacactcccggtcgtcttcgctccatcgccaaaagacaggtggattatctacttggagacaacccattaagaatgtcttacatggttggttacggtccaaaattcccacggagaatccaccaccgtggctcctcattaccttgtgttgcaagccacccggccaagatccaatgccaccaagggtttgcaatcatgaactctcaatctccaaaccctaacttccttgttggtgtagtcgttggtggtcccgaccagcatgatcgcttcccagacgaacggtctgattacgagcagtccgagccggctacttacatcaattcaccactcgttggagctcttgcctatttcgctcacgcctatggtcaactctagtttagtaacgacgagtgtgttagtttaagtaaaaataaaaatgaaggaagttttttctttatttttacttttatttgttagtaatgtagtggaccgaaaatcggatcacaagaggacattggtccgagggatggtttatttggttcgttataatataacgtcaagtgtaatcttattgtggttattaatgttatcatcctattaattactatatccatgtcgttaatttttgatatgtttatatgatttttcatatttttgtg

SEQ ID NO: 3171 - protein, 516 aa, Arabidopsis thaliana
  misc_feature (1)..(516): useful for making plants with increased nitrogen use efficiency as described in USSN 11/654,357
  misc_feature (1)..(516): Translation of theoretical sequence of Ceres CLONE ID no. 150823
  misc_feature (52)..(509): Pfam Name: Glyco_hydro_9; Pfam Description: Glycosyl hydrolase family 9
  misc_feature (105)..(105): Xaa is any aa, unknown or other
MALLLVSSSSSYALRVTIFLSFFFFLCNGFSYPTTSSLFNTHHHRHHLAKHNYKDALTKSILFFEGQRSGKLPSNQRMSWRRDSGLSDGSALHVDLVGGYYDAGXNIKFGFPMAFTTTMLSWSVIEFGGLMKSELQNAKIAIRWATDYLLKATSQPDTIYVQVGDANKDHSCWERPEDMDTVRSVFKVDKNTPGSDVAAETAAALAAAAIVFRKSDPSYSKVLLKRAISVFAFADKYRGTYSAGLKPDVCPFYCSYSGYQDELLWGAAWLQNATKNLKYLNYIKINGQILGAAEYDNTFGWDNKHAGARILLTKAFLVQNVKTLHEYKGHADNFICSVIPGAPFSSTQYTPGGLLFKMADANMQYVTSTSFLLLTYAKYLTSAKTVVHCGGSVYTPGRLRSIAKRQVDYLLGDNPLRMSYMVGYGPKFPRRIHHRGSSLPCVASHPAKIQCHQGFAIMNSQSPNPNFLVGAVVGGPDQHDRFPDERSDYEQSEPATYINSPLVGALAYFAHAYGQL

SEQ ID NO: 3172 - DNA, 1563 bp, Populus balsamifera subsp. trichocarpa
  misc_feature (1)..(1563): useful for making plants with increased nitrogen use efficiency as described in USSN 11/654,357
  misc_feature (1)..(1563): Ceres ANNOT ID no. 1444694
atggcttgcgctaatttctctttcacatttctagtcctctgctcttgttttgctacttcttttattgcatgccatggctttcccgtccatcacaacaacccattccaccaccgccgccaccctcgctttgccagtcataactacagagatgccctgaccaaatcaatcctctttttcgaaggccaaaggtctggtaagctcccttctagccagaggatgacatggaggagagactcgggtctaacagatggctcaaccatgcatgtggatttggtgggaggttattatgatgcaggagacaatgtgaagtttggattccctatggctttcactacaaccatgctttcatggagtgttttagagttcggggggttgatgaaaggtgagctgcagaacgctagagaagccattcgttgggcaactgattacctcctcaaagctacagcccatacagacaccatctatgttcaggtaggtaacgctaataaggaccatgcttgttgggagagaccagaagatatggatactccaaggagtgttttcaaggttgacaagcattcccctggttctgatgttgctgctgaaactgctgctgctcttgcagctgcgtctttggtgtttagaagatgtgaccccacttatgccaagcttttggtcaggagagctatcagggtgttccaatttgctgataagtacagaggagcctacagcaatggactgaagagatttgtttgccctttctattgctcctattctggatatgaggatgagctgctgtggggtgctgcttggctgcataaggcgaccaagaatccaacttatctcaattacattcaagttaacggacagaatcttggagctgcacagtttgacaatacctttggttgggataacaagcatgttggtgcaaggattcttctttccaaggcatttcttgttcaaaaactgcaatccctccatgactacaaaggacatgcagataatttcatctgttctctcataccaggggcccctttctcttcagcccaatatacaccaggcgggctgctgttcaaaatgagtgatagcaacatgcaatacgtcacctcaacttcattcttgctcttaacctatgccaagtacttgacctctgctcgcacggttgtaaactgtggtggaaccgttgtcactccaaagaggctacgaaccattgccaagaaacaggtggactatctacttggagacaacccattgaaaatgtcctacatggtggggtatggtccaaggtatccacaaaggattcaccacaggggctcatctctaccgtcaatcgctacacacccaggaaagatccaatgcacctcaggctttagtgtgatgaattctcaatccccaaaccccaacgttcttgtgggtgcgatagttggagggccagacgaacatgacaggttcccagatgaaagatcagactatgagcaatctgaaccagctacttacattaacgcacccctggtaggagcattggcttatctcgcgcactcttccggccagctcgaagtcctagcagcatctccaatttgttag

SEQ ID NO: 3173 - protein, 448 aa, Populus balsamifera subsp. trichocarpa
  misc_feature (1)..(448): useful for making plants with increased nitrogen use efficiency as described in USSN 11/654,357
  misc_feature (1)..(448): Ceres ANNOT ID no. 1444694
  misc_feature (1)..(448): Functional Homolog of  Ceres CLONE ID no. 150823						  with e-value of 1.59E-204 and percent identity of 81.7
MTWRRDSGLTDGSTMHVDLVGGYYDAGDNVKFGFPMAFTTTMLSWSVLEFGGLMKGELQNAREAIRWATDYLLKATAHTDTIYVQVGNANKDHACWERPEDMDTPRSVFKVDKHSPGSDVAAETAAALAAASLVFRRCDPTYAKLLVRRAIRVFQFADKYRGAYSNGLKRFVCPFYCSYSGYEDELLWGAAWLHKATKNPTYLNYIQVNGQNLGAAQFDNTFGWDNKHVGARILLSKAFLVQKLQSLHDYKGHADNFICSLIPGAPFSSAQYTPGGLLFKMSDSNMQYVTSTSFLLLTYAKYLTSARTVVNCGGTVVTPKRLRTIAKKQVDYLLGDNPLKMSYMVGYGPRYPQRIHHRGSSLPSIATHPGKIQCTSGFSVMNSQSPNPNVLVGAIVGGPDEHDRFPDERSDYEQSEPATYINAPLVGALAYLAHSSGQLEVLAASPIC

SEQ ID NO: 3174 - DNA, 1533 bp, Populus balsamifera subsp. trichocarpa
  misc_feature (1)..(1533): useful for making plants with increased nitrogen use efficiency as described in USSN 11/654,357
  misc_feature (1)..(1533): Ceres ANNOT ID no. 1525054
atggctctctctgtttcctctttcacacttctagtcctcttctcttgtttcgctacttttcttgtatgccatggctttcctgtccatcacaacaacccatttcaccaccgccgccaccctcgctttgccagtcacaactacagagatgccctgacgaaatcaatcctcttctttgaaggccaaaggtcaggcaagctcccttctagccagaggatcacatggaggagagactctggcctaacagatggctcagccatgcatgtggatttggtgggagggtactatgatgcaggagacaatgtgaagtttgggttccctatggctttcactactaccatgctttcatggagtgtattagagtttggtgggttgatgaaaggtgagctgcagaacgctagagaagccattcgttgggcaactgattacctcctcaaagctacagcccatccagacaccatctatgttcaggttggtgatgctaataaggaccatgcttgttgggagagaccagaagatatggatactccaaggagtgtttacaaggtagacaagaattcccctggttctgaagttgctgctgaaactgcggctgctcttgcagctgcttctttggtgtttagaaggtgtgaccccacttatgccaagcttttggtcagaagagctatcagggtgttccaatttgcagataagtaccgaggagcctacagcaatgggttgaagaaatatgtttgccctttctattgctcctactctggatatgaggatgagctgttgtggggtgctgcttggctgcataaggcgaccaagaacccaacttatctcaattacattcaagttaatgggcagactcttggagctgcacaatttgacaatacctttggttgggataacaagcatgttggagcaaggattcttctttccaaggcatttcttgttcaaaaagtgcaatccctccatgactacaaagatcatgcagataattttatctgctctctcatacaaggggcccctttctcttcagcccaatatactccaggtggtctgctgttcaaaatgaatgacagcaacatgcagtatgtgacttccacttcattcttgctcttatcgtatgccaagtacttaacctatgctcgcaagattgtaaactgtggtgtgaccgctgtcactccgaagaggctaagaaatattgcaaagaaacaggtggactatctgctaggagacaacccattgaaaatgtcctacatggtggggtatggtccaaggtatccacagaggattcaccacaggggctcatctctaccgtcgatggctgcacacccagcaaagatccaatgctcctcgggtttcagtgtaatgaattctcaatcccccaacccgaacattcttgtgggtgcaatagtcggagggccagacgaacacgataggttcccagatgaaagatcagactatgagcaatccgagcctgctacttacatgaacgcgcccctagtaggggcactggcttatcttgctcactcatttggccagctctaa

SEQ ID NO: 3175 - protein, 425 aa, Populus balsamifera subsp. trichocarpa
  misc_feature (1)..(425): useful for making plants with increased nitrogen use efficiency as described in USSN 11/654,357
  misc_feature (1)..(425): Ceres ANNOT ID no. 1525054
  misc_feature (1)..(425): Functional Homolog of  Ceres CLONE ID no. 150823 with e-value of 4.30E-195 and BLAST sequence percent identity of 80.4
MHVDLVGGYYDAGDNVKFGFPMAFTTTMLSWSVLEFGGLMKGELQNAREAIRWATDYLLKATAHPDTIYVQVGDANKDHACWERPEDMDTPRSVYKVDKNSPGSEVAAETAAALAAASLVFRRCDPTYAKLLVRRAIRVFQFADKYRGAYSNGLKKYVCPFYCSYSGYEDELLWGAAWLHKATKNPTYLNYIQVNGQTLGAAQFDNTFGWDNKHVGARILLSKAFLVQKVQSLHDYKDHADNFICSLIQGAPFSSAQYTPGGLLFKMNDSNMQYVTSTSFLLLSYAKYLTYARKIVNCGVTAVTPKRLRNIAKKQVDYLLGDNPLKMSYMVGYGPRYPQRIHHRGSSLPSMAAHPAKIQCSSGFSVMNSQSPNPNILVGAIVGGPDEHDRFPDERSDYEQSEPATYMNAPLVGALAYLAHSFGQL

SEQ ID NO: 3176 - DNA, 1626 bp, Populus balsamifera subsp. trichocarpa
  misc_feature (1)..(1626): useful for making plants with increased nitrogen use efficiency as described in USSN 11/654,357
  misc_feature (1)..(1626): Ceres ANNOT ID no. 1471639
atggctctctctgtttcctctttcacacttctagtcctcttctcttgtttcgctacttttcttgtatgccatggctttcctgtccatcacaacaacccatttcaccaccgccgccaccctcgctttgccagtcacaactacagagatgccctgacgaaatcaatcctcttctttgaaggccaaaggtcaggcaagctcccttctagccagaggatcacatggaggagagactctggcctaacagatggctcagccatgcatgtggatttggtgggagggtactatgatgcaggagacaatgtgaagtttgggttccctatggctttcactactaccatgctttcatggagtgtattagagtttggtgggttgatgaaaggtgagctgcagaacgctagagaagccattcgttgggcaactgattacctcctcaaagctacagcccatccagacaccatctatgttcaggttggtgatgctaataaggaccatgcttgttgggagagaccagaagatatggatactccaaggagtgtttacaaggtagacaagaattcccctggttctgaagttgctgctgaaactgcggctgctcttgcagctgcttctttggtgtttagaaggtgtgaccccacttatgccaagcttttggtcagaagagctatcagggtgttccaatttgcagataagtaccgaggagcctacagcaatgggttgaagaaatatgtttgccctttctattgctcctactctggatatgaggatgagctgttgtggggtgctgcttggctgcataaggcgaccaagaacccaacttatctcaattacattcaagttaatgggcagactcttggagctgcacaatttgacaatacctttggttgggataacaagcatgttggagcaaggattcttctttccaaggttcctattcttgcttccagttctttgtttgtcaaatattgtatttatgatcatcaatcaattaaaatgatcgacattgtccttgaatctcaggcatttcttgttcaaaaagtgcaatccctccatgactacaaagatcatgcagataattttatctgctctctcatacaaggggcccctttctcttcagcccaatatactccaggtggtctgctgttcaaaatgaatgacagcaacatgcagtatgtgacttccacttcattcttgctcttatcgtatgccaagtacttaacctatgctcgcaagattgtaaactgtggtgtgaccgctgtcactccgaagaggctaagaaatattgcaaagaaacaggtggactatctgctaggagacaacccattgaaaatgtcctacatggtggggtatggtccaaggtatccacagaggattcaccacaggggctcatctctaccgtcgatggctgcacacccagcaaagatccaatgctcctcgggtttcagtgtaatgaattctcaatcccccaacccgaacattcttgtgggtgcaatagtcggagggccagacgaacacgataggttcccagatgaaagatcagactatgagcaatccgagcctgctacttacatgaacgcgcccctagtaggggcactggcttatcttgctcactcatttggccagctctaa

SEQ ID NO: 3177 - protein, 456 aa, Populus balsamifera subsp. trichocarpa
  misc_feature (1)..(456): useful for making plants with increased nitrogen use efficiency as described in USSN 11/654,357
  misc_feature (1)..(456): Ceres ANNOT ID no. 1471639
  misc_feature (1)..(456): Functional Homolog of  Ceres CLONE ID no. 150823 with e-value of 8.70E-188 and BLAST sequence percent identity of 80.4
MHVDLVGGYYDAGDNVKFGFPMAFTTTMLSWSVLEFGGLMKGELQNAREAIRWATDYLLKATAHPDTIYVQVGDANKDHACWERPEDMDTPRSVYKVDKNSPGSEVAAETAAALAAASLVFRRCDPTYAKLLVRRAIRVFQFADKYRGAYSNGLKKYVCPFYCSYSGYEDELLWGAAWLHKATKNPTYLNYIQVNGQTLGAAQFDNTFGWDNKHVGARILLSKVPILASSSLFVKYCIYDHQSIKMIDIVLESQAFLVQKVQSLHDYKDHADNFICSLIQGAPFSSAQYTPGGLLFKMNDSNMQYVTSTSFLLLSYAKYLTYARKIVNCGVTAVTPKRLRNIAKKQVDYLLGDNPLKMSYMVGYGPRYPQRIHHRGSSLPSMAAHPAKIQCSSGFSVMNSQSPNPNILVGAIVGGPDEHDRFPDERSDYEQSEPATYMNAPLVGALAYLAHSFGQL

SEQ ID NO: 3178 - protein, 506 aa, Pisum sativum
  misc_feature (1)..(506): useful for making plants with increased nitrogen use efficiency as described in USSN 11/654,357
  misc_feature (1)..(506): Public GI no. 6009979
  misc_feature (1)..(506): Functional Homolog of  Ceres CLONE ID no. 150823 with e-value of 4.80E-219 and BLAST sequence percent identity of 79.0
MALSLSLTTILLSLFSFFLLHTHANPFRSIHHHNHPHFATHNYRDALTKSILFFQGQRSGKLPSNQRISWRRDSGLSDGSALHVDLVGGYYDAGDNVKFGFPMAFTTTMLSWSVIEFGGLMKSELPNAKKAVRWATDYLLKATAHPNIIYVQVGDAKKDHACWERPEDMDTPRSVFKVDANAPGSEVAAETAAALAAASLVFRKSDPTYAKILVRRAIRVFQFADKHRRSYSNALKPFVCPFYCSYSGYQDGLLWGAAWLHKATKNPMYLKYIQTNGQILGAAEFDNTFGWDNKHVGARILLSKEFLVQNVKSLHDYKGHSDNFVCSLIPGAGSSSAQYTPGGLLFKMSDSNMQYVTSTTFLLVTYAKYLTKSHSVVNCGGTTVTPKRLRTLAKRQVDYLLGDNPLKMSYMVGYGPRYPQRIHHRGSSLPSMAVHPGKIQCSAGFGVMNSKSPNPNILMGAVVGGPDQHDRFPDQRSDYEQSEPATYVNAPLVGTLAYLAHSFGQL

SEQ ID NO: 3179 - protein, 510 aa, Lycopersicon esculentum
  misc_feature (1)..(510): useful for making plants with increased nitrogen use efficiency as described in USSN 11/654,357
  misc_feature (1)..(510): Public GI no. 924622
  misc_feature (1)..(510): Functional Homolog of  Ceres CLONE ID no. 150823 with e-value of 8.30E-215 and BLAST sequence percent identity of 77.1
MASCSSSTAAMAMAITIFLFLLSFVTPVFLAKPVHHAHHPRFASHNYRDALAKSIIYFEGQRSGKLPSSQRITWRKDSGLSDGKAMGVDLVGGYYDAGDNVKFGFPMAFTTTMLSWSVIEFGGLMKGELLNAKQAIGWATEYLLKATAHPDTIYVQVGDAGSDHSCWERPEDMDTPRSVYKIDKNTPGTEVAAETAAALAAASLVFRKCNPSYSKILIKRAIRVFAFADKYRGSYSNGLRKVVCPYYCSVSGYEDELLWGAAWLHRATKNPTYLNYIQRNGQTLGAAETDNTFGWDNKHVGARILLSKSFLVQKLQTLHDYKSHADNYICSLIPGTPASQAQYTPGGLLFKMDDSNMQYVTSTSFLLVTYAKYLTSARMVVKCGGVVITPKRLRNVAKKQVDYLLGDNPLKMSYMVGYGARYPQRIHHRGSSLPSVANHPAKIQCRDGFSVMNSQSPNPNVLVGAVVGGPDEHDRFPDERSDYEQSEPATYINAPLVGTLTYLAHSFGQL

SEQ ID NO: 3180 - protein, 317 aa, Nicotiana tabacum
  misc_feature (1)..(317): useful for making plants with increased nitrogen use efficiency as described in USSN 11/654,357
  misc_feature (1)..(317): Public GI no. 16903355
  misc_feature (1)..(317): Functional Homolog of  Ceres CLONE ID no. 150823 with e-value of 6.59E-135 and BLAST sequence percent identity of 76.3
MDTPRSVFKIDKNTPGTEVAAETAAALAAASLVYRKCNPSYSKLLVKRAIRVFEFADKYRGSYSNGLRKVVCPYYCSVSGYEDELLWGAAWLHRATKNPSYLSYIQRNGQILGAAETDNTFGWDNKHVGARILLSKAFLVQKLQSLHDYKSHADNYICSLIPGTAFSQAQYTPGGLLFKMDDSNMQYVTTTSFLLVTYAKYLTSARMVVKCGGVVVTPKRLRNIAKKQVDYLLGDNPLKMSFMVGYGASYPQRIHHRGSSLPSVSNHPSQIECRSGFSVMSSQAPNPNVLVGAVVGGPDEHDRFPDERSDYEQSEPA

SEQ ID NO: 3181 - protein, 499 aa, Oryza sativa subsp. japonica
  misc_feature (1)..(499): useful for making plants with increased nitrogen use efficiency as described in USSN 11/654,357
  misc_feature (1)..(499): Public GI no. 34894544
  misc_feature (1)..(499): Functional Homolog of  Ceres CLONE ID no. 150823 with e-value of 6.70E-197 and BLAST sequence percent identity of 74.3
MALLRCLFLLAVLLPHRNAAVVAAASPHHGPAPHDYRDALTKSILFFEGQRSGKLPPSQRVSWRGDSGLSDGSSIKVDLVGGYYDAGDNMKFGFPLAFSMTMLAWSVVEFGGLMKGELQHARDAVRWGSDYLLKATAHPDTVYVQVGDANRDHACWERPEDMDTPRTVYKVDPSTPGTDVAAETAAALAAASLVFRKSDPAYASRLVARAKRVFEFADKHRGTYSTRLSPYVCPYYCSYSGYQDELLWGAAWLHRATKNPTYLSYIQMNGQVLGADEQDNTFGWDNKHAGARILIAKAFLVQKVAALHEYKGHADSFICSMVPGTPTDQTQYTRGGLLFKLSDSNMQYVTSSSFLLLTYAKYLAFSKTTVSCGGAAVTPARLRAIARQQVDYLLGSNPMGMSYMVGYGAKYPRRIHHRASSLPSVAAHPARIGCSQGFTALYSGVANPNVLVGAVVGGPNLQDQFPDQRSDHEHSEPATYINAPLVGALAYLAHSYGQL

SEQ ID NO: 3182 - DNA, 1535 bp, Arabidopsis thaliana
  misc_feature (1)..(1535): useful for making plants with increased nitrogen use efficiency as described in USSN 11/654,357
  misc_feature (1)..(1535): Theoretical sequence for Ceres CLONE ID no. 101255
  misc_feature (1180)..(1180): k is g or t/u
  misc_feature (1205)..(1205): y is t/u or c
aaaaagctttgccggagatttagcaaacacaaacacaaaaaacaaaaccaactcagacgaatgtgattttttcttcttgagtgaattgttgtaaaaaaatgatgatcggagaatctcatcgtggttttaatccaacggttcatattcctccatggccactttctgaagatctaacggtgtctgatatttacggaagtccagacggaggaagtagtatgatggaagctttggctgagttacaacgttatcttccgtcaaacgaaccggatccggattcagatccggatctctcgggtccggattcaccaatcgatgcttatacatgcgatcattttcggatgtatgagtttaaagtgagacgttgtgctcgtggccggagccatgattggacggagtgtccttacgctcatcccggagaaaaagctcgccgtcgtgatccgaggaagtttcattactccggtacgcgtgtcctgagtttcgtaaaggttgttgcaagagaggagacgcatgtgagttttctcatggtgtttttgagtgttggcttcacccggcgcgttaccggactcagccgtgtaaagacggtggtaactgtcgccgtcgtgtttgtttctttgctcattcgccggatcagattagggttttgcctaatcaaagccctgatcgtgttgattcgttcgacgttttgtctcctacgattcgtagagcgtttcagttttcgatttctccgtcgtctaactcgccgccggtgagtccacgaggtgactcggactcgtcgtgttcgttactgagtcgttcactcgggtctaatctgggaaacgacgtcgttgcgtctctcaggaatctgcaacttaataaagtgaagtcttctctttcgtcgtcatacaacaatcaaatcggaggatacggatccggattcgggtcgcctcgtggatcggttttgggtcctggtttccgtagcttaccaactacaccgacccgacctggttttatgaacatttgggagaatggcttggaggaagaaccggcgatggaacgggtcgagtcgggtcgtgaactgcgagcgcagctgttcgagaagctgagcaaagagaattgcatgggtcggattgaaccggatccggatcagggagcgggtgatactcctgatgtcgggtgggtctctgacttggttatgtgattkgaaccggattcgtaaaccggagtgyctgaaatttcgttgataaagattaattaaaggattattatcggcatgggaggttttttaatggatctcttcttaggaaaagaggagatttctctgcaagtttttttttttgtatatttattatttcctaatttcgtataatctctgttccataatcgatgattcgagggagattcctcagtgtataggagttgcttaggatttttcattatgatggattcactaatattgatattgttggttattgtttttttatatattatgatgtaagatgcaagtcgcaatgtaattattaaatatcttatgaatgaaatgagaatgtaaattattt

SEQ ID NO: 3183 - protein, 359 aa, Arabidopsis thaliana; identical to SEQ ID NO: 792
  misc_feature (1)..(359): useful for making plants with increased nitrogen use efficiency as described in USSN 11/654,357
  misc_feature (1)..(359): Ceres CLONE ID no. 101255

SEQ ID NO: 3184 - protein, 206 aa, Zea mays
  misc_feature (1)..(206): useful for making plants with increased nitrogen use efficiency as described in USSN 11/654,357
  misc_feature (1)..(206): Ceres CLONE ID no. 1233164
  misc_feature (1)..(206): Functional Homolog of  Ceres CLONE ID no. 101255 with e-value of 1.20E-66 and BLAST sequence percent identity of 65.8
MIGENKNRPHPTIHIPQWDQINDPTATISSPFSSVNLNSVNDYPHSPSPYLDSFASLFRYLPSNELTNDSDSSSGDESSPLTDSFSSDEFRIYEFKIRRCARGRSHDWTECPFAHPGEKARRRDPRKFHYSGTACPEFRKGSCRRGDSCEFSHGVFECWLHPSRYRTQPCKDGTSCRRRICFFAHTTEQLRVLPCSLDPDLGSSQD

SEQ ID NO: 3185 - DNA, 1024 bp, Populus balsamifera subsp. trichocarpa
  misc_feature (1)..(1024): useful for making plants with increased nitrogen use efficiency as described in USSN 11/654,357
  misc_feature (1)..(1024): Ceres ANNOT ID no. 1455308
atgatgatgatcggagaactctctcatcaccgttcgaatcccaccgttcaaatccctcaatgggacccatacgaagagcaaacaacgacgtctccctcgctgtccccaatcccgacttctccattcaccaacttcaacgccctcgattctctaacgtctctccaccgttaccttccgtcaaacgagccagaccctacttttgaagacgaactagatttaccagtggacgcgttctcatgcgatcacttccgtatgtacgagttcaaagtgaaaaggtgtgcacgtggccggtcacatgactggactgagtgtccgtatgcacatcctggcgagaaagcgcggcgcagggacccacgaaggtatcattactctggaacggcctgcccggagtttcggaaaggtggctgcaagaaaggcgatgcatgtgagtttgctcacggtgtctttgagtgctggctccatccggcccgttaccgcactcagccgtgtaaggatggacctgcttgtcgccgcagggtttgtttttttgctcacactccggaacagctcagactccttcctcagcagagtcctaagggaaatggatccgggtctggactcgggtcgggggaatatgattttgggtccccggttatacatccttttgactcctacatgactaaagctgggatttttgtttcatctccgacttcgattttgacttcaccgccagtttctccaccatctgactcgccaccaatgtctccaggcagtccacaggtgataggcggctctggacccggatccttaaattccatgagtgcgcttcttgcttcgatgcggggactgcaggttgggaaggcgaaaatgggatctcctgttggttcctggggagtccaatccggatttagattcgggtctccgcgtgggtcatcactacgacccggtttctgtagcctgccttcaactcctactagaacaatggcaagtcggtctggacttagtcagttggatatctggggcgatggggtcacttgtgaggaag

SEQ ID NO: 3186 - protein, 464 aa, Populus balsamifera subsp. trichocarpa
  misc_feature (1)..(464): useful for making plants with increased nitrogen use efficiency as described in USSN 11/654,357
  misc_feature (1)..(464): Ceres ANNOT ID no. 1455308
  misc_feature (1)..(464): Functional Homolog of  Ceres CLONE ID no. 101255 with e-value of 1.30E-101 and BLAST sequence percent identity of 65.5
MMMIGELSHHRSNPTVQIPQWDPYEEQTTTSPSLSPIPTSPFTNFNALDSLTSLHRYLPSNEPDPTFEDELDLPVDAFSCDHFRMYEFKVKRCARGRSHDWTECPYAHPGEKARRRDPRRYHYSGTACPEFRKGGCKKGDACEFAHGVFECWLHPARYRTQPCKDGPACRRRVCFFAHTPEQLRLLPQQSPKGNGSGSGLGSGEYDFGSPVIHPFDSYMTKAGIFVSSPTSILTSPPVSPPSDSPPMSPGSPQVIGGSGPGSLNSMSALLASMRGLQVGKAKMGSPVGSWGVQSGFRFGSPRGSSLRPGFCSLPSTPTRTMASRSGLSQLDIWGDGVTCEEEPAMERVESGRDLRAKIYAKLSKENSVDRDRGDSGVSGPDVGWVSELCPDQNTTKFSQPCGGVGSETGLTVSHSPFTGEKFCVCLKQNQRGAYLILHIPVVELRRRYERGGFKLDALSSDCSR

SEQ ID NO: 3187 - DNA, 1024 bp, Populus balsamifera subsp. trichocarpa
  misc_feature (1)..(1024): useful for making plants with increased nitrogen use efficiency as described in USSN 11/654,357
  misc_feature (1)..(1024): Ceres ANNOT ID no. 1508502
atgatgatcggagaactctctcatcaccgttcgaatcccaccgttcaaatccctcaatgggacccatacgaagagcaaacaacgacgtctccctcgctgtccccaatcccgacttctccattcaccaacttcaacgccctcgattctctaacgtctctccaccgttaccttccgtcaaacgagccagaccctacttttgaagacgaactagatttaccagtggacgcgttctcatgcgatcacttccgtatgtacgagttcaaagtgaaaaggtgtgcacgtggccggtcacatgactggactgagtgtccgtatgcacatcctggcgagaaagcgcggcgcagggacccacgaaggtatcattactctggaacggcctgcccggagtttcggaaaggtggctgcaagaaaggcgatgcatgtgagtttgctcacggtgtctttgagtgctggctccatccggcccgttaccgcactcagccgtgtaaggatggacctgcttgtcgccgcagggtttgtttttttgctcacactccggaacagctcagactccttcctcagcagagtcctaagggaaatggatccgggtctggactcgggtcgggggaatatgattttgggtccccggttatacatccttttgactcctacatgactaaagctgggatttttgtttcatctccgacttcgattttgacttcaccgccagtttctccaccatctgactcgccaccaatgtctccaggcagtccacaggtgataggcggctctggacccggatccttaaattccatgagtgcgcttcttgcttcgatgcggggactgcaggttgggaaggcgaaaatgggatctcctgttggttcctggggagtccaatccggatttagattcgggtctccgcgtgggtcatcactacgacccggtttctgtagcctgccttcaactcctactagaacaatggcaagtcggtctggacttagtcagttggatatctggggcgatggggtcacttgtgaggaagagc

SEQ ID NO: 3188 - protein, 388 aa, Populus balsamifera subsp. trichocarpa
  misc_feature (1)..(388): useful for making plants with increased nitrogen use efficiency as described in USSN 11/654,357
  misc_feature (1)..(388): Ceres ANNOT ID no. 1508502
  misc_feature (1)..(388): Functional Homolog of  Ceres CLONE ID no. 101255 with e-value of 1.59E-101 and BLAST sequence percent identity of 65.5
MIGELSHHRSNPTVQIPQWDPYEEQTTTSPSLSPIPTSPFTNFNALDSLTSLHRYLPSNEPDPTFEDELDLPVDAFSCDHFRMYEFKVKRCARGRSHDWTECPYAHPGEKARRRDPRRYHYSGTACPEFRKGGCKKGDACEFAHGVFECWLHPARYRTQPCKDGPACRRRVCFFAHTPEQLRLLPQQSPKGNGSGSGLGSGEYDFGSPVIHPFDSYMTKAGIFVSSPTSILTSPPVSPPSDSPPMSPGSPQVIGGSGPGSLNSMSALLASMRGLQVGKAKMGSPVGSWGVQSGFRFGSPRGSSLRPGFCSLPSTPTRTMASRSGLSQLDIWGDGVTCEEEPAMERVESGRDLRAKIYAKLSKENSVDRDRGDSGVSGPDVGWVSELVK

SEQ ID NO: 3189 - protein, 349 aa, Glycine max
  misc_feature (1)..(349): useful for making plants with increased nitrogen use efficiency as described in USSN 11/654,357
  misc_feature (1)..(349): Ceres CLONE ID no. 673872
  misc_feature (1)..(349): Functional Homolog of  Ceres CLONE ID no. 101255 with e-value of 5.29E-103 and BLAST sequence percent identity of 65.0
MLGEHHRGNPTVLVPPWPAHDDPTAEMYSAFLTNDVNAGEYSPYHLQEALTALQRFLPSNETDADSDSSEAAQPDAAVDAYTCDHFRMYEFKVRRCARGRSHDWTECPYAHPGEKARRRDPRRFHYSGVACPEFRKGNCRKGDACEFAHGVFECWLHPARYRTQPCKDGTSCRRRVCFFAHTPEQLRVLPMQSPRSVANSSESYDGSPMRQVSLSSAAAAAFMSSPAASLSPPESPPSVNEMVASLRNLQLGKMKSMPHNRNVSVGSPRGSVLRPGFLSLPTTPTQQPVRSGVKCFDVWDESFEEEPVMERVESGRGIRAKMFEKLSKENSLDASASPPDLGWVSELVK

SEQ ID NO: 3190 - protein, 246 aa, Boechera drummondii
  misc_feature (1)..(246): useful for making plants with increased nitrogen use efficiency as described in USSN 11/654,357
  misc_feature (1)..(246): Public GI no. 34013885
  misc_feature (1)..(246): Functional Homolog of  Ceres CLONE ID no. 101255 with e-value of 1.50E-41 and BLAST sequence percent identity of 64.4
MLKSASPLAFYDIGDQQYSTLGYIVSKPGIAEAYDLDHPIPTINNAIYGSDEFRMYAYKIKRCPRTRSHDWTECPYAHRGEKATRRDPRRYTYCAVACPAFRNGACHRGDSCEFAHGVFEYWLHPARYRTRACNAGNMCQRKVCFFAHAPEQLRQSEGKHRCRYAYRPVRARGGNGDGVAMRLDGEDYDTSRSPEKSGKGDLDSNEEKVLLKCWTSMTIVDDHYQPSDLDLDLDLSHIDWISELVD

SEQ ID NO: 3191 - protein, 249 aa, Capsella rubella
  misc_feature (1)..(249): useful for making plants with increased nitrogen use efficiency as described in USSN 11/654,357
  misc_feature (1)..(249): Public GI no. 38260642
  misc_feature (1)..(249): Functional Homolog of  Ceres CLONE ID no. 101255 with e-value of 3.49E-42 and BLAST sequence percent identity of 64.1
MLKSVSPMAFYDIGEQQYSTLGYIVSKPAIGNGGVYDLDPPIPTIDDAIYGSDEFRMYAYKIKRCPRTRSHDWTECPYAHRGEKATRRDPRRYTYCAVACPAFRNGACHRGDSCEFAHGVFEYWLHPARYRTRACNAGNLCQRKVCFFAHAPEQLRQSEGKHRCRYAYRPVRARGGNSNGVAMRMDGEDYDTSRSPEKSGKSVGLDSNEEKVLLKCWSRMSIVDDHYEPSDFDFDLDLSHFDWISELID

SEQ ID NO: 3192 - DNA, 1024 bp, Populus balsamifera subsp. trichocarpa
  misc_feature (1)..(1024): useful for making plants with increased nitrogen use efficiency as described in USSN 11/654,357
  misc_feature (1)..(1024): Ceres ANNOT ID no. 1530660
  misc_feature (1)..(359): Functional Homolog of  Ceres CLONE ID no. 101255 with e-value of 1.10E-95 and BLAST sequence percent identity of 64.0
atgatgatcggagaacatcctcatcaccatccaaatcccaccgtccaaatccctcaatgggacccatacgatgaccaaacaacatcaccatcaccgtcaacaatcccctcttctccattcaccaacttcaatgcgctcgactccctgacggcacttcaccgttaccttccgtcaaacgagccagacccatcctttgaagacgagctagacttaccagtggatgcgttctcatgcgatcacttccgtatgtacgtgttcaaagtgagaaggtgtggacgtggtcggtcgcatgactggactgaatgtccgtacgcgcatcctggagagaaagctcggcgaagggacccacaaaggtatcattactctggaacggcctgccctgaatttcggaaaggcggttgcaagaaaggagattcttgtgagtttgctcacggtgtctttgagtgctggctccatcctgcccgttacaggactcagccgtgtaaggatggacctgcttgtcgccgcagggtctgcttttttgctcacactcccgaacagcttaggctccttcctcagcatagtcctaaaggaaacggatccgggtcgtgggaacttgattttgggtccctggttatgcatcctctcgactcttacctgacaaaagctgggtcttttgtttcatctccaacctcgattttgacttctccgccagtttctccaccatctgattcgccaccgatgtcaccagtcagtccacagcttgggaagatgaaaatagggtctcctgttggttcttggggggtccaatccgggtctagatttgggtcgccacgtgggtcatcgctgcgacccgggttctgcagcctgccttctactcctactagaacaatggcaactcggtctggacttggccagctggatatctggggagatagtagtacttgcgaggaggagcctgcaatggagagggtggagtctgggagagatttgagggcgaagatatatgcaaagctgagtaaagagaactcactggaccctgatc

SEQ ID NO: 3193 - protein, 359 aa, Populus balsamifera subsp. trichocarpa
  misc_feature (1)..(359): useful for making plants with increased nitrogen use efficiency as described in USSN 11/654,357
  misc_feature (1)..(359): Functional Homolog of  Ceres CLONE ID no. 101255 with e-value of 1.10E-95 and BLAST sequence percent identity of 64.0
MIGEHPHHHPNPTVQIPQWDPYDDQTTSPSPSTIPSSPFTNFNALDSLTALHRYLPSNEPDPSFEDELDLPVDAFSCDHFRMYVFKVRRCGRGRSHDWTECPYAHPGEKARRRDPQRYHYSGTACPEFRKGGCKKGDSCEFAHGVFECWLHPARYRTQPCKDGPACRRRVCFFAHTPEQLRLLPQHSPKGNGSGSWELDFGSLVMHPLDSYLTKAGSFVSSPTSILTSPPVSPPSDSPPMSPVSPQLGKMKIGSPVGSWGVQSGSRFGSPRGSSLRPGFCSLPSTPTRTMATRSGLGQLDIWGDSSTCEEEPAMERVESGRDLRAKIYAKLSKENSLDPDRVESAVSGPDVGWVSELVK

SEQ ID NO: 3194 - protein, 353 aa, Glycine max; identical to SEQ ID NO: 805
  misc_feature (1)..(353): useful for making plants with increased nitrogen use efficiency as described in USSN 11/654,357
  misc_feature (1)..(353): Ceres CLONE ID no. 1239229
  misc_feature (1)..(353): Functional Homolog of  Ceres CLONE ID no. 101255 with e-value of 8.39E-105 and BLAST sequence percent identity of 63.8

SEQ ID NO: 3195 - protein, 388 aa, Zea mays
  misc_feature (1)..(388): useful for making plants with increased nitrogen use efficiency as described in USSN 11/654,357
  misc_feature (1)..(388): Ceres CLONE ID no. 287298
  misc_feature (1)..(388): Functional Homolog of  Ceres CLONE ID no. 101255 with e-value of 1.30E-60 and BLAST sequence percent identity of 63.6
MMMMGEGVSMPPWSHHVPVSGVDEGDEMTPYLLAALRQYLPCNDAGAEAEEDEAAAAMAAGVDGYGCDEFRMYEFKVRRCARARSHDWTECPFAHPGEKARRRDPRKYHYSGATCPDFRKGGCKRGDGCDMAHGVFECWLHPARYRTQPCKDGTACRRRVCFFAHTADQLRVLPPTPQQQSSPRGRRLLFPRSPSTTAPRSGARRSRATSPRASCARRRPAPSYRRPSRPRRSPRHCRPTSAVGAGRAPGPPSTTCSPRSVSSASAGPTRPRRAAGAATLHPRSRTDRLRGARSTACPPPRGPPPAPATWPTWTLSTSPSAATRSPWRGWSPAAHSARRCSSGLAGRALFPATPVAPTSGGSPTSSTEAAAGPWHGSGNGNGHGHGER

SEQ ID NO: 3196 - protein, 246 aa, Arabidopsis pumila
  misc_feature (1)..(246): useful for making plants with increased nitrogen use efficiency as described in USSN 11/654,357
  misc_feature (1)..(246): Public GI no. 38260661
  misc_feature (1)..(246): Functional Homolog of  Ceres CLONE ID no. 101255 with e-value of 1.70E-42 and BLAST sequence percent identity of 62.2
MLKSVSAMPFYEIGEQQYSTLGYIISKPGNAGLYDIDPPIPTIDDAIYGSDEFRMYAYKIKRCPRTRSHDWTECPYAHRGEKATRRDPRRYTYCAVACPAFRNGACHRGDSCEFAHGVFEYWLHPARYRTRACNAGNLCQRKVCFFAHAPEQLRQSEGKHRCRYAYRPVRTRGGNSDAMAVRMEGEDYDTSRSPEKSGKGGLDSNEEKVLFKCWSRMNIVDDHYEPSDLDLDLDLSHIDWISELVD

SEQ ID NO: 3197 - protein, 269 aa, Pimpinella brachycarpa
  misc_feature (1)..(269): useful for making plants with increased nitrogen use efficiency as described in USSN 11/654,357
  misc_feature (1)..(269): Public GI no. 6651292
  misc_feature (1)..(269): Functional Homolog of  Ceres CLONE ID no. 154343 with e-value of 7.5E-76 and BLAST sequence identity of 68.2%
MGRQPCCDKLGVKKGPWTADEDNKLINFILTNGQCCWRAVPKLAGLRRCGKSCRLRWTNYLRPDLKRGLLTDAEEQLVIDLHARLGNRWSKIAGRLPGRTDNEIKNHWNTHIKKKLIKMGIDPVTHEPLHKEETNSQKEILLQPFQSPAETENHVPPIPHTNDMASSENSCTPTDQNSSGDESNSLSAICDQIDDSLISYLFEDDTPGLVDAPWENFNKVDMVLPSWDESFPWLLDCQDFGIQDFGFDCFNDIEMNMLTQLDVKNDQTG

SEQ ID NO: 3198 - DNA, 762 bp, Gossypium hirsutum
  misc_feature (1)..(762): useful for making plants with increased nitrogen use efficiency as described in USSN 11/654,357
  misc_feature (1)..(762): Ceres CLONE ID no.100058160
aattggtgagactaattacttactattagtgtaattagtttgtgtttagtgggactaagttatgggtaggcagccttgctgtgacaaactgggtgtgaaaaaagggccatggactgccgaggaagacaagaaactcattaactttatcctcaccaatggccagtgttgctggcgtgctgttcctaagcttgccggcctccgccgctgcggtaagagctgccgccttcggtggactaattaccttcggcctgacttgaagagaggccttctttctgagaccgaagaacagttggttattgaccttcatgcccgtcttggaaataggtggtcgaagattgcagccaggttgccaggcagaactgataatgagatcaagaatcactggaacacccatatcaagaaaaagcttattaaaatgggaatcgatcccgttactcacgaacccttgaacaaagaagctaggacccaagaaagttcatcccatgctcatcattctgcagataaccataccacagaaaacgatggcatagccaattcatcagaggataattcaagttcaccaactgagaattgctctgctactgacgaccccaatttgttagacgctatttgcagcgatgaatctttattgaatagcttatggatggacgaacctcccctagtggatgtttcatggaccagtgtatcagcaggagaaaccaactgcaacctcacaagcttaccgtcttgggaggaggactgcgcatggttgctggattgtca

SEQ ID NO: 3199 - protein, 233 aa, Gossypium hirsutum
  misc_feature (1)..(233): useful for making plants with increased nitrogen use efficiency as described in USSN 11/654,357
  misc_feature (1)..(233): Ceres CLONE ID no. 100058160
  misc_feature (1)..(233): Functional Homolog of  Ceres CLONE ID no. 154343 with e-value of 9.9E-74 and BLAST sequence identity of 67.8%
MGRQPCCDKLGVKKGPWTAEEDKKLINFILTNGQCCWRAVPKLAGLRRCGKSCRLRWTNYLRPDLKRGLLSETEEQLVIDLHARLGNRWSKIAARLPGRTDNEIKNHWNTHIKKKLIKMGIDPVTHEPLNKEARTQESSSHAHHSADNHTTENDGIANSSEDNSSSPTENCSATDDPNLLDAICSDESLLNSLWMDEPPLVDVSWTSVSAGETNCNLTSLPSWEEDCAWLLDC

SEQ ID NO: 3200 - protein, 251 aa, Malus x domestica
  misc_feature (1)..(251): useful for making plants with increased nitrogen use efficiency as described in USSN 11/654,357
  misc_feature (1)..(251): Public GI no. 71041094
  misc_feature (1)..(251): Functional Homolog of  Ceres CLONE ID no. 154343 with e-value of 2.4E-70 and BLAST sequence identity of 62.8%
MGRQPCCDKLGVKKGPWTAEEDKKLVNFLLTHGQCCWRAVPKLAGLRRCGKSCRLRWINYLRPDLKRGLLNDAEEQLVIDLHARLGNRWSKIAARLPGRTDNEIKNHWNTHIKKKLVKMGIDPITHEPLHKQVTTPQEMPCEASNQPANSDMSIQQMNTNIPEHGISTNSDGNSTSENSPSNDSEPAEPNPNYSEEEDPLVSFILSDTFLEDLTWDFSTSSEYSSADNPTEENSLAWFMDCNDFGVEDFEL

SEQ ID NO: 3201 - protein, 275 aa, Zea mays
  misc_feature (1)..(275): useful for making plants with increased nitrogen use efficiency as described in USSN 11/654,357
  misc_feature (1)..(275): Public GI no. 42794336
  misc_feature (1)..(275): Functional Homolog of  Ceres CLONE ID no. 154343 with e-value of 2.5E-68 and BLAST sequence identity of 62.1%
MGRQPCCDKLGVKRGPWTAEEDRKLINFILTNGHCCWRAVPKLAGLLRCGKSCRLRWTNYLRPDLKRGLLTDAEEQVVIDLHAKLGNRWSKIAAKLPGRTDNEIKNHWNTHIKKKLIKMGIDPVTHEPLDRKTTSSGPATTSQSTKSDEATKEQSPQNDDAVIRDVPADGCSPTESSTNTVSTGGSSSSGGGGHDQDPLVKWLLEEEPATGDEAWLNFTGSVDVDEFSSIAAGPELLPWDGATDWLLDYQDFGLGDSSLVDGYMVNNNSSNGAKF

SEQ ID NO: 3202 - protein, 294 aa, Petunia x hybrida; identical to SEQ ID NO: 3144
  misc_feature (1)..(294): useful for making plants with increased nitrogen use efficiency as described in USSN 11/654,357
  misc_feature (1)..(294): Public GI no. 68052409
  misc_feature (1)..(294): Functional Homolog of  Ceres CLONE ID no. 154343 with e-value of 8.9E-73 and BLAST sequence identity of 59.7%

SEQ ID NO: 3203 - DNA, 1509 bp, Panicum virgatum
  misc_feature (1)..(1509): useful for making plants with increased nitrogen use efficiency as described in USSN 11/654,357
  misc_feature (1)..(1509): Ceres CLONE ID no.1819618
acacgctcccctcggcaagccgctgcggttgccgggcgcctgtcactccggccctgcttttttttgctctctctctctttgttggatgcagctgcttggttagcccggcccgtcgtctagcatccggccctgctgccccggccaggccgcgaccgcgattggacgccggccggccggccggcctcgctcgcaggcctttttaacaggacctcgccgtgagctctcggcggcggcggcggcggcggaatatacatatagatacatctaaccatatagctaggtgggatatatagatcatggggcggcagccgtgctgcgacaagctgggggtgaagcgggggccgtggacggctgaggaggaccggaagctcatcagcttcatcctgagcaacggccattgctgctggcgcgcggtgccgaagctggccggcctgctgcgctgcggcaagagctgccgcctgcgctggaccaactacctccgcccggacctcaagcgcggcctcctcaccgacgccgaggagcaggtcgtcatcgacctccacgccaagctcggcaacagatggtcaaagattgctgccaaactaccaggaaggactgacaacgagatcaagaaccactggaacacccacatcaagaagaagctgatcaagatgggcatcgacccggtcacgcacgagcccctcgaccggaagaccagcaacagcccggccacaacctcgcagtccgtcgtcacggccgattcaaccaagtccgacgaggcgaccaagcagcagagcccgcaaagcgacgccgtcggggacgtgttggccgacggttccagcccgacggaatcgagcgcgacgaacaccaccgtcagcacgggcggaagcatcagcagcagccacgaccaggacccgctggtgaagtggctcctggaagtggacccgcccaccggcgacgagccgtggctcaacttcaccggcagtgtcgaggtggacggcgagttcagcagcatcgccgccggtccggagttgccgtgggacggcgccaccgactggctgctcgactaccaagattttggattgggggacttgggcttggtcgatggctacatgatcaacagctcaaacggagcaaattaagttctattagctagctacatgccggtgaagatgacgatgatgcatcagctttgtgttgctaccagtgtagataagtaataaaaaaacaagcatatggaggttgtgaaaggtgaaatgaccagatcgaagggctctctctctcctagcttgatcgatccaaccaacggttgtgatgcatatttgatgggggtgtggtagagacgattagagagaggtgtgtagatttagctgtgttacttttttttctccctttgaggtcaagggatttgtgtttcttctcaaagagaagtggtagaacttcttgctgtgtagttatattttggtaatttggtgtatatatatgtgtgtattattgtacgttaagtttcactaaaaaaaaaaaaaaaaa

SEQ ID NO: 3204 - protein, 274 aa, Panicum virgatum
  misc_feature (1)..(274): useful for making plants with increased nitrogen use efficiency as described in USSN 11/654,357
  misc_feature (1)..(274): Ceres CLONE ID no. 1819618
  misc_feature (1)..(274): Functional Homolog of  Ceres CLONE ID no. 154343 with e-value of 3.2E-68 and BLAST sequence identity of 57.6%
MGRQPCCDKLGVKRGPWTAEEDRKLISFILSNGHCCWRAVPKLAGLLRCGKSCRLRWTNYLRPDLKRGLLTDAEEQVVIDLHAKLGNRWSKIAAKLPGRTDNEIKNHWNTHIKKKLIKMGIDPVTHEPLDRKTSNSPATTSQSVVTADSTKSDEATKQQSPQSDAVGDVLADGSSPTESSATNTTVSTGGSISSSHDQDPLVKWLLEVDPPTGDEPWLNFTGSVEVDGEFSSIAAGPELPWDGATDWLLDYQDFGLGDLGLVDGYMINSSNGAN

SEQ ID NO: 3205 - protein, 270 aa, Tradescantia fluminensis
  misc_feature (1)..(270): useful for making plants with increased nitrogen use efficiency as described in USSN 11/654,357
  misc_feature (1)..(270): Public GI no. 42541167
  misc_feature (1)..(270): Functional Homolog of  Ceres CLONE ID no. 154343 with e-value of 1.3E-48 and BLAST sequence identity of 55.4%
MGRSPCCEKAHTNKGAWTKEEDQRLIAYIKVHGEGCWRSLPKSAGLLRCGKSCRLRWINYLRPDLKRGNFTEEEDEVIIKLHALLGNKWSLIAGRLPGRTDNEIKNYWNTHIKRKLISRGIDPQTHRPVNSGAQFTISSANNQANSTKIPVNEALKQSTDSSSSQDMQSSNSVLDVVERCPDLNLDLSINIAYSTDRKPFSSSTEMQITPAATEATTPTSVSPYFQPICLCYRLGFSRTEACSCKAISNSNSQNVFRYYRPLKEEGHQTN

SEQ ID NO: 3206 - DNA, 438 bp, Populus balsamifera subsp. trichocarpa
  misc_feature (1)..(438): useful for making plants with increased nitrogen use efficiency as described in USSN 11/654,357
  misc_feature (1)..(438): Ceres ANNOT ID no.1527106
atgaagaagaagacagagcatgaagaagatgaatatcagcgtgatcttgaaatactcaaggctgtggcacaagcatggcatggtcattcaggaagttcaaggtctaccaatgaatatgatgcttatcgccaaaattttcaaagcaagccttctcggttcaagctagaagcaatgaacaagtcatcagccaagagggttgagagtgtaagttgggatttcaagcaatcactgtgggattcctatgagattgtgaacgtgtccaacaggttggagagagagcttgttttggaagatccatttagtggggtagatactcaaagaagggtgtatagtaagaaaagagagagtaagaacagtcttagaaaattgtttaatgtcatgtcttcaaggagattcaatgaggctgaagttcctcgtgaagataacaatcaattttga

SEQ ID NO: 3207 - protein, 145 aa, Populus balsamifera subsp. trichocarpa
  misc_feature (1)..(145): useful for making plants with increased nitrogen use efficiency as described in USSN 11/654,357
  misc_feature (1)..(145): Ceres ANNOT ID no. 1527106
  misc_feature (1)..(145): Functional Homolog of  Ceres CLONE ID no. 566305 with e-value of 1.7E-23 and BLAST sequence identity of 53.9%
MKKKTEHEEDEYQRDLEILKAVAQAWHGHSGSSRSTNEYDAYRQNFQSKPSRFKLEAMNKSSAKRVESVSWDFKQSLWDSYEIVNVSNRLERELVLEDPFSGVDTQRRVYSKKRESKNSLRKLFNVMSSRRFNEAEVPREDNNQF

SEQ ID NO: 3208 - protein, 144 aa, Glycine max
  misc_feature (1)..(144): useful for making plants with increased nitrogen use efficiency as described in USSN 11/654,357
  misc_feature (1)..(144): Ceres CLONE ID no. 649648
  misc_feature (1)..(144): Functional Homolog of  Ceres CLONE ID no. 566305 with e-value of 4.30E-18 and BLAST sequence identity of 45.5%
MKKRPELQQHQDFEVLKAVAQAWYSHSGTCKPMSEFEAHRRNFRGKPSRFKLEALNKPQASSSSSRDTSTYWDFQQSLWDSYELVTVSRRIETGLTLDNPFDELCGSPPIQQKRKPESKNSLRNLFNLMSSRRFNAPKNIPHQK

SEQ ID NO: 3209 - DNA, 1370 bp, Panicum virgatum
  misc_feature (1)..(1370): useful for making plants with increased nitrogen use efficiency as described in USSN 11/654,357
  misc_feature (1)..(1370): Ceres CLONE ID no.1805502
ccttgtataagtttttgttgttgttcagttaacaaatttactgaccgtccttaagtcgcatgtcgtctcaattaatgttaagcatggacccattcgtttacaattcataactttcatgagatactaaaaatatttgcaaacctagttttctgtttaacctatcttcttgttggttgctgtactttagatgtatatgtttgcgacactttgaaaacacatggttagcctgctatccgaatgacaaactagaaggatgcgcgctaccctctgcatttttcttgctttatatgctggatatgaccattctcatgctattaatgctaactggcacaaaaaataataatttaccttcaggattcaagggtaaaggatagttctgagcgtgggcagggtaatgactctaggagtaaaggtgctcaaagctctgcagttgaatccacacaaccatcttctggtccagttgtgcttaaccccatgatgccattttggcccgtccccccaccgatgggtggcccagcaactactatgaatatgggagtggattactggggtgctcctgcatctgtacctgtgcatggtaaagttattgcagcaccggcatcagctccttcatcaaattcgcgtgatattgttctcagtgatccagctatacaggatgagcgagaattgaagaaacaaaagcggaagcaatcgaatagggaatcagctcgccgctcaagattgcgcaagcaggctgaatgggaggaagtagccaaccgtgcggatttgctaaagcaggaaaacagttcactcaaagaagaattgaagcaacttcaggagaaatgtgatagcttgacctcagaaaatacatctctacatgagaagcttaaagcgcttgaagatgagaaatcaaatggaaattggtacaaagattaatggctgaaacttctctctttctgactgctgatataatttggtggtgacatgataggtcggacaattaggaggtattcatgtaacgtattagatttttggctgagggataacattgtatcataggatttgacatgggagatggctacagattcttcttttttccagttgcatcggctgttgtgctatggctttcttcttccttgtgctagatgccagttgccacagaagtaatactgtagaaatcccccggtgatgtttcaaacctggggattagcgtatgttgtagctgttgtagagctgctcattgggcttcttaagataaactgaagcgtgttaaagttattatttgcgatttatcgattcaaattagctaatttgtatactatatacactatagtgctgcactaattaatagtatttatggatcacccttttaaaaaaaaaaaaaaaaaaaa

SEQ ID NO: 3210 - protein, 146 aa, Panicum virgatum
  misc_feature (1)..(146): useful for making plants with increased nitrogen use efficiency as described in USSN 11/654,357
  misc_feature (1)..(146): Ceres CLONE ID no. 1805502
  misc_feature (1)..(146): Functional Homolog of  Ceres CLONE ID no. 14432 with e-value of 5.50E-09 and BLAST sequence identity of 36.0%
MMPFWPVPPPMGGPATTMNMGVDYWGAPASVPVHGKVIAAPASAPSSNSRDIVLSDPAIQDERELKKQKRKQSNRESARRSRLRKQAEWEEVANRADLLKQENSSLKEELKQLQEKCDSLTSENTSLHEKLKALEDEKSNGNWYKD

SEQ ID NO: 3211 - DNA, 1738 bp, Gossypium hirsutum
  misc_feature (1)..(1738): useful for making plants with increased nitrogen use efficiency as described in USSN 11/654,357
  misc_feature (1)..(1738): Ceres CLONE ID no.1853116
gcggcttgcagagattgattggttagggacttggggttgtaaaaactctggggtagcctgaaaatgggtctctctctttctcctttggcgctgatagtccttcttgcttgtttaactgctcttcatcagtgtaatggcaaccccttccgtagaaacaacccttttcgtcaccaccatcaccctcgctttgccaagcataactacagagatgcacttaccaaatctatcatgtttttcgaaggccaaaggtcagggaggcttccttctaaccagcggattacttggagaagagattctggcctctcagatggtgcagccatgcatgttgatttggttggaggatactatgatgctggagacaatgtgaagttcggattccctatggccttcaccaccaccatgctttcttggagtgtgattgaatttggtgggctgatgaaaggagagttacaaaatgccaaacaagccatccgttgggctactgattacttgctcaaagcaaccgcacatccagacaccatctatgttcaggttggtgatgcaaagcaggaccattcttgctgggaaagaccagaagacatggacactccgagaagtgttttcaaaatagacaaaaactctcctggttcagatgtagcaggagaaactgctgctgcgcttgcagctgcctctttggtcttcagaagaagtgaccccacttactctaagcttttggctaggagggctatcagggtatttcagttcgctgataagtacagaggaccctacagcaatggattgaaaaaagttgtttgcccattctattgctcttattctggttatcaggatgaactgctgtggggagctgcttggctgcaccgagccaccaggaacccgacctacctaaactacattcaggtgaatggacagatacttggagctgccgagtttgacaacacttttggatgggataacaaacatgtcggagcaaggattcttctttccaaggcatttctcgttcaaagactgaagtctctccatgattacaagggacacgcagataatttcatttgctctctcataccaggggccccattctcttcagctcaatatactccaggtggtctcctgtttaagatgagtgacagcaacatgcaatatgttacctccacttccttcctgcttcttacctatgccaagtacttaacttcagcccaccaggtcgttaactgcggtggcaccagggtcaccccaaagaggctccgaaccattgccaagaaacaggtggactatctgctaggtgacaaccccttgaagatgtcctacatggtaggatatggcccaaggtacccacaacgtatacaccacaggggctcatctttgccgtcggttgcaaatcacccagccaagatccaatgctccgcaggcttcaatttcatgaagtctcaatcccccaaccccaacattctggtgggtgcagtcattggtggtcctgaccagaaagacaggttcccagatcaacggtccgattatgaacagtctgaaccagcaacgtacatcaatgcaccccttgtcggagcgttaacttaccttgctcattcttttggtcagctttagggccctacaggcgttactactactactactactttttagggttatcagtaactttttaacatatttaggtgttcgtaatgtattcccttttagttaattttaaaatattaaaaggttatagcaaaaaaaaaaaaaaaaaaaa

SEQ ID NO: 3212 - protein, 510 aa, Gossypium hirsutum
  misc_feature (1)..(510): useful for making plants with increased nitrogen use efficiency as described in USSN 11/654,357
  misc_feature (1)..(510): Ceres CLONE ID no. 1853116
  misc_feature (1)..(510): Functional Homolog of  Ceres CLONE ID no. 150823 with e-value of 6.2E-223 and BLAST sequence identity of 78.9%
MGLSLSPLALIVLLACLTALHQCNGNPFRRNNPFRHHHHPRFAKHNYRDALTKSIMFFEGQRSGRLPSNQRITWRRDSGLSDGAAMHVDLVGGYYDAGDNVKFGFPMAFTTTMLSWSVIEFGGLMKGELQNAKQAIRWATDYLLKATAHPDTIYVQVGDAKQDHSCWERPEDMDTPRSVFKIDKNSPGSDVAGETAAALAAASLVFRRSDPTYSKLLARRAIRVFQFADKYRGPYSNGLKKVVCPFYCSYSGYQDELLWGAAWLHRATRNPTYLNYIQVNGQILGAAEFDNTFGWDNKHVGARILLSKAFLVQRLKSLHDYKGHADNFICSLIPGAPFSSAQYTPGGLLFKMSDSNMQYVTSTSFLLLTYAKYLTSAHQVVNCGGTRVTPKRLRTIAKKQVDYLLGDNPLKMSYMVGYGPRYPQRIHHRGSSLPSVANHPAKIQCSAGFNFMKSQSPNPNILVGAVIGGPDQKDRFPDQRSDYEQSEPATYINAPLVGALTYLAHSFGQL

SEQ ID NO: 3213 - protein, 499 aa, Oryza sativa; identical to SEQ ID NO: 3181
  misc_feature (1)..(499): useful for making plants with increased nitrogen use efficiency as described in USSN 11/654,357
  misc_feature (1)..(499): Public GI no. 75272525
  misc_feature (1)..(499): Functional Homolog of  Ceres CLONE ID no. 150823 with e-value of 4.5E-197 and BLAST sequence identity of 74.3%

SEQ ID NO: 3214 - protein, 501 aa, Zea mays
  misc_feature (1)..(501): useful for making plants with increased nitrogen use efficiency as described in USSN 11/654,357
  misc_feature (1)..(501): Ceres CLONE ID no. 351318
  misc_feature (1)..(501): Functional Homolog of  Ceres CLONE ID no. 150823 with e-value of 2.8E-195 and BLAST sequence identity of 73.7%
MARLRCVFVVFVLLSSALRLPGDAIASRGHHGPAAHDYRDSLVKSILFFEGQRSGKLPPSQRVSWRRDSGLSDGHSAKVDLVGGYHDAGDNVKFGFPMAFSMTMLAWSVVEFGGLMKSELQHARDAVRWGADYLLKATAHPDTIYVQVGDATKDHACWERPEDMDTPRTVYKVDRGTPGSDVAAETAAALAAASLVFRKSDPAYASRLVARAKRVFEFADKHRGSYSTGLAADVCPYYCSYSGYQDELLWGAAWLHRATKSPSYLSYIQTNGQVLGADESDNTFGWDNKHAGARVLISKSFLVQRLGALHEYKGHADGFICSMVPGTATDQTQYTRGGLLFRLSDSNMQYVTSSSFLLLTYAKYLAFAKQTVRCGGVAVTPQRLRAIARRQVDYLLGSNPMGMSYMVGYGAKYPRRIHHRASSLPSVAAHPARIGCSQGFTALYAGGANPNLLVGAVVGGPDMQDRFPDERNDHEHSEPATYINAPLVGALAYLAHSYGQL

SEQ ID NO: 3215 - DNA, 475 bp, Panicum virgatum
  misc_feature (1)..(475): useful for making plants with increased nitrogen use efficiency as described in USSN 11/654,357
  misc_feature (1)..(475): Ceres CLONE ID no.1893261
cgcttcagtgagccagccagccagccagtaggcggagtgggcggcggcggcgagcggcgaggcggcgccggcccacattgtccggtgcgcgaagagctccggcggcggtggtggccatggctcgcctccgctgcctgttcgtgctcgcgctcctcctcgggcagctgcccggcgacgccgtcgccgggcgcgggcaccacggccccgccgcgcacgactaccgggacgcgctggccaagtccatcctcttcttcgagggccagcggtcgggccggctgccgccgtcgcagcgcatgtcctggcgccgggactccgggctgagcgacggcgccgcggccaaggtggacctcgtcggcgggtaccacgacgccggcgacaacgtcaagttcgggttcccgatggcgttcagcatgacgatgctggcgtggagcgtggtggagttcggctgcctcatgaaggccgagctgcagcacgc

SEQ ID NO: 3216 - protein, 501 aa, Panicum virgatum
  misc_feature (1)..(501): useful for making plants with increased nitrogen use efficiency as described in USSN 11/654,357
  misc_feature (1)..(501): Ceres CLONE ID no. 1893261
  misc_feature (1)..(501): Functional Homolog of  Ceres CLONE ID no. 150823 with e-value of 4.4E-190 and BLAST sequence identity of 72.2%
MARLRCLFVLALLLGQLPGDAVAGRGHHGPAAHDYRDALAKSILFFEGQRSGRLPPSQRMSWRRDSGLSDGAAAKVDLVGGYHDAGDNVKFGFPMAFSMTMLAWSVVEFGGLMKAELQHAREAVRWGADYLLKATAHPDTIYVQVGDATKDHACWERPEDMDTPRTVYKVDAGTPGSDVAAETAAALAAASLVFRKADPAYAGRLLARAKRVFAFADRHRGSYSTGLAADVCPYYCSYSGYQDELLWGAAWLHRATRSPAYLGYIQANGQVLGAGEGDNTFGWDNKHAGARVLIARSLLVQRQGALREYRAHADAFICSMVPGTPADQTQYTRGGLLFKLSDSNMQYVTSSAFLLLTYAKYLAFARQTVSCGGGGGAVVTPQRLRAIARRQVDYLLGSNPAGMSYMVGYGARYPRRVHHRASSLPSVVAHPGRIGCSQGFAALYAGGANPNVLVGAVVGGPDLQDRFPDQRSDHEHSEPATYINAPLVGALAYLAHSYGQL

SEQ ID NO: 3217 - protein, 510 aa, Pinus radiata
  misc_feature (1)..(510): useful for making plants with increased nitrogen use efficiency as described in USSN 11/654,357
  misc_feature (1)..(510): Public GI no. 3025468
  misc_feature (1)..(510): Functional Homolog of  Ceres CLONE ID no. 150823 with e-value of 6.2E-191 and BLAST sequence identity of 69.0%
MRAFCDVSLVFGLFFLFWVGHANANYTIESYQHSKHPKPNFHGASHNYRDALSKAILFYEGQRSGKLPGSQRMTWRRDSALSDGFSQHVDLVGGYYDAGDNVKFGFPMAFTTTMLSWSVLEFGGFMGGELANSKDAIRWATDYLLKATAHPGTIYVQVGDPNTDHKCWERPEDMDTARTVYKIDSQHPGSDVAAETAAALAAASLVFRKSDPQYSKRLIHTAMRVFDFADKHRGAYSDSLRSCVCPFYCSYSGYEDELLWGAAWLHKATRNPTYLNYIQSKGQSLGADESDNIFGWDNKHAGARVLLSKEFLLRNVKSLHDYKGHADNYICSLLPGVSYSQAKYTPGGLLYTLSDSNLQYVTSSSFLLFTYAKYLSSSKHVVTCGSMTFSPKRLRTIAKRQVDYILGDNPLKMSYMVGYGSHYPERIHHRGSSLPSKGNHPQAIPCNAGFQSLYSNAPNPNILVGAVVGGPDSMDRFPDDRNDYEQSEPTTYINAPFVGSLAYLAHSTMS

SEQ ID NO: 3218 - protein, 493 aa, Atriplex lentiformis
  misc_feature (1)..(493): useful for making plants with increased nitrogen use efficiency as described in USSN 11/654,357
  misc_feature (1)..(493): Public GI no. 12957206
  misc_feature (1)..(493): Functional Homolog of  Ceres CLONE ID no. 150823 with e-value of 2.10E-167 and BLAST sequence identity of 65.2%
MARLSSLTTLFLVTICYLSVTTSAFAPRDYHDALQKSILFFEGQRSGPLPSSQRLNWRGDSGLSDGSSYHVDLVGGYYDAGDNVKFGLPMAFTTTMLAWSVIEFGSSMHDQLSAAKDAVRWGADYLLKAAATPGTLYVQVGEPNLDHQCWERPEDMDTPRNVYKVSTQNPGSDVAAETAAALAAASIVFKDSDPSYSSKLLHTAIQVFDFADKYRGSYSDSLNSVVCPFYCSYSGYQDELLWGAAWIHKASGDSSYLSYIQSNGHILGAEDDDFSFSWDDKKAGTKVLLAKDFLQDRVEQFQVYKAHADNFICSFIPGANDYQAQYTPGGLLFKQSDSNLQYVTTTSFLLVAYAKYLGKNGDITTCGSTVITAKKLISVAREQVDYILGDNPATMSYMVGFGNKYPQHIHHRASSLPSVHAHPSRIGCNDGFQYLNSGSPNPNVLVGAILGGPDSGDKFTDDRNNYRQSEPATYINAPFVGAAAFFSAYNERY

SEQ ID NO: 3219 - protein, 497 aa, Prunus persica
  misc_feature (1)..(497): useful for making plants with increased nitrogen use efficiency as described in USSN 11/654,357
  misc_feature (1)..(497): Public GI no. 1657374
  misc_feature (1)..(497): Functional Homolog of  Ceres CLONE ID no. 150823 with e-value of 1.4E-163 and BLAST sequence identity of 64.5%
MAYAATFSLVTQVLGLTLCLLSLCCSAFTPQDYSDALEKSILFFEGQRSGKLPANQRATWRANSGLSDGSSYHVDLVGGYYDAGDNVKFGLPMAFTTTLLAWSVIEFGDSMHNQIENAKDAIRWSTDYLLKAATSTPGALYVQVADPNADHQCWERPEDMDTPRNVYKVSTQNPGSDVAAETAAALAAASIVFKDSDPSYSGKLLHTAMKVFDFADRYRGSYSDSIGSVVCPFYCSYSGYHDELLWGASWIHRASQNSSYLAYIKSNGHILGADDDGFSFSWDDKRPGTKVLLSKNFLEKNNEEFQLYKAHSDNYICSLLPGTSNFQAQYTPGGLLYKASESNLQYVTSTTLLLLTYAKYLRTNGGVATCGSSKVTAETLISEAKKQVDYILGNNPAKISYMVGFGKKYPLHIHHRGSSLPSVHEHPERISCNNGFQYLNSGSPNPNVLVGAIVGGPDSKDSFSDDRNNYQQSEPATYINAPIVGALAFFSANTNPN

SEQ ID NO: 3220 - protein, 497 aa, Capsicum annuum
  misc_feature (1)..(497): useful for making plants with increased nitrogen use efficiency as described in USSN 11/654,357
  misc_feature (1)..(497): Public GI no. 1655545
  misc_feature (1)..(497): Functional Homolog of  Ceres CLONE ID no. 150823 with e-value of 3.8E-168 and BLAST sequence identity of 64.3%
MAHAFNMLILCYTFFLLLDLSHNFAFAFTSQDYSNALEKSILFFEGQRSGKLPANQRVKWRGNSGLSDGSGSHVNLVGGYYDAGDNVKFGLPMAFTTTLLAWSVIEFGSSMHSQLGHAKEAIRWSTDYLLKAATASPDTLYVQVGDPNQDHRCWERPEDMDTPRNVYKVSPQNPGSDVAAETAAALAAASIVFKDSDPSYSSTLLRTAQKVFAFADKYRGSYSDSLSSVVCPFYCSYSGYNDELLWGASWLHRASQDTSYLSYIQSNGQTMGANDDDYSFSWDDKRPGTKIVLSKDFLEKSTQEFQAYKVHSDNYICSLIPGSPSFQAQYTPGGLLFKGSESNLQYVTSSSFLLLTYAKYLRSNGGVVSCGSSRFPANKLVELARKQVDYILGDNPAKISYMVGFGQKYPLRVHHRGSSLPSVRTHPGHIGCNDGFQSLYSGSPNPNVLVGAIVGGPDSRDNFEDDRNNYQQSEPATYINAPLVGALAFLSAESTAV

SEQ ID NO: 3221 - protein, 505 aa, Citrus sinensis
  misc_feature (1)..(505): useful for making plants with increased nitrogen use efficiency as described in USSN 11/654,357
  misc_feature (1)..(505): Public GI no. 2290681
  misc_feature (1)..(505): Functional Homolog of  Ceres CLONE ID no. 150823 with e-value of 7.3E-165 and BLAST sequence identity of 63.6%
MVLSILRKMDPVTKFSLTLQILGLTLCALSLLCSAFTFQDYSDALGKSILFFEGQRSGRLPPNQQLTWRGNSGLSDGSSYHVDLVGGYYDAGDNVKFGLPMAFTTTLLSWSVIEFGSSMQNHLENAKAAIRWGTDYLLKASTATPGALYVQVGDPNMDHHCWERPEDMDTPRNVYKVSTQNPGSDVAAETAAALAAASVVFKDSDPSYSTKLLKTAMKVFDFADKYRGSYSDSLNSVVCPYYCSYSGYLDELLWGASWLHRASQNSSYLAYIQSNGHILGADDDDYSFSWDDKRAGTKVLLSKGFLEKNTQEFQLYKAHSDNYICSLIPGSSSFQAQYTAGGLFYKASESNLQYVTTTAFLLLTYAKYLSSNGGVATCGSSTVKAENLIALAKKQVDYILGDNPAKMSYMVGFGERYPQHVHHRGSSLPSIHAHPDHIACNDGFQYLYSRSPNPNVLTGAILGGPDNRDNFADDRNNYQQSEPATYINAPFVGAVAFFSSKTTTN

SEQ ID NO: 3222 - protein, 494 aa, Persea americana
  misc_feature (1)..(494): useful for making plants with increased nitrogen use efficiency as described in USSN 11/654,357
  misc_feature (1)..(494): Public GI no. 121784
  misc_feature (1)..(494): Functional Homolog of  Ceres CLONE ID no. 150823 with e-value of 6.8E-162 and BLAST sequence identity of 63.2%
MDCSSPLSLFHLLLVCTVMVKCCSASDLHYSDALEKSILFFEGQRSGKLPTNQRLTWRGDSGLSDGSSYHVDLVGGYYDAGDNLKFGLPMAFTTTMLAWGIIEFGCLMPEQVENARAALRWSTDYLLKASTATSNSLYVQVGEPNADHRCWERPEDMDTPRNVYKVSTQNPGSDVAAETAAALAAASIVFGDSDSSYSTKLLHTAVKVFEFADQYRGSYSDSLGSVVCPFYCSYSGYNDELLWGASWLHRASQNASYMTYIQSNGHTLGADDDDYSFSWDDKRVGTKVLLSKGFLQDRIEELQLYKVHTDNYICSLIPGTSSFQAQYTPGGLLYKGSASNLQYVTSTAFLLLTYANYLNSSGGHASCGTTTVTAKNLISLAKKQVDYILGQNPAKMSYMVGFGERYPQHVHHRGSSLPSVQVHPNSIPCNAGFQYLYSSPPNPNILVGAILGGPDNRDSFSDDRNNYQQSEPATYINAPLVGALAFFAANPVTE

SEQ ID NO: 3223 - DNA, 1485 bp, Populus alba
  misc_feature (1)..(1485): useful for making plants with increased nitrogen use efficiency as described in USSN 11/654,357
  misc_feature (1)..(1485): Public GI no. 13383303
atggctaatgccactacattttcactaatgttgcagtttttcttcgtaactttttgttgtctgagctattttagctttgccttcacttctcaagactatgctaatgctcttgaaaaacctatcctcttttttgagggtcagaggtcaggcaaattgccgtctaaccaacggctagcatggaggggggattctgggttgtctgacggttctacttatcacgtgaacctagttggtggatactacgatgcgggtgataatgtcaagtttggccttccaatggccttcactactacattgttggcatggagtgtcattgaattcggtagctcgatgcagaatcagattgaaaatgccaaagcagccattcggtggagcactgactaccttttaaaagcagcaactgccacccctgacacactatatgttcaagttggaaatccaaacatggatcaccggtgctgggagaggccggaagacatggacacaccacgcaatgtgtacaaagtaaccatccacaacccgggatctgacgtggctgccgagacagctgctgcattggctgcagcttcaattgttttcaaagagtctgacccttcttactctaccaaactgcttcatacggcaatgaaagtattcgattttgcagacaggtatagaggttcttatagcaactccctcaattcagtagtctgcccattttactgctcttactcgggataccaggatgagcttctttggggagcatcatggattcatagagcgtcacagaacgggtcatacttgacttacatccagtcaaatggtcacacgatgggttctgatgacgacgactactcctttagttgggatgacaagcgacctgggactaagattcttctttccaaggaattcttggagaaaactactgaagaatttcaattatataaatcgcattcagacaactatatatgctctctaattccaggaacttctagtttccaggcccaatatacacccggggggcttttttacaaagcaagtgaaagcaatttgcaatatgtaacctccacaactttccttctattgacatacgccaagtatcttggctcaaatggaggagttgccagatgcggtggttcaaccgtgacaacagagtcgctcatcgcacaggcgaagaagcaggtggactatatcttaggtgataatccagcaaggatgtcttacatggttggattcggtaacaggtatccgcaacatgttcatcacaggggttcctcggtgccatccatacacgcacacccgaatcgcatttcctgcaacgatgggtttcagttcctctactccagctctcccaatccgaatgtccttgttggagccataataggcggccctgataacagagacaacttcgctgatgatcgaaacaactatcagcaatccgagccagctacgtatatcaacgcaccctttgttggtgctcttgctttcttctcagccaaaaattaa

SEQ ID NO: 3224 - protein, 494 aa, Populus alba
  misc_feature (1)..(494): useful for making plants with increased nitrogen use efficiency as described in USSN 11/654,357
  misc_feature (1)..(494): Public GI no. 13383303
  misc_feature (1)..(494): Functional Homolog of  Ceres CLONE ID no. 150823 with e-value of 2.4E-166 and BLAST sequence identity of 63.0%
MANATTFSLMLQFFFVTFCCLSYFSFAFTSQDYANALEKPILFFEGQRSGKLPSNQRLAWRGDSGLSDGSTYHVNLVGGYYDAGDNVKFGLPMAFTTTLLAWSVIEFGSSMQNQIENAKAAIRWSTDYLLKAATATPDTLYVQVGNPNMDHRCWERPEDMDTPRNVYKVTIHNPGSDVAAETAAALAAASIVFKESDPSYSTKLLHTAMKVFDFADRYRGSYSNSLNSVVCPFYCSYSGYQDELLWGASWIHRASQNGSYLTYIQSNGHTMGSDDDDYSFSWDDKRPGTKILLSKEFLEKTTEEFQLYKSHSDNYICSLIPGTSSFQAQYTPGGLFYKASESNLQYVTSTTFLLLTYAKYLGSNGGVARCGGSTVTTESLIAQAKKQVDYILGDNPARMSYMVGFGNRYPQHVHHRGSSVPSIHAHPNRISCNDGFQFLYSSSPNPNVLVGAIIGGPDNRDNFADDRNNYQQSEPATYINAPFVGALAFFSAKN

SEQ ID NO: 3225 - protein, 496 aa, Fragaria x ananassa
  misc_feature (1)..(496): useful for making plants with increased nitrogen use efficiency as described in USSN 11/654,357
  misc_feature (1)..(496): Public GI no. 4972234
  misc_feature (1)..(496): Functional Homolog of  Ceres CLONE ID no. 150823 with e-value of 9.9E-161 and BLAST sequence identity of 62.6%
MARNGLCLPGNAPAFRATLVLSLLLLLQPIRAGHDYHDALRKSILFFEGQRSGKLPPDQRLKWRRDSALHDGSTAGVDLTGGYYDAGDNVKFGFPMAFTTTLLAWSIIDFGRVMGTEQRNAVKALRWGTDYLLKATAVPGVVFVQVGDPYSDHNCWERPEDMDTRRTVYKIDHNNPGSDVAGETAAALAAASIVFRSRDPAYSRLLLNRAVKVFEFADTHRGAYSSSLKNAVCPFYCDVNGFQDELLWGAAWLHKASRRRQYREYIVRNEVILRAGDTINEFGWDNKHAGINILISKEVLMGKADYFESFKQNADGFICSVLPGLAHTQAQYSPGGLIFKPGGSNMQHVTSLSFLLLTYSNYLSHANKNVPCGMTSASPAFLKQLAKRQVDYILGDNPLRMSYMVGYGPRYPQRIHHRGSSLPSVQAHPARIGCKAGSRYFLSPNPNPNKLVGAVVGGPNSSDAFPDSRPYFQESEPTTYINAPLVGLLSYFAAHY

SEQ ID NO: 3226 - DNA, 1461 bp, Populus tremula x Populus tremuloides
  misc_feature (1)..(1461): useful for making plants with increased nitrogen use efficiency as described in USSN 11/654,357
  misc_feature (1)..(1461): Public GI no. 50346664
atgagaaggggagcttctttctgcctcttgttttccctgtcacttgttctcttgggttttgtccaagccaaacccaattacaacgaagccctagcaaaatccatactgttttttcaaggtcagaggtcagggaggctccccggatcccagcagctggcttggaggtccgattccgggctctctgatggcttattcgcccacgtggatttaactggagggtactatgatgctggagacaatgtcaagtttaatttcccaatggccttcaccacgacaatgctctcatggagcacgctcgagtatggcaagagaatgggacctgaattaccaaatgcaagggccgcaatccggtgggccacggactatcttctaaaatgtgccaccgccacccctggtaagctctatgtgggtgttggtgatccgaatgtcgatcacaagtgctgggagaggccggaggatatggacacagtccgaactgtattttcggtctcggcaagaagccctggctcggatgttgccggtgagacggccgcggcattagctgctgcctcaatggtttttcgaaaagtcgaccgtaaatactcggctttgctactgagaacagccaggaaggtttttcaatttgccatgcaataccaaggtgcctatagtgattctcttggatcagcagtgtgcccattttactgctcgtattctggttataaggatgaactactgtggggagctgcatggctgttcagggcaacaaacgaaatgtcctactataacatcttcaagtccttgggagctgacgaccaacctgacctattcagctgggacaacaagtatgctggtgttcatgttcttttatcaaggcgagcattgctcaacaacgacaaaaacttcgagcaatttgaaggagaagcagaaagtttcatgtgccggatcttacccaactcaccttataaaactacacagtatacacagggtggactgatgtacaagctacctgaaagcaacctccaatatgtgacatccataacattcttgctcaccacttatgctaaatacatgaaagcaaccaggcacaccttcaactgtggcaatctcttggtcactccaaattccctgttatatgtggctaaaagacaggtggattacatactaggggagaacccgattcgaatgtcctacatggtaggattcgggccaaattttcctaagagaattcaccatagaggttcttctttgccatcattggcaagccacccacaagctatcggttgtgatagtggcttcgagcctttcttccattcagcaaatcctaatcctaacatcttaaccggagctattgtcggcggtccaaaccagaatgatggctatccagatgaacgcagtgattatagccactcggagcctgctacgtacatcaacgctgctatggttggacccttggcatactttgctgctaccttgaattag

SEQ ID NO: 3227 - protein, 486 aa, Populus tremula x Populus tremuloides
  misc_feature (1)..(486): useful for making plants with increased nitrogen use efficiency as described in USSN 11/654,357
  misc_feature (1)..(486): Public GI no. 50346664
  misc_feature (1)..(486): Functional Homolog of  Ceres CLONE ID no. 150823 with e-value of 7.2E-158 and BLAST sequence identity of 62.0%
MRRGASFCLLFSLSLVLLGFVQAKPNYNEALAKSILFFQGQRSGRLPGSQQLAWRSDSGLSDGLFAHVDLTGGYYDAGDNVKFNFPMAFTTTMLSWSTLEYGKRMGPELPNARAAIRWATDYLLKCATATPGKLYVGVGDPNVDHKCWERPEDMDTVRTVFSVSARSPGSDVAGETAAALAAASMVFRKVDRKYSALLLRTARKVFQFAMQYQGAYSDSLGSAVCPFYCSYSGYKDELLWGAAWLFRATNEMSYYNIFKSLGADDQPDLFSWDNKYAGVHVLLSRRALLNNDKNFEQFEGEAESFMCRILPNSPYKTTQYTQGGLMYKLPESNLQYVTSITFLLTTYAKYMKATRHTFNCGNLLVTPNSLLYVAKRQVDYILGENPIRMSYMVGFGPNFPKRIHHRGSSLPSLASHPQAIGCDSGFEPFFHSANPNPNILTGAIVGGPNQNDGYPDERSDYSHSEPATYINAAMVGPLAYFAATLN

SEQ ID NO: 3228 - protein, 497 aa, Malus x domestica
  misc_feature (1)..(497): useful for making plants with increased nitrogen use efficiency as described in USSN 11/654,357
  misc_feature (1)..(497): Public GI no. 33943180
  misc_feature (1)..(497): Functional Homolog of  Ceres CLONE ID no. 150823 with e-value of 3.4E-151 and BLAST sequence identity of 58.7%
MAMRLSLSIFISLFVILGSSISSSVQVLAAGNPNYREALAKSVLFFQGQRSGRLPAGAAQQITWRSNSGLSDGRQAYVDLTGGYYDAGDNVKFNFPMAFTTTMLSWGALEYGKRMGPQLPETRAAIRWATDYLIKCARQTPGRLYVGVGDPNVDHKCWERPEDMDTTRTVYSVSPSNPGSDVAGETAAALAAASLVFRRVDPKYSKLLLNTARNVMQFAIQYRGAYSDSLGSAVCPFYCSYSGYNDELLWGAAWLFRATNELYYYNFIKSLGASDSTDIFSWDNKFAGAYVLLSRRALLNNDKNFEPYKQEAEQFMCRILPNSPSSSTQYTQGGLIYKLPGSNLQYVTSITFLLTTYSKYMAARKLTFDCGNLVVTPMALRNLAKQQVDYILGVNPLKMSYMVGYGPYYPKRIHHRGSSLPSLTSHRQSIGCDGGFQPFFYSLNPNPNILVGAVVGGPNQNDGFPDDRGDYSHSEPATYINGAIVGPLAFFAGSYRS

SEQ ID NO: 3229 - protein, 490 aa, Lilium longiflorum
  misc_feature (1)..(490): useful for making plants with increased nitrogen use efficiency as described in USSN 11/654,357
  misc_feature (1)..(490): Public GI no. 33350938
  misc_feature (1)..(490): Functional Homolog of  Ceres CLONE ID no. 150823 with e-value of 3.4E-144 and BLAST sequence identity of 58.1%
MLSLKIVILGLLVAISDAVAIPANINYKDALSKSIIFFEGQRSGKLPPNQTLTWRANSALSDGAADNVDLTGGYYDAGDNVKFGFPMAFSVTMLSWSVIEFGKLIPADIDKAREAIRWGTDYLLKACSALPDAIYVQVGDPTSEHQCWERPENMSTQRSVYKITPSNPGSDVAGETAAALAAASLVFHKIDHKYAKTLRETAKKAFTFAESHRGSYSDSLSSAVCPYYCSYSGFQDELLWAAGWLYKATHNASYLNFAQSLNVDSNADTFSWDNKFPGADILLAQDFIINKNQAASSYKQQAEKFLCTVLPNSPTLSAKYTAGGLLYKMTPSNLQYVTSTSFLLGVYAKYLRISRRTFSCGNMVVTPSVLIRLVEKQIGYILGHNPQALSYMVDFGNNFPLHIHHRGSSIPSVHADAQAIGCDEGFQYYNTSNPNPNILTGAVVGGPDENDSFADDRDNYSQSEPATYINAPLVGTLAFLAGDQVLGKLF

SEQ ID NO: 3230 - protein, 496 aa, Phaseolus vulgaris
  misc_feature (1)..(496): useful for making plants with increased nitrogen use efficiency as described in USSN 11/654,357
  misc_feature (1)..(496): Public GI no. 1039431
  misc_feature (1)..(496): Functional Homolog of  Ceres CLONE ID no. 150823 with e-value of 1.9E-132 and BLAST sequence identity of 54.7%
MGYHSVFIAVFLWSSMVCHNGLAMMDDGKLTSSSGPPNYDYADALAKAILFFEGQRSGKLPSSQRVKWREDSALSDGKLQNVNLIGGYYDAGDNVKFGWPMAFSTSLLSWAAVEYESEISSVNQLGYLQSAIRWGADFMLRAHTSPTTLYTQVGDGNADHNCWERPEDMDTPRTVYKIDANSPGTEVAAEYAAALSAASIVFKKIDAKYSSTLLSHSKSLFDFADKNRGSYSGSCPFYCSYSGYQDELLWAAAWLYKASGESKYLSYIISNQGWSQTVSEFSWDNKFVGAQTLLTEEFYGGKKDLAKIKTDAESFICAVMPGSNSRQIKTTPGGLLFTRDSSNLQYTTSSTMVLFIFSRILNRNHINGINCGSSHFTASQIRGFAKTQVEYILGNNPMKMSYMVGFGSKYPKQLHHRGSSIPSIKVHPAKVGCNAGLSDYYNSANPNPNTHVGAIVGGPDSNDRFNDARSDYSHAEPTTYINAAFVASISALLAKT

SEQ ID NO: 3231 - protein, 483 aa, Medicago truncatula
  misc_feature (1)..(483): useful for making plants with increased nitrogen use efficiency as described in USSN 11/654,357
  misc_feature (1)..(483): Public GI no. 92873257
  misc_feature (1)..(483): Functional Homolog of  Ceres CLONE ID no. 150823 with e-value of 7.8E-113 and BLAST sequence identity of 48.7%
MDSKSVYWAIIVAWLTLFQGSMILVQGQFNYKEALTKSLIFLEAQRSGKLPPNNRVPWRGDSAVDDGKLANVDLSGGYYDAGDNVKYGLPMAFTVTTLSWAAIFYKTEFEATKEMGNIQDAIKWGTDYFLKASSRRNKLYVEVGDPEEDHHCWAPPEKMKTKRSVKVIDSNTPGSEIASETAAAMASSSIVFRHTDRKYARRLLNKAKLLFDLAKSHKGTYDGECPFYCSYSGYNDELVWAATWLYMATKKSLYMKYIQEESISANVAEFSWDLKYAGVQVLLTQLHFEGQKGLETFKSHGESYICSVLPDSPYHQIHLSPGGFIHMRDGANTQYATSTSFLFTVYSDLLAKYKQKVKCGNKEFDSSHVLDFAKKQMDYILGKNPEGRSYMVGFGKNPPTQAHHRGASVPKLSPNEDINCPMSFSKWLKRDGPNPHELTGAIVGGPDINDKFDDNRTDSPKTEPCTYVNSLAAGALAKLASLG

SEQ ID NO: 3232 - DNA, 1330 bp, Gossypium hirsutum
  misc_feature (1)..(1330): useful for making plants with increased nitrogen use efficiency as described in USSN 11/654,357
  misc_feature (1)..(1330): Ceres CLONE ID no.1843695
tatacaaatcttacaagccaaaaaagaaaaaatgatgcttggagaaactcatcgtccaaatccaaccgtccacgtaccaccttggcctgatcttgacgatgatcagacggatgtagtttactctcctatccattacaatgcaaccgacaacaacttgagcagtaacggcaacccgttttacctccatgaagcgttatcagctttacaacgttatttgccatcgaacggcccggatgttgagttggattccgagtttccgggtttggatagtccggattcaccggtcgatgcttattcctgtgaccatttcaggatgtacgagttcaaaatccggaggtgtgctcgtgggcggtctcatgactggaccgagtgtccgtacgcccatcccggtgaaaaagctcgtcggagggatccgaggaagtatcattattcgggtactgcatgcccggattttcgtaaagggaactgccggaaaggagattcatgtgagttcgctcatggggtttttgagtgttggcttcacccggctcgttaccggactcaaccgtgtaaagatgggtcgggttgtcgtcgtcgggtttgtttctttgctcatactcctgaccagctccgtctcgtaagctctactgatacttacgacggttcaccgtgtggtaaaacgctgacgttttggtcttcacctggttctagctcacctccggttagtccccgtgccgagtcttgctcttcccctccggtctcgccgatggctcagtcgctaagccgttctctcggttcggcttccattaacgagatggtgacctctttaaggaacttacagctaggaaaaggcaagtcctggaagacccaagttggctgttgctccccttcgtcaccttccagtttcggatcccccagagcagcaatgatccgacccggtttctgcagcttacccagtactccgacccgaaacttaacccgtccaggtatcagctacccggattcatgggataaagcgtgtgaagaagaaccggtaatggaacgggtcgaatcgggacgtgatttacgtgcaaagatgttcgagaaactgagtaaagaaaattcattggagcgggtgaacccggatcaatcttccggaggtccggatttgaattgggtttcggacttgggtaagcaagcaatggggattattgtaatggttgatattgtgctttttattaagtatttttaattatgattatccaagttgctaatcttttttatttgtactaaaaaaatagtgtaattaaatattgtaaaattttagagcttatgtatgctcttttatggtcaaaaaaaaaaaaaaaaaaaa

SEQ ID NO: 3233 - protein, 392 aa, Gossypium hirsutum; identical to SEQ ID NO: 794
  misc_feature (1)..(392): useful for making plants with increased nitrogen use efficiency as described in USSN 11/654,357
  misc_feature (1)..(392): Ceres CLONE ID no. 1843695
  misc_feature (1)..(392): Functional Homolog of  Ceres CLONE ID no. 101255 with e-value of 7.8E-113 and BLAST sequence identity of 67.7%

SEQ ID NO: 3234 - protein, 249 aa, Capsella rubella; identical to SEQ ID NO: 3191
  misc_feature (1)..(249): useful for making plants with increased nitrogen use efficiency as described in USSN 11/654,357
  misc_feature (1)..(249): Public GI no. 38260642
  misc_feature (1)..(249): Functional Homolog of  Ceres CLONE ID no. 101255 with e-value of 4.8E-42 and BLAST sequence identity of 64.2%

SEQ ID NO: 3235 - protein, 386 aa, Oryza sativa subsp. japonica; identical to SEQ ID NO: 821
  misc_feature (1)..(386): useful for making plants with increased nitrogen use efficiency as described in USSN 11/654,357
  misc_feature (1)..(386): Public GI no. 115435036
  misc_feature (1)..(386): Functional Homolog of  Ceres CLONE ID no. 101255 with e-value of 8.5E-84 and BLAST sequence identity of 60.9%

SEQ ID NO: 3236 - protein, 381 aa, Medicago truncatula; identical to SEQ ID NO: 808
  misc_feature (1)..(381): useful for making plants with increased nitrogen use efficiency as described in USSN 11/654,357
  misc_feature (1)..(381): Public GI no. 92893962
  misc_feature (1)..(381): Functional Homolog of  Ceres CLONE ID no. 101255 with e-value of 7.4E-101 and BLAST sequence identity of 60.9%

SEQ ID NO: 3237 - DNA, 525 bp, Panicum virgatum
  misc_feature (1)..(525): useful for making plants with increased nitrogen use efficiency as described in USSN 11/654,357
  misc_feature (1)..(525): Ceres CLONE ID no.1858754
ccccgtccccaacccacgcactgtcccagtagcgataagccgagtccacgagatccccgtagaccaccggagcggaggagaaagcagccagccatgatgatgatgggcgaaggcgtgagcgtcccgccgtggtcgcaccacctcccggtgagcggcgtcgacgtcggaggcggcaccaccggcggcgacgagatgacgccgtacctgctgtcggcgctgcatcagtacctgccgtgcaacgacgccggcgcaggcgccgacgacgacgaggcggcggccgcggcggcgatggcggccggcgtcgacgggtacggctccgacgagttccgcatgtacgagttcaaggtccggcggtgcgcgcgcgcccgcagccacgactggaccgagtgccccttctcgcacccgggggagaaggcgcgccgccgggacccgcgcacgtacccctactcccgcacgcgcctgcccggacttccgctacggcgggtgcaagcgcggggacgctctgcgagttcgtgtacggcgtct

SEQ ID NO: 3238 - protein, 381 aa, Panicum virgatum
  misc_feature (1)..(381): useful for making plants with increased nitrogen use efficiency as described in USSN 11/654,357
  misc_feature (1)..(381): Ceres CLONE ID no. 1858754
  misc_feature (1)..(381): Functional Homolog of  Ceres CLONE ID no. 101255 with e-value of 4.1E-84 and BLAST sequence identity of 59.8%
MMMMGEGVSVPPWSHHLPVSGVDVGGGTTGGDEMTPYLLSALHQYLPCNDAGAGADDDEAAAAAAMAAGVDGYGSDEFRMYEFKVRRCARARSHDWTECPFSHPGEKARRRDPRKYHYSGTACPDFRKGGCKRGDACEFAHGVFECWLHPARYRTQPCKDGTACRRRVCFFAHTPDQLRVLPAQQSSPRGAAAAASPLAESYDGSPLRRQAFESYLTKSIMSSSPTSTLMSPPKSPPSESPPLSPDGAAAAFRRGSWPGVGSPVNEVLASLRQLRLSKANSSPAGGWSGYPSSAVAYGSPTATGLYSLPSTPTTMGGYMANLEPLDVSFGGGEEEPVQRVESGRALRAKVFERLSREGAVSGDATAAIGGPDVGWVSDLIN

SEQ ID NO: 3239 - protein, 391 aa, Zea mays; identical to SEQ ID NO: 810
  misc_feature (1)..(391): useful for making plants with increased nitrogen use efficiency as described in USSN 11/654,357
  misc_feature (1)..(391): Ceres CLONE ID no. 327364
  misc_feature (1)..(391): Functional Homolog of  Ceres CLONE ID no. 101255 with e-value of 2.6E-82 and BLAST sequence identity of 58.4%

SEQ ID NO: 3240 - protein, 307 aa, Cucumis sativus; identical to SEQ ID NO: 799
  misc_feature (1)..(307): useful for making plants with increased nitrogen use efficiency as described in USSN 11/654,357
  misc_feature (1)..(307): Public GI no. 56605376
  misc_feature (1)..(307): Functional Homolog of  Ceres CLONE ID no. 101255 with e-value of 1.1E-69 and BLAST sequence identity of 52.7%

SEQ ID NO: 3241 - DNA, 1024 bp, Arabidopsis thaliana
  misc_feature (1)..(1024): useful for making plants with increased nitrogen use efficiency as described in USSN 11/654,357
  misc_feature (1)..(1024): in planta sequence for ME07344
  misc_feature (1)..(1024): in planta sequence for Ceres Clone 101255
aaaaagctttgccggagatttagcaaacacaaacacaaaaaacaaaaccaactcagacgaatgtgattttttcttcttgagtgaattgttgtaaaaaaatgatgatcggagaatctcatcgtggttttaatccaacggttcatattcctccatggccactttctgaagatctaacggtgtctgatatttacggaagtccagacggaggaagtagtatgatggaagctttggctgagttacaacgttatcttccgtcaaacgaaccggatccggattcagatccggatctctcgggtccggattcaccaatcgatgcttatacatgcgatcattttcggatgtatgagtttaaagtgagacgttgtgctcgtggccggagccatgattggacggagtgtccttacgctcatcccggagaaaaagctcgccgtcgtgatccgaggaagtttcattactccggtacggcgtgtcctgagtttcgtaaaggttgttgcaagagaggagacgcatgtgagttttctcatggtgtttttgagtgttggcttcacccggcgcgttaccggactcagccgtgtaaagacggtggtaactgtcgccgtcgtgtttgtttctttgctcattcgccggatcagattagggttttgcctaatcaaagccctgatcgtgttgattcgttcgacgttttgtctcctacgattcgtagagcgtttcagttttcgatttctccgtcgtctaactcgccgccggtgagtccacgaggtgactcggactcgtcgtgttcgttactgagtcgttcactcgggtctaatctgggaaacgacgtcgttgcgtctctcaggaatctgcaacttaataaagtgaagtcttctctttcgtcgtcatacaacaatcaaatcggaggatacggatccggattcgggtcgcctcgtggatcggttttgggtcctggtttccgtagcttaccaactacaccgacccgacctggttttatgaacatttgggagaatggcttggaggaagaacc

SEQ ID NO: 3242 - protein, 153 aa, Triticum aestivum
  misc_feature (1)..(153): useful for making plants with increased nitrogen use efficiency as described in USSN 11/654,357
  misc_feature (1)..(153): Ceres Clone 770946
  misc_feature (1)..(153): Also known as Ceres ME24939
  misc_feature (1)..(153): Functional Homolog of Ceres CLONE ID no. 566305 with e-value of 5.5E-21 and BLAST sequence identity of 37.4%
MKSSADNVDIELVKAVAQAWYAHSGNPRPSRAPADDDDGAGLGARRVGAPRYRPSRFKLEAAAAAAAAAKPPNSRPWDFTQSLWDTYELVTVAQKIESSLAIVDEATARPPRRAFTNEDATRGGGGKRARESRRSLRSLFRRSSSRRFEDSSS

SEQ ID NO: 3243 - protein, 516 aa, Arabidopsis thaliana
  misc_feature (1)..(516): useful for making plants with increased nitrogen use efficiency as described in USSN 11/654,357
  misc_feature (1)..(516): Translation of in planta nucleotide sequence of Ceres Clone 150823
  misc_feature (1)..(516): Also known as Ceres ME03926
  misc_feature (52)..(509): Pfam Name: Glyco_hydro_9; Pfam Description: Glycosyl hydrolase family 9
MALLLVSSSSSYALRVTIFLSFFFFLCNGFSYPTTSSLFNTHHHRHHLAKHNYKDALTKSILFFEGQRSGKLPSNQRMSWRRDSGLSDGSALHVDLVGGYYDAGDNIKFGFPMAFTTTMLSWSVIEFGGLMKSELQNAKIAIRWATDYLLKATSQPDTIYVQVGDANKDHSCWERPEDMDTVRSVFKVDKNTPGSDVAAETAAALAAAAIVFRKSDPSYSKVLLKRAISVFAFADKYRGTYSAGLKPDVCPFYCSYSGYQDELLWGAAWLQNATKNLKYLNYIKINGQILGAAEYDNTFGWDNKHAGARILLTKAFLVQNVKTLHEYKGHADNFICSVIPGAPFSSTQYTPGGLLFKMADANMQYVTSTSFLLLTYAKYLTSAKTVVHCGGSVYTPGRLRSIAKRQVDYLLGDNPLRMSYMVGYGPKFPRRIHHRGSSLPCVASHPAKIQCHQGFAIMNSQSPNPNFLVGVVVGGPDQHDRFPDERSDYEQSEPATYINSPLVGALAYFAHAYGQL

SEQ ID NO: 3244 - DNA, 470 bp, Glycine max
  misc_feature (1)..(470): useful for making plants with increased nitrogen use efficiency as described in USSN 11/654,357
  misc_feature (1)..(470): Ceres CLONE ID no. 658946
  misc_feature (1)..(470): Also known as ME05213
  misc_feature (401)..(401): y is t/u or c
  misc_feature (405)..(405): w is a or t/u
  misc_feature (408)..(408): w is a or t/u
cttgttatgtgcatattcttaggaactctaagtctccctctctttctctctctctttctctctcgctataccaatattaatttgaacctctctcagttcaattccagatagactttgttggcatttgagttttgtcgaatagaaccaaaaagaaaaaatgggaaggcaaccttgctgtgacaaagtggggttgaagaaggggccatggaccgcagaggaggataagaaactcatcaatttcatcctcactaatggccaatgttgctggagagctgtccctaaactagcagggctgttaaggtgtggcaaaagttgcaggctcaggtggacaaattatctgaggccagacttgaaagagaggccttctatcagaataatgaagagaaaatggtcattgatcyccawgcwcaacttggcaatagatggtctaagattgcttctcatctcccaggaagaactgataatgagat

SEQ ID NO: 3245 - DNA, 788 bp, Arabidopsis thaliana
  misc_feature (1)..(788): useful for making plants with increased nitrogen use efficiency as described in USSN 11/654,357
  misc_feature (1)..(788): Ceres CLONE ID no. 4267
  misc_feature (1)..(788): Also known as ME02730
aacaacacttagagaacaagcagaggaatataactttttttttctttttcctttttgcttttttacaaccaaaaaaataaagcaagccgtagagagcaagagacggtgtaaagatgcactacacacgcatctcgccggctttagtaccatctctatcaccaaccgccgcggctgaatctagcgatggtgggacgatgatagctactgttttcatggcccttctcctcccctgcgtcggcatgtgcatcgtcttcctaatctatctattcctcttgtggtgctccacacggcgtcgtatcgaacgccttcgatttgctgaaccggttaaaccggtcgcaggtaaaggcctttcggtgttggagctcgagaaaatccctaaactcaccggaagagagctagccgtaatagctagatcaacggaatgtgctgtttgccttgaagatatagagagtggtcaatcgactcgtctagttcccggttgcaaccatgggtttcaccaattatgtgctgatacgtggctatctaaccacacggtttgtccagtttgccgcgccgagctggctccgaacctacctcaatgtaatgaaaatcaaagtccatgttagaaacagaattttcaaaaacattctttccttcttttttactcgttttgtgtacttctcttgtttttcccttttcttagttttgtgtaagcgttatagagagagaagtttccaggttgtaactagccttgttgtttttttttgtacatgaaattagttttagagtaaattacgaaatttacagcc

SEQ ID NO: 3246 - DNA, 773 bp, Triticum aestivum
  misc_feature (1)..(773): useful for making plants with increased nitrogen use efficiency as described in USSN 11/654,357
  misc_feature (1)..(773): Ceres Clone 770946
  misc_feature (1)..(773): Also known as Ceres ME24939
tttttcaaatcgaatgcggctaccgttggattctctcttgcgccacttgtgaacgtgaggctgatacccggacacgccgtagccgccaaaccgacgggctcaaactcagccgctcacgtccacccgtgcgccgccgaatgccgaacacaaaaccccacccaccccacgcacgcaccgcgccggcgtcggcgtcggcatccgcatgaagagctcggcggacaacgtggacatcgagctggtcaaggcggtggcgcaggcgtggtacgcgcactcgggcaacccgcggccgtcccgcgcgccggcggacgacgacgatggcgccggtctgggcgcgcgccgcgtgggcgccccgcgctacaggccgtcgcggttcaagctggaggccgcggcggcggcggcggcggcggccaagccgccgaacagcaggccgtgggacttcacgcagtcgctgtgggacacctacgagctggtgaccgtggcgcagaagatcgagtccagcctcgccatcgtggacgaggccacggccaggccaccaaggcgtgccttcaccaacgaagacgccacgcgcggcggaggagggaagcgggcgagggagagcaggcgtagcctcaggagcctgttccgccggtcctcgtccaggaggttcgaggattcaagcagctagctagctagctagtgttctcctctctaccttcctgtttctctctctagtccttccttgcctgaaaaacttggcagcgtctatgcaacttagtacagagctatctgtattg

SEQ ID NO: 3247 - DNA, 2343 bp, Panicum virgatum
  misc_feature (1)..(2343): useful for making plants with increased salt and oxidative stress tolerance as described in USSN 11/858,117
  misc_feature (1)..(2343): Ceres CLONE ID no.1792354
agtgactagtgagctcactccctcctccttcccacttgactctgcccgccagctactgaaccaaccaacaaatacctccgggctccctccggctttgccactcccatggattggaggttggaggcctgaagggggaggtgggtcgccggacagggacggggagacggcgagagggcgttccgcaggagccgttcccgtgcttcctccaccgaccgggccgacgcgccgcgccgctgtttcaggttccagaatttcaagtattggccgctttaggatactatgggaaagtccccggggaagtggatcaagtctgtgctcttggggaagaaatcgactaaatccggttctaccaaggcaaatgagtcgaaggctacaaataacaatggacactcagctggggaggagcgtgcattttctgaaaattctccagtgatctctgagccggtgcttgttgaagcccacaaaaatggagctgtttcagttaatgggaaggctgaagatgtcaatttgccaagtgacagggctggccaacaagatctgcagaaccaaagtattgttgagtccgaaacatcagttcctgggcaattgggagaagaccaagctgcagtgaaggcacaggcagcatttcgcggttacctagcacgaaggtcattccgtgcattgaaaggtatcataagactccaggtactgattcgagggcatcttgtaaggagacaggctgtttcaacccttcgaactacttggttgattgtgaagtttcaatctctagttcgtggaagaaatgtcagactctctggtgctgacattcaactcaatgtgaagcttggccaacataaccttggtggcactagatcatctgatgcatggaaagagaagttatcttcaaatgcctatgttcggaagcttctgtcttcaccaatagtgctagaacctcttcacttccagtatgacaagagggatcccaattcaacctataactggctagagagatggaccataggctgcatctggaagcctgtttttcaaccaaaaagagttcctgatgggaaactgctggtaaggaaggctagttatgcaatggaaactgaatcagccaagttaaagcgcaacattaggaagggctctgctgctacagttgagagtttccatacaagagtgactggtgaatctgagaaacttaaacgtaatccaaagaaattctcaaacttccctgctgactcagtaccagatagccagttatctgaacttgagaaggttaaaaggaacctgaggaaggtaactgattccatggctgaagcctcaaagatctctagttccagggttgattcctcaaaggtatctgattctacacctgatgctccaaaagtatctaatcctgtggccgaaatctcaaagacatctagtctcctgaacgggatctctgaccatcaagacagccaatgtgaaaaagcactacagaatacacgtgaggcttcatttcctcttgaaactcaagattactctggcaatggtcagctattggaatattcagatatggataacttcgacttggtacctggtttgaaaagtgatctggaaactcagcttgattcagtttctataggagaaaatgttgatgagcccactgttggtgcttcagcagctgaaggtatgccactgcagaacattgatgagcccattagtttagggaagaaagaggaagcaaggtccaaggaagagcatctgtctaatggaagccttagaactggcaagagaaagtcttcatccccatacaaatcagaatatgtggaaaacgggactcacactactcctgctcagccaaggaagccaagctatatggctgcaacggagtctgcgaaggcgaaattacgagcacagaattcacccagggtggattctgattcatcagcagaaaagaatggcttcactcgacgccactctcttccttccggtacaaacagtagggcgatcaaagctgaatggaagcgctgaggaggcattgacttgaattgaatagtgcgattgtctgaatctctgctgggtgaactctgccgctgcttgctcctttttatttatcctgcgatgtaaagagaagacattgtccctgtattgaacaatctttgtgatgagtgcgtctggttcagtctgtggtaggttcacgtgccaggcctagtgccccgttcattgtatagtcacagttctctcgggattgaaatcgattcctcgtgtaagctgatgttaggactgcagtctgatcgaataacatcatccgcttgcacactgccttaagcccttaattgatatgataccgggcaatttcgtgaaaaaaaaaaaaaaaaaaaa

SEQ ID NO: 3248 - protein, 570 aa, Panicum virgatum
  misc_feature (1)..(570): useful for making plants with increased salt and oxidative stress tolerance as described in USSN 11/858,117
  misc_feature (1)..(570): Ceres CLONE ID no.1792354
  misc_feature (1)..(570): Score of 822.8 for HMM of FIGURE 5 of USSN 11/858,117.
  misc_feature (106)..(126): Pfam Name: IQ Pfam Description: IQ calmodulin-binding motif
MGKSPGKWIKSVLLGKKSTKSGSTKANESKATNNNGHSAGEERAFSENSPVISEPVLVEAHKNGAVSVNGKAEDVNLPSDRAGQQDLQNQSIVESETSVPGQLGEDQAAVKAQAAFRGYLARRSFRALKGIIRLQVLIRGHLVRRQAVSTLRTTWLIVKFQSLVRGRNVRLSGADIQLNVKLGQHNLGGTRSSDAWKEKLSSNAYVRKLLSSPIVLEPLHFQYDKRDPNSTYNWLERWTIGCIWKPVFQPKRVPDGKLLVRKASYAMETESAKLKRNIRKGSAATVESFHTRVTGESEKLKRNPKKFSNFPADSVPDSQLSELEKVKRNLRKVTDSMAEASKISSSRVDSSKVSDSTPDAPKVSNPVAEISKTSSLLNGISDHQDSQCEKALQNTREASFPLETQDYSGNGQLLEYSDMDNFDLVPGLKSDLETQLDSVSIGENVDEPTVGASAAEGMPLQNIDEPISLGKKEEARSKEEHLSNGSLRTGKRKSSSPYKSEYVENGTHTTPAQPRKPSYMAATESAKAKLRAQNSPRVDSDSSAEKNGFTRRHSLPSGTNSRAIKAEWKR

SEQ ID NO: 3249 - DNA, 2278 bp, Gossypium hirsutum
  misc_feature (1)..(2278): useful for making plants with increased salt and oxidative stress tolerance as described in USSN 11/858,117
  misc_feature (1)..(2278): Ceres CLONE ID no.1925477
cccgctccattgatgtcactaaccctaattatacttacacacctacttctcttgtgattcattttacacatttaatttctgaaggccgttttcatctctttcttagcttttatttagttttaaattcactccaaaaaaaaaaaaaaaaacactgcacgggaatctcttgttcgaggaatccttcacggtacgaaattcgttcttcagatctctgaatgctcactgtttaactgttccttggttttttcttctggtaatggcagcttagtagcgaacaaggacttcaaatttgctgcatttttcagatttccagatttagaaacttggaattttaattatttttgggtctaacggagatgggaaaatctccagcaaaatggatcaagaccttacttcttgggaagaaatcttcaaagtccagtttctcaaaaggaaaagagaagctgaaatctgcaaataaaggtgaggttttggtttcttccaaggtgactgtgtctgacctatcagtggatcctccatcaatttcagcacctattctagtgaatagcgctaggaatgtggtggactctgagaagggtatacctgcccaattgccaaatgatggggcaaatattccatctccaaaagtggatggaaatgatgccacaactggtaattttggtaacccagaaaatcctgataggattgggcttgacccagctgctgtgacggtacaggctgctttcagaggttatctggctcgcagggcatttcgaaccctcaagggcattataaggctgcaagcagttattcgtggtcacttggttagaagacaagctgttgctactttatgctgtacatggggaattgttaagttgcaagcactagctcgtggtcaaaaggtcagatgttcagatattgccatggaaatacaagaaaaacatctaagactgcttcagggttctaaaagctcggattctattggagtgagcacatcttctaaggtgaagaatttatcaaataatgtgtttgttcagaagcttttggcctcatcaccttctgtattacctctacaacttcaatatgttccagaggagcctaactcatcctggcagtggcttctacgatggacaatgtcacatttttgggtatcccctttaaaaccagttaggagtggaaagacaaaacgaagtattcagaaactgtccaatgcaaaagttgttaatggatctagtcattctaccttggagcatgaaaaaaacaaacgaggtgtgaggagagtttctggcaactcagcagcagattcagttcggaagcatccacaaaatgagcttgagagggttaagcgcagtttacgaaagctttctgactcttcaaaggaggtttctgataagtctgaagtttttaatgagaaaacaaagaagactccgaaaaaaacttctaattctaatgaccctgatttttcagaacaggaatccgctgagaagataagagatgtgactgcaacactatcagaactgtcaattcttgaggcagatctgaaaatttccctagaagatccttctcttggtgagcctaatctctgtcctgcagttgatttgtcacctgctgaaaacaatcgtaaacttgaggtaatagaggagttaatctctaaagacaagcaggttggtgatgagagctcaaacacaagccaaagaagagcttctttccctgcaaaaattgataatcaggcgaatgggttaaatctcatgccaaaagtgcccagttatatggcagcaactgaatctgcaaaagctagacttaggggtcaaggctccccaatgtttaccccggaggctgttgagaaaaatgggttaaacaggcgatattctctgccatcttcaacctatagtaatacaagttcacagtccccacatggtcaaagacgggttcgagtagctggcaaaggtgctaacatcagtgacaaatctcaatcatcctctaaagatgctaatgataaggttgtcagagctgagtggaggaggtaattcttgcatggggaattgtttcgatgaagtttccatggagtttgtgcacggatgctacttaacaaaacttcccttatgtgttgtaaacttctgatgtttggttgtagaagcaggagagtgaatcatctaatcttttgttgcttggtgtatctttttaagtttccttggcactttcaggtttgtagatgggtaaatatttgtagatgttacagttggttatttggtttatttggttcgtttgtgtttgtacgcaaaaaaaaaaaaaaaaaaaa

SEQ ID NO: 3250 - protein, 549 aa, Gossypium hirsutum
  misc_feature (1)..(549): useful for making plants with increased salt and oxidative stress tolerance as described in USSN 11/858,117
  misc_feature (1)..(549): Ceres CLONE ID no.1925477
  misc_feature (1)..(549): Score of 1112.9 for HMM of FIGURE 5 of USSN 11/858,117.
  misc_feature (113)..(133): Pfam Name: IQ Pfam Description: IQ calmodulin-binding motif
  misc_feature (1)..(549): Functional Homolog Of Ceres CLONE ID no. 1792354
MGKSPAKWIKTLLLGKKSSKSSFSKGKEKLKSANKGEVLVSSKVTVSDLSVDPPSISAPILVNSARNVVDSEKGIPAQLPNDGANIPSPKVDGNDATTGNFGNPENPDRIGLDPAAVTVQAAFRGYLARRAFRTLKGIIRLQAVIRGHLVRRQAVATLCCTWGIVKLQALARGQKVRCSDIAMEIQEKHLRLLQGSKSSDSIGVSTSSKVKNLSNNVFVQKLLASSPSVLPLQLQYVPEEPNSSWQWLLRWTMSHFWVSPLKPVRSGKTKRSIQKLSNAKVVNGSSHSTLEHEKNKRGVRRVSGNSAADSVRKHPQNELERVKRSLRKLSDSSKEVSDKSEVFNEKTKKTPKKTSNSNDPDFSEQESAEKIRDVTATLSELSILEADLKISLEDPSLGEPNLCPAVDLSPAENNRKLEVIEELISKDKQVGDESSNTSQRRASFPAKIDNQANGLNLMPKVPSYMAATESAKARLRGQGSPMFTPEAVEKNGLNRRYSLPSSTYSNTSSQSPHGQRRVRVAGKGANISDKSQSSSKDANDKVVRAEWRR

SEQ ID NO: 3251 - DNA, 1908 bp, Populus balsamifera subsp. trichocarpa
  misc_feature (1)..(1908): useful for making plants with increased salt and oxidative stress tolerance as described in USSN 11/858,117
  misc_feature (1)..(1908): Ceres ANNOT ID no.1521592
atggggagaaaatcacctgcgaaatggataaagactgttttgtttggaaagaagtcttccaaatctcttattgtcaaaggaagggagagaactgtgaatgacaaagagacattggttgctgtcagagccgtggaagctgatgtgacctcagttcctccggtggtcaagccgacagcccccactaccactaatatcactgaaaggatgttagagctagagagcagggaaactacagaatcatcacgtgatggaggtatattgtcaactggaaatcaagatgcaaatcattctcaattatacactcctgatgctcctccatctgatgctgacaaaataaggcttgatgaagctgcgacaatggcacaagccgcatttaggggttacttggctcgccgagcatttcgagctcttaaaggcataataaggcttcaggctcttatccgtggacacttggttagaaggcaagctgttgctactctctgctgtgtgctcggagttgtcaagttacaggctcttgctcgaggaagaatggttaggaattcagagattggctatgaggttcataaattatgcagccaagtaaaactgccggagggcaagcttgcagattctagtggagttggtatacaaatggccaagctgtcatcaaatgcttttgttcgcaagcttcttgctccatcacctgctgtaatgcctttgcaactcccctatgattccatggaaccaaactcagttgcaaactggttagagtgctggtcagcgtcctctttctggaaaccagttccccaaccaaaaaaaattacttgctcaaaaactcagagaaagcagagtaatggtcaaatagtggaagctgaaactggtaggccaaagcgcactgttcggagggtccctgctgcaaatgttgacagtacctcagtacaagcagcctctgaatttgagaaacccaagcgcaatttgaggaaagtttcaagccatccagctgattcagcagaaaattcacagattgagcttgaaaaggtaaagcgcagcttaagaaaggttaataaccccgttatagaaaactctgctcattcagaggttgaaaatgaaaagccaaagcaaggtctagaaaaggtatctggcacttcaggtgataatgttttgggatggagcgtaagtaattcagctgagaagatgaagaaagaagctaccttgacaacatccaatgtacctgatgtggtgaagaatgatccaaacttgatgtccaagttgcctgatgcagagacagctgatgaacctgtagaaatgatcaaggcattggaatcatcacatgacgatcaagctgtggtagaatctaaagcttcagtagatactggtggtatagttgagaatatgcaaataaatgggaagtccatacaccaggatgatccaacaagcaatgaaaatcacaaaactgccaagaaaccttcattcacaatgaaaccagaacgtgccgagaatgggctacagagcagtcccaccctccctagctacatggcagcaactgaatctgcaaaggcaaagctgagaatgcaaggctccccaagatttagtgaagatcgagttgagaaaaataacatcacccgtcgtcattctctgccctcttcaactaatagcaaaatcagctccgagtccccgaggacacaaagagcagttcatggtagtggcaaaggggggaataagagtgacaagtctttattgtcttcaagagatggaaatgctaagggagcccaaccagagtggaagagatcatggtgtagcagtgaaacatggtctatagccggaagggggggaataaagagaaaagaaggaaaaaaaaataaaagtccaccaatgacaaaccaaccacctaacattgacacgcgtcgccccaaaataaagaggacatga

SEQ ID NO: 3252 - protein, 589 aa, Populus balsamifera subsp. trichocarpa
  misc_feature (1)..(589): useful for making plants with increased salt and oxidative stress tolerance as described in USSN 11/858,117
  misc_feature (1)..(589): Ceres ANNOT ID no.1521592
  misc_feature (1)..(589): Score of 1414.1 for HMM of FIGURE 5 of USSN 11/858,117.
  misc_feature (115)..(135): Pfam Name: IQ Pfam Description: IQ calmodulin-binding motif
  misc_feature (1)..(589): Functional Homolog Of Ceres CLONE ID no. 1792354
MGRKSPAKWIKTVLFGKKSSKSLIVKGRERTVNDKETLVAVRAVEADVTSVPPVVKPTAPTTTNITERMLELESRETTESSRDGGILSTGNQDANHSQLYTPDAPPSDADKIRLDEAATMAQAAFRGYLARRAFRALKGIIRLQALIRGHLVRRQAVATLCCVLGVVKLQALARGRMVRNSEIGYEVHKLCSQVKLPEGKLADSSGVGIQMAKLSSNAFVRKLLAPSPAVMPLQLPYDSMEPNSVANWLECWSASSFWKPVPQPKKITCSKTQRKQSNGQIVEAETGRPKRTVRRVPAANVDSTSVQAASEFEKPKRNLRKVSSHPADSAENSQIELEKVKRSLRKVNNPVIENSAHSEVENEKPKQGLEKVSGTSGDNVLGWSVSNSAEKMKKEATLTTSNVPDVVKNDPNLMSKLPDAETADEPVEMIKALESSHDDQAVVESKASVDTGGIVENMQINGKSIHQDDPTSNENHKTAKKPSFTMKPERAENGLQSSPTLPSYMAATESAKAKLRMQGSPRFSEDRVEKNNITRRHSLPSSTNSKISSESPRTQRAVHGSGKGGNKSDKSLLSSRDGNAKGAQPEWKR

SEQ ID NO: 3253 - DNA, 2059 bp, Glycine max
  misc_feature (1)..(2059): useful for making plants with increased salt and oxidative stress tolerance as described in USSN 11/858,117
  misc_feature (1)..(2059): Ceres CLONE ID no.463594
attgtttggttctggttctcaggaatggtagatttgaggtgaagacgttccacattggtcaggtcccgatctcacgatggggaagtcaccaggaaaatggatcaaaactgtactgttcgggaaaaagtcatctaaatcaaatatttcaaaaggcagagagaagcttgttaatcaaaaaggagtagtagttacctccaaggtgccagaaactggtttggctttagaaccaacctccgatactattgccagacatgaggaagatccagagctggaaaataaagaagcagaaaatgttttacccgggaatcaagaaatagacacagtgggatcaattaatgaagatgctgcactagatccagagaaaatgaggctggaggaagcagctacaaaggcacaagctgctttcaggggttatttggctcggagagcatttagggctctaaaaggaataataaggttgcaagcactcatccgtgggcacttggttaggagacaagctgttgttacattatgctcaatgtatggtattgtcaagtttcaagcacttgttcgtggaggaatagttagacagtctaatgttggatctgaaatccatgagaagtccaatatattgaaccctctggatggcaagcttgtcaagccaaatgctatgttcacgaaaattaccaagctgtctgcaaatgctttcattcggaagcttcttacttcgtcaactacaataatggcgctgcggttgcaatatgttcccggcgatccaaattcagtcctaagttggttggagcgctggtcagcatctcacttttggaaaccagttccccaacccaagaaaattcgagatactaagtctcagagaaagcatggcaatatttcagttggagatactcatgtgagcaagtcaaaacgaatcaacaggaagcttcctactgcaagttttgactcggtcccagtgcaagcaaatcctgaatttgaaaaaccaaaacgaaacacaaggaaaatttcaaaccaatcctcagatcctcatgtgcaggaaaacccacaaagtgagcttgaaaagattaaacgtaacttgagaaaggtttataacccagttgttgagaatgctgttccgtcagaagttgaatccgaaatgccaaaggatcatttggaaaaggtaacagttacctcatgccttgctgtttcagagcaagaggtcattagttctaatgagaagatcaagaaggaagcaatattaactgtttccagtgtgccagatatagaaactactccaagactttcagttagtaaggaggtgtctgacacaccaagcagttatcaagtgactgtggaatcaaaaccattgactgagattacaactaaagataaaaacatttctgtttctgacgaagtaaaaaatgagcccatagatttaccagagcctatttgtaaagatgaaaattctcacttaacaaatggagatttgagtcacaaggaagatcaaataggcagtgaaaaccagaaaccaaaccaaaaagcctcaattgtagcaaagcaggaacgtgcagagaatggtatacagaatagtccaacattaccgagttacatggcagcaactgaatctgcaaaggcaaagttgagggcacaaggatccccaagatttggacaggatggaagtgaaagaaacaaccatactcggcgacattctctgccatcctcaactaacagcaaaattaattcaccttcacctaggacacagagaccagttcaatcaggtggcaaaggtggccacagaagtgacagaactgtatcatcttctagagatgggaatggaaaggtaattcaagcagagtggaggcggtaatttgaggaaggccgatgttctggaggaacatgaggagggcgaaaccgtgtgtggtttatatgtatctttgatgagaattgttgaatggataggactataggtgtgcttgaattcaggttatttcttcatttgctgcattttgggctttgagggtgatttgtacattataggtttctagttttgcatgatgcaactataactaaatttaattatgttttaagc

SEQ ID NO: 3254 - protein, 586 aa, Glycine max
  misc_feature (1)..(586): useful for making plants with increased salt and oxidative stress tolerance as described in USSN 11/858,117
  misc_feature (1)..(586): Ceres CLONE ID no.463594
  misc_feature (1)..(586): Score of 730.7 for HMM of FIGURE 5 of USSN 11/858,117.
  misc_feature (100)..(120): Pfam Name: IQ Pfam Description: IQ calmodulin-binding motif
  misc_feature (1)..(586): Functional Homolog Of Ceres CLONE ID no. 1792354
MGKSPGKWIKTVLFGKKSSKSNISKGREKLVNQKGVVVTSKVPETGLALEPTSDTIARHEEDPELENKEAENVLPGNQEIDTVGSINEDAALDPEKMRLEEAATKAQAAFRGYLARRAFRALKGIIRLQALIRGHLVRRQAVVTLCSMYGIVKFQALVRGGIVRQSNVGSEIHEKSNILNPLDGKLVKPNAMFTKITKLSANAFIRKLLTSSTTIMALRLQYVPGDPNSVLSWLERWSASHFWKPVPQPKKIRDTKSQRKHGNISVGDTHVSKSKRINRKLPTASFDSVPVQANPEFEKPKRNTRKISNQSSDPHVQENPQSELEKIKRNLRKVYNPVVENAVPSEVESEMPKDHLEKVTVTSCLAVSEQEVISSNEKIKKEAILTVSSVPDIETTPRLSVSKEVSDTPSSYQVTVESKPLTEITTKDKNISVSDEVKNEPIDLPEPICKDENSHLTNGDLSHKEDQIGSENQKPNQKASIVAKQERAENGIQNSPTLPSYMAATESAKAKLRAQGSPRFGQDGSERNNHTRRHSLPSSTNSKINSPSPRTQRPVQSGGKGGHRSDRTVSSSRDGNGKVIQAEWRR

SEQ ID NO: 3255 - protein, 587 aa, Arabidopsis thaliana
  misc_feature (1)..(587): useful for making plants with increased salt and oxidative stress tolerance as described in USSN 11/858,117
  misc_feature (1)..(587): Public GI ID no.22330633
  misc_feature (1)..(587): Score of 545.5 for HMM of FIGURE 5 of USSN 11/858,117.
  misc_feature (113)..(132): Pfam Name: IQ Pfam Description: IQ calmodulin-binding motif
  misc_feature (1)..(587): Functional Homolog Of Ceres CLONE ID no. 1792354
MGKSTKWLKNVLLGKKTSKSSGSKDKERVVSGKEVLVTSKVEESDVVSDLPSFEVAETNTVDRSGGMLETQNVGPEEISDDEIELPEGKSTDSQNVAPVQDHSLSDAERIQREIAATSVQAAFRGYLARRAFWALKGIIRLQALIRGHLVRRQAVATLFSVMGIVRLQAFARGREIRKSDIGVQVYRKCRLQLLQGNKLANPTDAYLGIKKLTANAFAQKLLASSPKVLPVHAYDTSNPNSNLIWLENWSASCFWKPVPQPKKTISRKPQNRLLVEAESAKPKKSVRKVPASNFESSSVQTSFEFEKPKRSFRKVSSQSIEPPAVEDPQIELEKVKRSLRKVHNPVVESSIQPQRSPRKEVEKPKLGVEKTRESSYPLVHETAEEPVNVCDEKKKQEISEQPEEEVHALEMEVHTPGPLETNEALDSSLVNQIDSNEKAMVEEKPSMEKDTKEEKTPKPNNKENSAGKENQKSRKKGSATSKTEREESNGHHETSPSIPSYMQATKSAKAKLRLQGSPKSAEQDGTEKATVPRRHSLPSPGNGRITSHSPRTTRLANSGDKTGNKKEKPLLSSREGNAKTTPAERKR

SEQ ID NO: 3256 - DNA, 2049 bp, Zea mays
  misc_feature (1)..(2049): useful for making plants with increased salt and oxidative stress tolerance as described in USSN 11/858,117
  misc_feature (1)..(2049): Ceres CLONE ID no.345954
gtttttcgccgagcagttcgcgtgctcccctccacaggccgacgcggcgacgccgctgtttcaggttctggaatttccagtgcgggtgcattaggctgctatgggcaagtcgccggggaagtggatcaaatcggtgcttttggggaagaaatctaccaagtcaggtcctaccaagtcgaatgaatctaaggctgacaacaacagatactcgaccggggaggaccgcacattgtctgagagttctcctgtgatttctgagccggtactagttaacatccacaagaacgtagctatcaatgggaaggctgcagatgccagtgatagggcacggcaacaagatccgcagagccaaagcgttgttgagtccagatcatcggctccagctgctcagctgggagaagatcaagctgcagcgaaggcacaggcagcctttcgtggttacctggcacgaaggtcattccgtgcattaaaaggtatcgtaagactccaggcgctgattcgagggtatcttgtaaggaggcaggctgtatcaacccttcgcgcaacatggttgattgtgaagtttcaggctctagttcgtggaagaaatgttagactctctggcagtcgcatgcagctcaatgtgaagtttggtcagagtaactttgggggtgttagatcgtctgatgcatggaaagagaagctatcttcaaatgcttatgttcggaagcttctgtcttcaccaattgttttagaacctcttcacttccagtatgacaagagggatcccaattcaacctataactggtttgagagatggaccataggttgcatctggaagcctgcttttcaacccaaaagagttgctgatgggaaaccactggtaaagaaggctagttatgcaatggaaactcaatcagccaagttaaaacgcaacattcggaagggttctgctgctatcgctgggagtttccatacatctggtgaatctgataaagtaaaaaggaatccaaagaatttctctagcttccctgctgattcagtaccagatagccagttatctgaacttgaaaaggttaaaaggaacctcaggaaggtaactgattcgatggctgaagcctcaaagatatctagttccagggttgattcctcgaaggtatgtaattctacagctgaggttccaaaggaatctaatcctgtggcagaaatctcaaagatacgtagtctcctgaatgggatctctgaccatcaggatattcaatgtgagaatacacgtgaatcttcatttcctcttggaactcaagaagactctgacaatgatcatctattgcgatattcaaatatggatagcttggacttggtacctggtttgaaaagtgatcaggaaattcagctggattcggtttctataggagaaaatgttgatgatcccactgttgttgctccagcagttgaagaaatgtcaccgcaaaacattgatacggaagacaatgttttatgcaagaaagaggaagcaaggtccaaggaagagcacttgtctaatggaagccttagaactagcaagaggaagtcttcattccccaacaaatcagaatatgtagaaaatgggactcacgctactcctgttcagccaacgcagccaagctatatggctgcaacggagtccgcaaaggcgaaattgcgagcccagaattcacccagtctggattctgattcagcggcagaaaagaatggtttcacccgacgccactctcttccttccagtacaaagagtagagcacttaaagctgaatggaagcgctgaagaggcaacccatcgtccacttgaattgaattgtgcactgctctgaaacttcgctggatgaactcgaccggtcttgtcccatgttcttgctgtattgaacaaccccttgtgaagttgcgattctggttcagtttgtcgtaggttcatgtgcaaccactagtgccttgtgtcgtatattgcatggttcttgtcgaaggaacaatgcctgcgaaagctgatgttaggactgcattaactgaataacatcacccagttgcccaggtctt

SEQ ID NO: 3257 - protein, 560 aa, Zea mays
  misc_feature (1)..(560): useful for making plants with increased salt and oxidative stress tolerance as described in USSN 11/858,117
  misc_feature (1)..(560): Ceres CLONE ID no.345954
  misc_feature (1)..(560): Score of 757.6 for HMM of FIGURE 5 of USSN 11/858,117.
  misc_feature (101)..(121): Pfam Name: IQ Pfam Description: IQ calmodulin-binding motif
  misc_feature (1)..(560): Functional Homolog Of Ceres CLONE ID no. 1792354
MGKSPGKWIKSVLLGKKSTKSGPTKSNESKADNNRYSTGEDRTLSESSPVISEPVLVNIHKNVAINGKAADASDRARQQDPQSQSVVESRSSAPAAQLGEDQAAAKAQAAFRGYLARRSFRALKGIVRLQALIRGYLVRRQAVSTLRATWLIVKFQALVRGRNVRLSGSRMQLNVKFGQSNFGGVRSSDAWKEKLSSNAYVRKLLSSPIVLEPLHFQYDKRDPNSTYNWFERWTIGCIWKPAFQPKRVADGKPLVKKASYAMETQSAKLKRNIRKGSAAIAGSFHTSGESDKVKRNPKNFSSFPADSVPDSQLSELEKVKRNLRKVTDSMAEASKISSSRVDSSKVCNSTAEVPKESNPVAEISKIRSLLNGISDHQDIQCENTRESSFPLGTQEDSDNDHLLRYSNMDSLDLVPGLKSDQEIQLDSVSIGENVDDPTVVAPAVEEMSPQNIDTEDNVLCKKEEARSKEEHLSNGSLRTSKRKSSFPNKSEYVENGTHATPVQPTQPSYMAATESAKAKLRAQNSPSLDSDSAAEKNGFTRRHSLPSSTKSRALKAEWKR

SEQ ID NO: 3258 - DNA, 2049 bp, Zea mays; identical to SEQ ID NO: 3256
  misc_feature (1)..(2049): useful for making plants with increased salt and oxidative stress tolerance as described in USSN 11/858,117
  misc_feature (1)..(2049): Ceres CLONE ID no.345954

SEQ ID NO: 3259 - protein, 574 aa, Zea mays
  misc_feature (1)..(574): useful for making plants with increased salt and oxidative stress tolerance as described in USSN 11/858,117
  misc_feature (1)..(574): Ceres LOCUS ID no. Os01m05025_AP003288
  misc_feature (1)..(574): Score of 858.7for HMM of FIGURE 5 of USSN 11/858,117.
  misc_feature (98)..(118): Pfam Name: IQ Pfam Description: IQ calmodulin-binding motif
  misc_feature (1)..(574): Functional Homolog Of Ceres CLONE ID no. 1792354
MGKSPAKWIKSVLLGKKSAKSNSTKAKDLAKAANNKPVLSEDPPVISEPALVNSHNDGNAENCKLPNGVAVEAMGQGVENQNIVGSKAPTSPEKLSEELAAVKAQAAFRGYLARRAFRALKGIIRLQALIRGHLVRRQAASTLRVTWLIVKLQALVRGRNVRLSGASIQFVVKSGQHKFLSDKPSDAWKEKVSSNAYVRKLLSSSIGLEALHLQYDKRDPNSLYNWLERWTISQIWKSSSQPKKVADGKPQVRKASYAMETESAKLKRNVRKSSAVTVDSFQTNMTVEPEKIKRNSRKFSSSAADSVPDSQLSELEKVKRNLRKVTNSMAEASKISSSRADASKVSSSMADASKVSSSTADASKVSDSVAQIPPSLVNGISDHQDNQCEEAQQNACVSFPPETQELHSGILLEDNSHMNLLEPDLISNPETPFTSILTWEKFNDSTADAQEVEVLPLQNIDNEDNFPENGVLGKKEKPRSKEEPLSNGNLKTSKRRSSFSTKSDYPENGAQNTPVPRRKPSYMAATESAKAKLRGQNSPRLDSDSPADMNGFTRRQSLPSSTNNRAIRAEWRRW

SEQ ID NO: 3260 - protein, 582 aa, Oryza sativa subsp. indica
  misc_feature (1)..(582): useful for making plants with increased salt and oxidative stress tolerance as described in USSN 11/858,117
  misc_feature (1)..(582): Public GI ID no.125527495
  misc_feature (1)..(582): Score of 851.5 for HMM of FIGURE 5 of USSN 11/858,117.
  misc_feature (98)..(118): Pfam Name: IQ Pfam Description: IQ calmodulin-binding motif
  misc_feature (1)..(582): Functional Homolog Of Ceres CLONE ID no. 1792354
MGKSPAKWIKSVLLGKKSAKSNSTKAKDLAKAANNKPVLSEDPPVISEPALVNSHNDGNAENCKLPNGVAVEAMGQGVENQNIVGSKAPTSPEKLSEELAAVKAQAAFRGYLARRAFRALKGIIRLQALIRGHLVRRQAASTLRVTWLIVKLQALVRGRNVRLSGASIQFVVKSGQHKFLSDKPSDAWKEKVSSNAYVRKLLSSSIGLEALHLQYDKRDPNSLYNWLERWTISQIWKSSSQPKKVADGKPQVRKASYAMETESAKLKRNVRKSSAVTVDSFQTNMTVEPEKIKRNSRKFSSSAADSVPDSQLSELEKVKRNLRKVTNSMAEASKISSSRADASKVSSSMADASKVSSSTADASKVSDSVAQIPPSLVNGISDHQDNQCEEAQQNACVSFPPETQELHSGILLEDNSHMNLLEPDLISNPETPFTSILTWEKFNDSTADAQEVEVLPLQNIDNEDNFPENGVLGKKEKPRSKEEPLSNGNLKTSKRRSSFSTKSDYPENGAQNTPVPRRKPSYMAATESAKAKLRGQNSPRLDSDSPADMNGFTRRQSLPSSTNSKLNPHSPHTQGPIYFKFD

SEQ ID NO: 3261 - protein, 580 aa, Oryza sativa subsp. indica
  misc_feature (1)..(580): useful for making plants with increased salt and oxidative stress tolerance as described in USSN 11/858,117
  misc_feature (1)..(580): Public GI ID no.125553119
  misc_feature (1)..(580): Score of 656.4 for HMM of FIGURE 5 of USSN 11/858,117.
  misc_feature (1)..(580): Functional Homolog Of Ceres CLONE ID no. 1792354
MGKSPAKWIKSVLFGKKSSRSGSTKAKDLSKGSNNKGYAAAGKDAGFESSPVISEPVLVTPHNNEAVQEVGRGENSSLQGEVVVRDVSQDLEKQNTVVSDASNDPERLREEQAAVKAQAAFRGYLHGIGPGTSGIPCVERNHKTPSPDSWASRKEASRCNSSCNMVDCEVSSSSPWLTRPHTRNMCPNLLALKPHKQPIMLYKSYKSGKRDAWKEKLSSNAFARKLLASPILVEALHFQYDERDPNSAFNWLERWTIGRVWRPISHPKRAAVTDAKPHTRKASYAMETESGKLKRNSRRSSAAPVESSQTNMAMETEKSRRNPRKFTSSTADSVPESQLTELEKVKRNLRKVTNSMAEASKVSTPATEIPERQEVQCEKPQRTAEEVPNYPEIQEPQNGNLLENAKTDILVPDLQPEPEVPSYQVETEEKVAELTVADPAVETMPLQDIHNEENALVNDMEQRSKEEPLSTESLKSSKRRSSFSTKTEYPENGSKNSPAVPSYMAATQSAKAKLRGQNLPRLSSDSAEKNGFTRRHSLPSSNGKLNSHSPRTQRPTHAGGKEGVKADKSMLSSRDASGKL

SEQ ID NO: 3262 - DNA, 2368 bp, Zea mays
  misc_feature (1)..(2368): useful for making plants with increased salt and oxidative stress tolerance as described in USSN 11/858,117
  misc_feature (1)..(2368): Ceres CLONE ID no.236431
agctgatttattttctctcgctctcgccttcgcggcgctgcctgcgcagtactacgagctagcaggctagcagcaccaggaccaggagcctcttcccacacttccgctcttcctctctctctttcctctcgagaatggttgtgtaggcgggcgcaggagggaggagagagaggggagctagctagggttttgcgtcgccgccttctgttacccttaggctctgaacccctccggtccagtgcggcggcggattaggctccgatggggaagtctccggcgaagtggatcaagtccgtgctcttcggtaaaaagtcgtcgtcgaggtccggctccaccaaggccaaggatttatcgaagggtaccactaacaaagcggcggctgctgctgctgccgggaaggagcctgcgttctctgagagctctccggtcatctcggagcctgtgcttgttagcgcccacaacaatgagaccgcgcgggaggccgctaagggtgagaattccagcgtgcaagaagtgccagtgactgatgttagtcaagacttggagaagcagggcactgttgggtctgatacgtctaatgatgctgagaggttgagggaagagcaagcggccgtgaaggcacaagctgccttccgtggttatctggcacgccgagcattccgtgccctgaaagggatcataagactacaggcactgattcggggacatcttgtaaggaggcaagctgtttcaactctccgtgctacatggttgattgtgaagtttcaagcccttgtccgtggaaggaacgttagactttctaaagtttccattcaaccaactacggaactttcccaacagaacttcgggggttctaaacctggttcctggaaggagaagttgtcttcaaatgcatttgctcggaagcttctctcttcaccaattgtggttgaggctcttcatgtccagtatgatgagatggaccctaattcggccttcaattggttagagaggtggacagtaagtcatgtctggaagcctatttcccaaccaaagagagttggtgctgatactaagcctcatacaaggaaggccagttatgcaatggaaacagagtcagcgaaattaaagcgtaatgcacggaagagccctgcagtgccatttgagccttctcaaacaaacaccaccattgaaaatgagaagacaagacggaatccaaggaaattaagtagcactcctgctgagtcagttcccgatggccagttaacagaacttgagaaggttaaacgtagccttaggaaggttactagttccatggttgaaacctcaaaggtgcctagcccaacaactgagattcctgaccgtcaagaggtacaatgtgagagaccactaagaagtgcaaagcaagctccaattcatgttgagaatcaagaacctcagaatgttaatctatcggacaatgcaaagatggatattctggtaccagatatccagcctgacgtggaagttgcttcagatctagtcacaatcacaaatgaagaaaaagttgatgagacaccgtctgttgttgctccagcgactgaaattatgccactgcaagacatcaacagcgaagaaaatgctttggtgaatgatgtggaagagagatccaaagaagaacatccatctactgataacctgaaaggcagcaagaggaggtcttcattctcagttaagcctgaatatccagaaaatggctccaaaaattctccagctctgccaagctacatggctgctacacaatctgcaaaggcgaaactgcgggggaattgttcaccaagacttagctctgattcagcagagaaaaacgggttcactcgtcgtcactcccttccgtcccctaacaatggtaagataatttcacattctccacgtacgcaaaggccaacccatgctggtggcaaggacggagcaaaaggcgacaaggctatgctgtcatcaagagatgcgagcgagagaccactgaaagctgagtggagacgctgaggtggcgaatcaaaaccccaaaccctccatttggttagtgcaactatttgggttggtggatggcgtctgcagtttgctccgattgttttgcttgtgatgtaaaaaagacgttatcatcatcatccgaggcgatgaacgggttcagctttgttgtgatgaatctgctgggagtcaacttatttacagggttttgggtcatgccttttgtgatgtatagctgaagtattttcccggtttgtttttgtttcccagacccccagactcccccctccccctcctgcttgctgagagggctgctgatgttagagagaacgagaacctgtatggattgagttgaacagaacaatcttagtcccgtttggtc

SEQ ID NO: 3263 - protein, 580 aa, Zea mays
  misc_feature (1)..(580): useful for making plants with increased salt and oxidative stress tolerance as described in USSN 11/858,117
  misc_feature (1)..(580): Ceres CLONE ID no.236431
  misc_feature (1)..(580): Score of 1099.7 for HMM of FIGURE 5 of USSN 11/858,117.
  misc_feature (114)..(134): Pfam Name: IQ Pfam Description: IQ calmodulin-binding motif
  misc_feature (1)..(580): Functional Homolog Of Ceres CLONE ID no. 1792354
MGKSPAKWIKSVLFGKKSSSRSGSTKAKDLSKGTTNKAAAAAAAGKEPAFSESSPVISEPVLVSAHNNETAREAAKGENSSVQEVPVTDVSQDLEKQGTVGSDTSNDAERLREEQAAVKAQAAFRGYLARRAFRALKGIIRLQALIRGHLVRRQAVSTLRATWLIVKFQALVRGRNVRLSKVSIQPTTELSQQNFGGSKPGSWKEKLSSNAFARKLLSSPIVVEALHVQYDEMDPNSAFNWLERWTVSHVWKPISQPKRVGADTKPHTRKASYAMETESAKLKRNARKSPAVPFEPSQTNTTIENEKTRRNPRKLSSTPAESVPDGQLTELEKVKRSLRKVTSSMVETSKVPSPTTEIPDRQEVQCERPLRSAKQAPIHVENQEPQNVNLSDNAKMDILVPDIQPDVEVASDLVTITNEEKVDETPSVVAPATEIMPLQDINSEENALVNDVEERSKEEHPSTDNLKGSKRRSSFSVKPEYPENGSKNSPALPSYMAATQSAKAKLRGNCSPRLSSDSAEKNGFTRRHSLPSPNNGKIISHSPRTQRPTHAGGKDGAKGDKAMLSSRDASERPLKAEWRR

SEQ ID NO: 3264 - DNA, 2129 bp, Triticum aestivum
  misc_feature (1)..(2129): useful for making plants with increased salt and oxidative stress tolerance as described in USSN 11/858,117
  misc_feature (1)..(2129): Ceres CLONE ID no.908518
agaacctctctctctcctctgctccacgccacagaagagaacaaacagtaggaggagcgctctccttcggccgcgagcgtctgcgtcccgcaatggaggcgtgatggttggcgcggatagaggggtagcgggacagggaaggtgagcaatctgccgggagagcgccgacgccccgcccagtccagcccaggtccagaatttccggtgtttgagcagttttagtaggctgctatggggaagtccccggccaagtggataaagtccgtgctcctcgggaagaaatcaacaaaatccaattctaccaaggcaaaggatcttccagcaaaggctgcaaacagcaacggatgcactgctgggaaggagcctgaatcctctgataattctcccctcatctcggagccggtacttgttagctcccacaatgtgtctgaaatttccaacttgcccaatgggagggcaatcgaaaacatggttagagttgggtccgacacgcaaattagtccagagaaactgagagaagaactagcagcagtgaaggcgcaagccgcttttcgaggttacctggcacgcagggccttccgcgcattaaaaggtatcatcagacttcaggcactgattcgagggcatcttgtaaggaggcaggccgtttcaacccttcgtggaacatggttgattgtgaagtttcaagctctagttcgtggaagaaatgttagattttctagtgctgccacgcaattagctgtgaagtttggtcaacataagtatgggggtgacaagtcgtcggatgcatggaaggagaagctatcttcacatccatatgttcgaaagcttctgtcttcaccaattttggtacaagctcttcacgttcagtatgatgagacaaaccccaattcagccctcaactggctggagagatggacaataagctgcatctggaagcctgtttccaaaccaaaaatagttactgacgggaaaccacaagtaaggagggccagttatgccatggaaactcactcagcaaagttaaagcgcaatgttcggaagtcttctactgccactgttgagactcaggcaaataccgttgaatctgaaaaatggaaaagaaacccacggaaattgaatggctcacctgctgattcagtaccagacagccagttatctgaacttgagaaggttaaaaggaaccttaagaaggcagctaactccatggctgaagcctctaagatatctaccaaggctgatgtgttgaaggtacctaattccatagctgatgagctgaagatacttggttccatggctgaactatcaaaaaaatccagcataccaaacggtatctctgaccatcaagacagcgaatgcgagaaagcactagagagtacacgtgaggctgtgtttcctcttggaactcaagattctcacagtggcaatcttttggaaaattcaaatataagtaagttggtacctgacataaaatatgatctagaagcatcattcttaggggacaaagttaatgaacccactactgtcgctcaagcagatgaagtcatacaactgcagaaccttgataacggatatgatattatagaaaggaaagaagagactaggtccaaggaagaacctctgcctaatggaagccttaaaaccaagagaaggtcttcgttctctaattcagaataccctgagagtggaaccaagaacactccagttccatcaaggaagccaagctatatggctccaacagaatcgttaaaggcgaaattgcgaggaccacccagattagactctgatctaccagtggacaagaatgccttcactcgccgtcagtctcttccttctgctgcaaacaatagagcaatcaaaacagaatggaggcggtgaagaggctatcaagcttccaacagaagggtgcattattgtggaagaaatttcaagctgtataaattattgattagtttatgaagtttgctgatgtctacctgtctctgtccttgttgttctgtctacgttataaacatatgttcttacgcccttttcgaactagcttgtggtgatatgtttggtgctattttttcctcgagttatcttatagttccttggtccgtgtattaaatgtaaaaaaaaaaaaaaaa

SEQ ID NO: 3265 - protein, 548 aa, Triticum aestivum
  misc_feature (1)..(548): useful for making plants with increased salt and oxidative stress tolerance as described in USSN 11/858,117
  misc_feature (1)..(548): Ceres CLONE ID no.908518
  misc_feature (1)..(548): Score of 1274.3 for HMM of FIGURE 5 of USSN 11/858,117.
  misc_feature (97)..(117): Pfam Name: IQ Pfam Description: IQ calmodulin-binding motif
  misc_feature (1)..(548): Functional Homolog Of Ceres CLONE ID no. 1792354
MGKSPAKWIKSVLLGKKSTKSNSTKAKDLPAKAANSNGCTAGKEPESSDNSPLISEPVLVSSHNVSEISNLPNGRAIENMVRVGSDTQISPEKLREELAAVKAQAAFRGYLARRAFRALKGIIRLQALIRGHLVRRQAVSTLRGTWLIVKFQALVRGRNVRFSSAATQLAVKFGQHKYGGDKSSDAWKEKLSSHPYVRKLLSSPILVQALHVQYDETNPNSALNWLERWTISCIWKPVSKPKIVTDGKPQVRRASYAMETHSAKLKRNVRKSSTATVETQANTVESEKWKRNPRKLNGSPADSVPDSQLSELEKVKRNLKKAANSMAEASKISTKADVLKVPNSIADELKILGSMAELSKKSSIPNGISDHQDSECEKALESTREAVFPLGTQDSHSGNLLENSNISKLVPDIKYDLEASFLGDKVNEPTTVAQADEVIQLQNLDNGYDIIERKEETRSKEEPLPNGSLKTKRRSSFSNSEYPESGTKNTPVPSRKPSYMAPTESLKAKLRGPPRLDSDLPVDKNAFTRRQSLPSAANNRAIKTEWRR

SEQ ID NO: 3266 - protein, 574 aa, Oryza sativa subsp. japonica
  misc_feature (1)..(574): useful for making plants with increased salt and oxidative stress tolerance as described in USSN 11/858,117
  misc_feature (1)..(574): Public GI ID no.115465121
  misc_feature (1)..(574): Score of 966.7 for HMM of FIGURE 5 of USSN 11/858,117.
  misc_feature (111)..(131): Pfam Name: IQ Pfam Description: IQ calmodulin-binding motif
  misc_feature (1)..(574): Functional Homolog Of Ceres CLONE ID no. 1792354
MGKSPAKWIKSVLFGKKSSRSGSTKAKDLSKGSNNKGYAAAGKDAGFESSPVISEPVLVTPHNNEAVQEVGRGENSSLQGEVVVRDVSQDLEKQNTVVSDASNDPERLREEQAAVKAQAAFRGYLARRAFRALKGIIRLQALIRGHLVRRQAVATLRATWLIVKFQALVRGRNVRLSTNTIQVNWKLVQQQSGSGKRDAWKEKLSSNAFARKLLASPILVEALHFQYDERDPNSAFNWLERWTIGRVWRPISHPKRAAVTDAKPHTRKASYAMETESGKLKRNSRRSSAAPVESSQTNIAMETEKSRRNPRKFTSSTADSVPESQLTELEKVKRNLRKVTNSMAEASKVSTPATEIPERQEVQCEKPQRTAEEVPNYPEIQEPQNGNLLENAKTDILVPDLQPEPEVPSYQVETEEKVAELTVADPTVETMPLQDIHNEENALVNDMEQRSKEEPLSTESLKSSKRRSSFSTKTEYPENGSKNSPAVPSYMAATQSAKAKLRGQNSPRLSSDSAEKNGFTRRHSLPSSNGKLNSHSPRTQRPTHAGGKEGVKADKSMLSSRDASERPAKAEWKR

SEQ ID NO: 3267 - DNA, 2529 bp, Panicum virgatum
  misc_feature (1)..(2529): useful for making plants with increased salt and oxidative stress tolerance as described in USSN 11/858,117
  misc_feature (1)..(2529): Ceres CLONE ID no.1791910
ggattggaggttggaggcctgaagggggaggtgggtcgccggacagggacggggagacggcgagagggcgttccgcaggagccgttcccgtgcttcctccaccgaccgggccgacgcgccgcgccgctgtttcaggttcccgcccctgcatttttctgcttgtgcttgcgctagttgcgagggtaggttgcggcgttagagattggttcgcggcttctgtgcggcgctgtgtttgtttggccagatccgcgtgtgtgctgctgactcttcgtgatttcctcttctgtttgagctttccttgctcggctttgtgctgctgcctgcctgctgcttctttttctggccactgcatttgggttgtgtgccgcgctacttatcctgctctgcttgtgtttaagattacagctcgtgtttctttcaacgatattttcacctttgtttcatcacttgggaagctggtgccgtaaaagagtctgctaaaccatgctaactttagcgaaattactgttactccagctgtccagcatgttccttccttcatcttagtgaaaataaagtatgttgtggcatactggtatggatctgtgcattgctgagctcctctgtttacaggttccagaatttcaagtattggccgctttaggatactatgggaaagtccccggggaagtggatcaagtctgtgctcttggggaagaaatcgactaaatccggttctaccaaggcaaatgagtcggctacaaataacaatggacactcagctggggaggagcgtgcattttctgaaaattctccagtgatctctgagccggtgcttgttgaagcccacaaaaatggagctgtttcagttaatgggaaggctgaagatgtcaatttgccaagtgacagggctggccaacaagatctgcagaaccaaagtattgttgagtccgaaacatcagttcctgggcaattgggagaagaccaagctgcagtgaaggcacaggcagcatttcgcggttacctagcacgaaggtcattccgtgcattgaaaggtatcataagactccaggcactgattcgagggcatcttgtaaggagacaggctgtttcaacccttcaaactacttggttgattgtgaagtttcaatctctagttcgtggaagaaatgtcagactctctggtgctgacattcaactcaatgtgaagcttggccaacataaccttggtggcactagatcatctgatgcatggaaagagaagttatcttcaaatgcctatgttcggaagcttctgtcttcaccaatagtgctagaacctcttcacttccagtatgacaagagggatcccaattcaacctataactggctagagagatgcaccataggctgcatctggaagcctgtttttcaaccaaaaagagttcctgatgggaaactgctggtaaggaaggctagttatgcaatggaaactgaatcagccaagttaaagcgcaacattaggaagggctctgctgctacagttgagagtttccatacaagagtgactggtgaatctgagaaacttaaacgtaatccaaagaaattctcaaacttccctgctgactcagtaccagatagccagttatctgaacttgagaaggttaaaaggaacctgaggaaggtaactgattccatggctgaagcctcaaagatctctagttccagggttgattcctcaaaggtatctgattctacacctgatgctccaaaagtatctaatcctgtggccgaaatctcaaagacatctagtctcctgaacgggatctctgaccatcaagacagccaatgtgaaaaagcactacagaatacacgtgaggcttcatttcctcttgaaactcaagattactctggcaatggtcagctattggaatattcagatatggataacttcgacttggtacctggtttgaaaagtgatctggaaactcagcttgattcagtttctataggagaaaatgttgatgagcccactgttggtgcttcagcagctgaaggtatgccactgcagaacattgataagcccaatagtttagggaagaaagaggaagcaaggtccaaggaagagcatctgtctaatggaagccttagaactggcaagagaaagtcttcatccccatacaaatcagaatatgtggaaaacgggactcacactactcctgctcagccaaggaagccaagctatatggctgcaacggagtctgcgaaggcgaaattacgagcacagaattcacccagggtggattctgattcatcagcagaaaagaatggcttcactcgacgccactctcttccttccggtacaaacagtagggcgatcaaagctgaatggaagcgctgaggaggcattggcttgaattgaatagtgcgattgtctgaatctctgctgggtgaactctgccgctgcttgctcctttttatttatcctgcgatgtaaagagaagacgttgtccctgtattgaacaatctttgtgatgagtgcgtctggttcaaaaaaaaaaaaaaaaaaaa

SEQ ID NO: 3268 - protein, 569 aa, Panicum virgatum
  misc_feature (1)..(569): useful for making plants with increased salt and oxidative stress tolerance as described in USSN 11/858,117
  misc_feature (1)..(569): Ceres CLONE ID no.1791910
  misc_feature (1)..(569): Score of 824.9 for HMM of FIGURE 5 of USSN 11/858,117.
  misc_feature (105)..(125): Pfam Name: IQ Pfam Description: IQ calmodulin-binding motif
  misc_feature (1)..(569): Functional Homolog Of Ceres CLONE ID no. 1792354
MGKSPGKWIKSVLLGKKSTKSGSTKANESATNNNGHSAGEERAFSENSPVISEPVLVEAHKNGAVSVNGKAEDVNLPSDRAGQQDLQNQSIVESETSVPGQLGEDQAAVKAQAAFRGYLARRSFRALKGIIRLQALIRGHLVRRQAVSTLQTTWLIVKFQSLVRGRNVRLSGADIQLNVKLGQHNLGGTRSSDAWKEKLSSNAYVRKLLSSPIVLEPLHFQYDKRDPNSTYNWLERCTIGCIWKPVFQPKRVPDGKLLVRKASYAMETESAKLKRNIRKGSAATVESFHTRVTGESEKLKRNPKKFSNFPADSVPDSQLSELEKVKRNLRKVTDSMAEASKISSSRVDSSKVSDSTPDAPKVSNPVAEISKTSSLLNGISDHQDSQCEKALQNTREASFPLETQDYSGNGQLLEYSDMDNFDLVPGLKSDLETQLDSVSIGENVDEPTVGASAAEGMPLQNIDKPNSLGKKEEARSKEEHLSNGSLRTGKRKSSSPYKSEYVENGTHTTPAQPRKPSYMAATESAKAKLRAQNSPRVDSDSSAEKNGFTRRHSLPSGTNSRAIKAEWKR

SEQ ID NO: 3269 - protein, 567 aa, Oryza sativa subsp. japonica
  misc_feature (1)..(567): useful for making plants with increased salt and oxidative stress tolerance as described in USSN 11/858,117
  misc_feature (1)..(567): Public GI ID no.125595019
  misc_feature (1)..(567): Score of 928.2 for HMM of FIGURE 5 of USSN 11/858,117.
  misc_feature (111)..(131): Pfam Name: IQ Pfam Description: IQ calmodulin-binding motif
  misc_feature (1)..(567): Functional Homolog Of Ceres CLONE ID no. 1792354
MGKSPAKWIKSVLFGKKSSRSGSTKAKDLSKGSNNKGYAAAGKDAGFESSPVISEPVLVTPHNNEAVQEVGRGENSSLQGEVVVRDVSQDLEKQNTVVSDASNDPERLREEQAAVKAQAAFRGYLARRAFRALKGIIRLQALIRGHLVRRQAVATLRATWLIVKFQALVRGRNVRLSTNTIQVNWKLVQQQSGSGKRDAWKEKLSSNAFARKLLASPILVEALHFQYDERDPNSAFNWLERWTIGRVWRPISHPKRAAVTDAKPHTRKASYAMETESGKLKRNSRRSSAAPVESSQTNIAMETEKSRRNPRKFTSSTADSVPESQLTELEKVKRNLRKVTNSMAEASKVSTPATEIPERQEVQCEKPQRTAEEVPNYPEIQEPQNGNLLENAKTDILVPDLQPEPEVPSYQVETEEKVAELTVADPTVETMPLQDIHNEENALVNDMEQRSKEEPLSTESLKSSKRRSSFSTKTEYPENGSKNSPAVPSYMAATQSAKAKLRGQNSPRLSSDSAEKNGFTRRHSLPSSNGKLNSHSPRTQRPTHAGGKEGVKADKSMLSSRDASGKL

SEQ ID NO: 3270 - protein, 636 aa, Arabidopsis thaliana
  misc_feature (1)..(636): useful for making plants with increased salt and oxidative stress tolerance as described in USSN 11/858,117
  misc_feature (1)..(636): Public GI ID no.42568886
  misc_feature (1)..(636): Score of 1517.7 for HMM of FIGURE 5 of USSN 11/858,117.
  misc_feature (129)..(149): Pfam Name: IQ Pfam Description: IQ calmodulin-binding motif
  misc_feature (1)..(636): Functional Homolog Of Ceres CLONE ID no. 1792354
MGKTPSPGKWIKSLLGKKSSKSSLEKGGEKLRSAKKEELVVKVKDNNVSKLPTEPPVVSSQEVAATQTVVVPDVVIAEKQLSGDIEGDESSNVNLESGNDSEEVKLEEAATKVQAALRAQQAREESQNLKGITRVQAVIRGHLVRRQAVATYSCIWGIVKVQALVRGKKARSSETVAQLQKTNTETETSETLQGSTYSWMENPTKLSMIDKLLVSSPTTLPLKIQYSPEDPNSAKVWLGRWTQLQVWAPGPLVVKNLVPKSQTKKRSFQAVEAEKGKLKRGVRKPTGVSTTANSSTSRSTADNEKPKRTVRKASTLGKELSKIENDKSKQSSRKSTSAIKEGSSVEVKDEKPRISHKKASLSNGIGKATRKSAEKKKEIADAVQKELPIEEVSVSLVDAPEDEKMNLIPVTISKESDLDKDEKSLVLDKPEQDELRTAERDDKAEEELKTAERDDSAEEKIQEPDAQISSENGNVASENTKPSDRRASLPAKIENHHQDDGLTQSGRKIPSYMAPTASAKARIRGQGSPRIAQEKPEKNGTTRRHSLPPAANGKLSTMSPRAHRLLIASAKGSMNSDRSFSSSKDIGGKRFKPITIHKPFCQFLLHYLHPFNKFSSCLYQTSRRKLSGNGESTKAE

SEQ ID NO: 3271 - protein, 650 aa, Arabidopsis thaliana
  misc_feature (1)..(650): useful for making plants with increased salt and oxidative stress tolerance as described in USSN 11/858,117
  misc_feature (1)..(650): Public GI ID no.2947062
  misc_feature (1)..(650): Score of 1502.4 for HMM of FIGURE 5 of USSN 11/858,117.
  misc_feature (143)..(163): Pfam Name: IQ Pfam Description: IQ calmodulin-binding motif
  misc_feature (1)..(650): Functional Homolog Of Ceres CLONE ID no. 1792354
MGKTPSPGKWIKSLLGKKSSKSSLEKGGEKLVRRVNRSAKKEELVVKVKDNNVSKLPTEPPVVSSQEVAATQTVVVPDVVIAEKQLSGDIEGDESSNVNLESGNDSEEVKLEEAATKVQAALRAQQVNVYIFDILAREESQNLKGITRVQAVIRGHLVRRQAVATYSCIWGIVKVQALVRGKKARSSETVAQLQKTNTETETSETLQGSTYSWMENPTKLSMIDKLLVSSPTTLPLKIQYSPEDPNSAKVWLGRWTQLQVWAPGPLVVKNLVPKSQTKKRSFQAVEAEKGKLKRGVRKPTGVSTTANSSTSRSTADNEKPKRTVRKASTLGKELSKIENDKSKQSSRKSTSAIKEGSSVEVKDEKPRISHKKASLSNGIGKATRKSAEKKKEIADAVQKELPIEEVSVSLVDAPEDEKMNLIPVTISKESDLDKDEKSLVLDKPEQDELRTAERDDKAEEELKTAERDDSAEEKIQEPDAQISSENGNVASENTKPSDRRASLPAKIENHHQDDGLTQSGRKIPSYMAPTASAKARIRGQGSPRIAQEKPEKNGTTRRHSLPPAANGKLSTMSPRAHRLLIASAKGSMNSDRSFSSSKDIGGKRFKPITIHKPFCQFLLHYLHPFNKFSSCLYQTSRRKLSGNGESTKAE

SEQ ID NO: 3272 - DNA, 1881 bp, Populus balsamifera subsp. trichocarpa
  misc_feature (1)..(1881): useful for making plants with increased salt and oxidative stress tolerance as described in USSN 11/858,117
  misc_feature (1)..(1881): Ceres ANNOT ID no.1468228
atggggagaaaatcacctgcgaaatggataaagactgttttgtttggaaagaagtcttccaaatctcttattgtcaaaggaagggagagaactgtgaatgacaaagagacattggttgctgtcagagccgtggaagctgatgtgacctcagttcctccggtggtcaagccgacagcccccactaccactaatatcactgaaaggatgttagagctagagagcagggaaactacagaatcatcacgtgatggaggtatattgtcaactggaaatcaagatgcaaatcattctcaattatacactcctgatgctcctccatctgatgctgacaaaataaggcttgatgaagctgcgacaatggcacaagccgcatttaggggttacttgataggtgcactactggggctgttttcatggaccttgagggttcgactgacttggtaccaggctcgccgagcatttcgagctcttaaaggcataataaggcttcaggctcttatccgtggacacttggttagaaggcaagctgttgctactctctgctgtgtgctcggagttgtcaagttacaggctcttgctcgaggaagaatggttaggaattcagagattggctatgaggttcataaattatgcagccaagtaaaactgccggagggcaagcttgcagattctagtggagttggtatacaaatggccaagctgtcatcaaatgcttttgttcgcaagcttcttgctccatcacctgctgtaatgcctttgcaactcccctatgattccatggaaccaaactcagttgcaaactggttagagtgctggtcagcgtcctctttctggaaaccagttccccaaccaaaaaaaattacttgctcaaaaactcagagaaagcagagtaatggtcaaatagtggaagctgaaactggtaggccaaagcgcactgttcggagggtccctgctgcaaatgttgacagtacctcagtacaagcagcctctgaatttgagaaacccaagcgcaatttgaggaaagtttcaagccatccagctgattcagcagaaaattcacagattgagcttgaaaaggtaaagcgcagcttaagaaaggttaataaccccgttatagaaaactctgctcattcagaggttgaaaatgaaaagccaaagcaaggtctagaaaaggtatctggcacttcaggtgataatgttttgggatggagcgtaagtaattcagctgagaagatgaagaaagaagctaccttgacaacatccaatgtacctgatgtggtgaagaatgatccaaacttgatgtccaagttgcctgatgcagagacagctgatgaacctgtagaaatgatcaaggcattggaatcatcacatgacgatcaagctgtggtagaatctaaagcttcagtagatactggtggtatagttgagaatatgcaaataaatgggaagtccatacaccaggatgatccaacaagcaatgaaaatcacaaaactgccaagaaaccttcattcacaatgaaaccagaacgtgccgagaatgggctacagagcagtcccaccctccctagctacatggcagcaactgaatctgcaaaggcaaagctgagaatgcaaggctccccaagatttagtgaagatcgagttgagaaaaataacatcacccgtcgtcattctctgccctcttcaactaatagcaaaatcagctccgagtccccgaggacacaaagagcagttcatggtagtggcaaaggggggaataagagtgacaagtctttattgtcttcaagagatggaaatgctaagggagcccaaccagagtggaagagatcatggtgtagcagtgaaacatggtctatagccggaagggagtatgtggattaa

SEQ ID NO: 3273 - protein, 626 aa, Populus balsamifera subsp. trichocarpa
  misc_feature (1)..(626): useful for making plants with increased salt and oxidative stress tolerance as described in USSN 11/858,117
  misc_feature (1)..(626): Ceres ANNOT ID no.1468228
  misc_feature (1)..(626): Score of 1490.5 for HMM of FIGURE 5 of USSN 11/858,117.
  misc_feature (157)..(177): Pfam Name: IQ Pfam Description: IQ calmodulin-binding motif
  misc_feature (1)..(626): Functional Homolog Of Ceres CLONE ID no. 1792354
MGRKSPAKWIKTVLFGKKSSKSLIVKGRERTVNDKETLVAVRAVEADVTSVPPVVKPTAPTTTNITERMLELESRETTESSRDGGILSTGNQDANHSQLYTPDAPPSDADKIRLDEAATMAQAAFRGYLIGALLGLFSWTLRVRLTWYQARRAFRALKGIIRLQALIRGHLVRRQAVATLCCVLGVVKLQALARGRMVRNSEIGYEVHKLCSQVKLPEGKLADSSGVGIQMAKLSSNAFVRKLLAPSPAVMPLQLPYDSMEPNSVANWLECWSASSFWKPVPQPKKITCSKTQRKQSNGQIVEAETGRPKRTVRRVPAANVDSTSVQAASEFEKPKRNLRKVSSHPADSAENSQIELEKVKRSLRKVNNPVIENSAHSEVENEKPKQGLEKVSGTSGDNVLGWSVSNSAEKMKKEATLTTSNVPDVVKNDPNLMSKLPDAETADEPVEMIKALESSHDDQAVVESKASVDTGGIVENMQINGKSIHQDDPTSNENHKTAKKPSFTMKPERAENGLQSSPTLPSYMAATESAKAKLRMQGSPRFSEDRVEKNNITRRHSLPSSTNSKISSESPRTQRAVHGSGKGGNKSDKSLLSSRDGNAKGAQPEWKRSWCSSETWSIAGREYVD

SEQ ID NO: 3274 - DNA, 2050 bp, Gossypium hirsutum
  misc_feature (1)..(2050): useful for making plants with increased salt and oxidative stress tolerance as described in USSN 11/858,117
  misc_feature (1)..(2050): Ceres CLONE ID no.1942388
atttagttttaaattcactaaaaaaaagcctgcacgagattctcttgttcgaggaatccttcacgatctctgaatgctcacagttccggtaatggcagcttagtaccgaacaaggacttcatatttgatactcttttcagatttccagatttagaaacttgggattttaattatttttgggtttaactgagatggggaaatctccagcgaaatggatcaagaccttgcttcttgggaagaaatcttcaaagtccagtttctcaaaaggaaaagataagctgaattctgcaaataaaggtgaggttttggtttcttccaaggtaactgtgtctgacctatcagcggattctccatcgatttcagcacctattctagtgagccgtgctaggaatgtgatggactctgagaagggtatacctgcccaattgccgattgatggggaaaatattccatctctaaaagtggatggaaataatgccacaaccggtaattttggtaacccagaaaatcctgataggattaggcttgacccagctgctgtgacagtacaggctgctttcagaggttatctggctcgccgggaatttcgaatcctcaagggcattataaggctgcaggcagttattcgtggtcacttggttagaagacaagctgttgctactttatgctgtacatggggaattgttaagttgcaagcactagctcgtggtcaaaaggtcagatgttcagatattgccatggaaatacaggaaaaacatctaagactgcttcagggtttgaaaagctcaaattctgtaggagcgagcatatcttctacagtgaagaatttatcaagtaatgtgtttgttcagaagcttttggcctcgtcaccttctgtattgcctctacaacttcagtatgttccagaggagcctaactcatcctggcaatggcttcaacgatggacaagatcacaattttgggaatacccctcaaaaccaattaggagtggaaagacaaagctaagtgttcagaaactatcctttgcaaaagctgttaatggatctagtcattctacattggagtatgaaaaaaataaacgaggtctgaggagaatttctgtcaactcagcagcagattcagttcgggagcatccacaaaatgagctcgagagggttaagcgcaatttaagaaagctttccaactcttcaaaggaggttactgataagtctgagtttgttaatgagaaaacaaagaagactctgaaaaaatattctagttctaatggccctgatgttttagaacaggaatctgctgagaagataagagatgtgactgcaacactatcagaactgtcaattcttgaggcagatctgaaattttcctcagaacatgcttctcttggtgagcctattgtctgtcctgcagttgattttccaccggccaaaaacaatggtaaaattgagcacatgccactaacagaggagttaaactctaaggatgagcaggtcggtgatgagagctcaaacacaaaccaaagaagagcttctttcccagcaaatattgataatcaggcaaatcggttaaatcacatgccaaaagtgcccagttatatggcaccaactgaatctgcgaaagctagacttaggggtcaagggtccccaaggtttatccccgaggctgttgagaaaaatgggttaaacaggcggtattctttgccaacttcaaccaatagtaatacaggttcacaatccccacatactcaaagacaggttcgagtagctggcaaaggtgctatcatcagtgacaaatctcaatcatcctctaaagatgctaatgataaggtggtcagagccgagtggaggaggtaattcttgcacaaggaattgtttcgatgaagtttccatgggtaaatatttgtagatgttacagttgtttatttggttcgtttttgtttggacgtaaaattctttggatcccctgttcactcttttctaccatttaatatcataggaatagagtgtgcccatctccatatctggctttcgtagaaaaaaaaaaaaaaaaaaaa

SEQ ID NO: 3275 - protein, 552 aa, Gossypium hirsutum
  misc_feature (1)..(552): useful for making plants with increased salt and oxidative stress tolerance as described in USSN 11/858,117
  misc_feature (1)..(552): Ceres CLONE ID no.1942388
  misc_feature (1)..(552): Score of 1315.8 for HMM of FIGURE 5 of USSN 11/858,117.
  misc_feature (113)..(133): Pfam Name: IQ Pfam Description: IQ calmodulin-binding motif
  misc_feature (1)..(552): Functional Homolog Of Ceres CLONE ID no. 1792354
MGKSPAKWIKTLLLGKKSSKSSFSKGKDKLNSANKGEVLVSSKVTVSDLSADSPSISAPILVSRARNVMDSEKGIPAQLPIDGENIPSLKVDGNNATTGNFGNPENPDRIRLDPAAVTVQAAFRGYLARREFRILKGIIRLQAVIRGHLVRRQAVATLCCTWGIVKLQALARGQKVRCSDIAMEIQEKHLRLLQGLKSSNSVGASISSTVKNLSSNVFVQKLLASSPSVLPLQLQYVPEEPNSSWQWLQRWTRSQFWEYPSKPIRSGKTKLSVQKLSFAKAVNGSSHSTLEYEKNKRGLRRISVNSAADSVREHPQNELERVKRNLRKLSNSSKEVTDKSEFVNEKTKKTLKKYSSSNGPDVLEQESAEKIRDVTATLSELSILEADLKFSSEHASLGEPIVCPAVDFPPAKNNGKIEHMPLTEELNSKDEQVGDESSNTNQRRASFPANIDNQANRLNHMPKVPSYMAPTESAKARLRGQGSPRFIPEAVEKNGLNRRYSLPTSTNSNTGSQSPHTQRQVRVAGKGAIISDKSQSSSKDANDKVVRAEWRR

SEQ ID NO: 3276 - protein, 570 aa, Arabidopsis thaliana
  misc_feature (1)..(570): useful for making plants with increased salt and oxidative stress tolerance as described in USSN 11/858,117
  misc_feature (1)..(570): Public GI ID no.12324824
  misc_feature (1)..(570): Score of 428.7 for HMM of FIGURE 5 of USSN 11/858,117.
  misc_feature (105)..(124): Pfam Name: IQ Pfam Description: IQ calmodulin-binding motif
  misc_feature (1)..(570): Functional Homolog Of Ceres CLONE ID no. 1792354
MIVFFFFFFCSNYSYNNAQRVVSGKEVLVTSKVEESDVVSDLPSFEVAETNTVDRSGGMLETQNVGPEEISDDEIELPEGKSTDSQNVAPVQDHSLSDAERIQREIAATSVQAAFRGYLARRAFWALKGIIRLQALIRGHLVRRQAVATLFSVMGIVRLQAFARGREIRKSDIGVQVYRKCRLQLLQGNKLANPTDAYLGIKKLTANAFAQKLLASSPKVLPVHAYDTSNPNSNLIWLENWSASCFWKPVPQPKKTISRKPQNRLLVEAESAKPKKSVRKVPASNFESSSVQTSFEFEKPKRSFRKVSSQSIEPPAVEDPQIELEKVKRSLRKVHNPVVESSIQPQRSPRKEVEKPKLGVEKTRESSYPLVHETAEEPVNVCDEKKKQEISEQPEEEVHALEMEVHTPGPLETNEALDSSLVNQIDSNEKAMVEEKPSMEKDTKEEKTPKPNNKENSAGKENQKSRKKGSATSKTEREESNGHHETSPSIPSYMQATKSAKAKLRLQGSPKSAEQDGTEKATVPRRHSLPSPGNGRITSHSPRTTRLANSGDKTGNKKEKPLLSSREGNG

SEQ ID NO: 3277 - protein, 570 aa, Arabidopsis thaliana
  misc_feature (1)..(570): useful for making plants with increased salt and oxidative stress tolerance as described in USSN 11/858,117
  misc_feature (1)..(570): Public GI ID no.5882749
  misc_feature (1)..(570): Score of 428.1 for HMM of FIGURE 5 of USSN 11/858,117.
  misc_feature (105)..(124): Pfam Name: IQ Pfam Description: IQ calmodulin-binding motif
  misc_feature (1)..(570): Functional Homolog Of Ceres CLONE ID no. 1792354
MEMLAYFLSEFQICYNNAQRVVSGKEVLVTSKVEESDVVSDLPSFEVAETNTVDRSGGMLETQNVGPEEISDDEIELPEGKSTDSQNVAPVQDHSLSDAERIQREIAATSVQAAFRGYLARRAFWALKGIIRLQALIRGHLVRRQAVATLFSVMGIVRLQAFARGREIRKSDIGVQVYRKCRLQLLQGNKLANPTDAYLGIKKLTANAFAQKLLASSPKVLPVHAYDTSNPNSNLIWLENWSASCFWKPVPQPKKTISRKPQNRLLVEAESAKPKKSVRKVPASNFESSSVQTSFEFEKPKRSFRKVSSQSIEPPAVEDPQIELEKVKRSLRKVHNPVVESSIQPQRSPRKEVEKPKLGVEKTRESSYPLVHETAEEPVNVCDEKKKQEISEQPEEEVHALEMEVHTPGPLETNEALDSSLVNQIDSNEKAMVEEKPSMEKDTKEEKTPKPNNKENSAGKENQKSRKKGSATSKTEREESNGHHETSPSIPSYMQATKSAKAKLRLQGSPKSAEQDGTEKATVPRRHSLPSPGNGRITSHSPRTTRLANSGDKTGNKKEKPLLSSREGNG

SEQ ID NO: 3278 - DNA, 1461 bp, Zea mays
  misc_feature (1)..(1461): useful for making plants with increased salt and oxidative stress tolerance as described in USSN 11/858,117
  misc_feature (1)..(1461): Ceres CLONE ID no.325403
aaatgcatttgctcgcaagcttctatcttcatcaattgtggttgaggctcttcacttccagtatgatgagatggaccctaattcagccttcaattggttagagaggtggacgataagtcatgtctggaagcccacttcccagccaaggagagttagtgctgatgctaagccacatacaaggaaggccagctatgcaatggaaacagagtcagtgaaattaaagcgtaatgcacggaggagctctgcagtgccatttgaaccttctcaaacaaacactgccattgaaattgagaagacaagacggaatccaaggaaattaagtagcactcctgctgagtcagttcctgatggccagttaacagaacttgagaaggttaaacgtagccttaggaaggttactaattctgtggctgaaacctcgaaggcacctagtccaaaaactgagattcctaaccatcaagaggtccaatgtgagagaccactaagaagagcaaaacaggttccaattcatcttgagaatcaagagcctgataatgttaatctgttggacaatgcaaagatggatattctggtacctgatatccagcctgatgtggaagttgcttcagatccagtcaccatcactaatgaagaaaatgttgatgaaccaccatctgttgttgctccagtggccgaaattatgcccctgcaagacatcaacaacgatgaaaatgctttggtgaatgatgtggaagagagatccaaagaagaacatccttgtactgagagcctgaaaggcagcaagaggaggtcttcattctcagctaagcctgaatatccagaaaatggctccaaaaattctccagctctgccaagctacatggctgctacacaatcagcaaaggcgaaactgcggggaaatagctcaccaaaacttagctctgattcagcagagaaaaacggcttcactcgtcgtcactcccttccatcctctaacaacggtaagatggtttcacattctccacgtacacaaaggccagctaatgctggttgcaaggatggagcgaaaggtgacaaggctatgctgtcatcaagagatgcaagcgagagaccactgaaagctgagtggagacgttgaggcggcgaatcaaatccaaatcctccatttgattagcgtgaccgtttgggtggatggatcgcccttgcagtttgctcggatttgttttgtttgtgatgtaaaaaaatgatgtcgtcatcgtcggcgagatgaatgaaccggctttgttgtgatgaatccgctgggagtcaacttatttattatagggttttccgtcatgccttttgtgatgtatagctgaagtattttcccggtttgttttggttcccagacccccagacttcctcccttcttgttgagagctgctgatgttagagagaatgagaacatgcatggattgagttgaacaatcttacccatttggt

SEQ ID NO: 3279 - protein, 371 aa, Zea mays
  misc_feature (1)..(371): useful for making plants with increased salt and oxidative stress tolerance as described in USSN 11/858,117
  misc_feature (1)..(371): Ceres CLONE ID no.325403
  misc_feature (1)..(371): Score of 576.4 for HMM of FIGURE 5 of USSN 11/858,117.
  misc_feature (1)..(371): Functional Homolog Of Ceres CLONE ID no. 1792354
NAFARKLLSSSIVVEALHFQYDEMDPNSAFNWLERWTISHVWKPTSQPRRVSADAKPHTRKASYAMETESVKLKRNARRSSAVPFEPSQTNTAIEIEKTRRNPRKLSSTPAESVPDGQLTELEKVKRSLRKVTNSVAETSKAPSPKTEIPNHQEVQCERPLRRAKQVPIHLENQEPDNVNLLDNAKMDILVPDIQPDVEVASDPVTITNEENVDEPPSVVAPVAEIMPLQDINNDENALVNDVEERSKEEHPCTESLKGSKRRSSFSAKPEYPENGSKNSPALPSYMAATQSAKAKLRGNSSPKLSSDSAEKNGFTRRHSLPSSNNGKMVSHSPRTQRPANAGCKDGAKGDKAMLSSRDASERPLKAEWRR

SEQ ID NO: 3280 - DNA, 783 bp, Oryza sativa subsp. Japonica
  misc_feature (1)..(783): useful for making plants with increased salt and oxidative stress tolerance as described in USSN 11/858,117
  misc_feature (1)..(783): Ceres GI ID no.56784328
atgcggggtttccccgttccggtgacgagttggagctccgccgcgctcctgggccgctccatctcctcggccagggacgcggccgaggcctcctcccccatcaccgccgcggagatggtccgggtggcgaaggaggtggccaacgccgccgacgcctgcggagtctccggcaagaagctgctggaggctgcggaagcgctgtccaggtccgacaccgacgcggagccgaggcggcgcgccgccgagcggattttcgatgcggcgtccatggtggccaaggaggccgacgcgtcaggagcgtcgggtctctcagatgcggcccaaaatctgacctgcgcgacctacgcgttctcggtagccgcctcgggatgggggtccttgccggagtccagcacgagcgggagggacgccggcgacctcctaaccgagccccttcttgggtcatgtcaggacaagaacgagaagatgaccggcgagggcaaggacttcagcgagatgaggaatagtgcagcggactctgatccacttcagcaatcggagattaaggagtcgtccctttttggaaaatgcaaagaactcctcaattatggttttcttggaggtcctgccctcctaccctatctaggctctggactgaggaaaacagtgtcaccctgcagcccgtctgtcttccactacatcttctcgtcgtggtggatttgcattgttgtcggatcacatgaacaaggagacttgaagatattacatatcgatagaatcacttctcatccaaatgataagtag

SEQ ID NO: 3281 - protein, 260 aa, Oryza sativa subsp. Japonica
  misc_feature (1)..(260): useful for making plants with increased salt and oxidative stress tolerance as described in USSN 11/858,117
  misc_feature (1)..(260): Ceres GI ID no.56784328
  misc_feature (1)..(260): Score of 660.5 for HMM of FIGURE 6 of USSN 11/858,117.
MRGFPVPVTSWSSAALLGRSISSARDAAEASSPITAAEMVRVAKEVANAADACGVSGKKLLEAAEALSRSDTDAEPRRRAAERIFDAASMVAKEADASGASGLSDAAQNLTCATYAFSVAASGWGSLPESSTSGRDAGDLLTEPLLGSCQDKNEKMTGEGKDFSEMRNSAADSDPLQQSEIKESSLFGKCKELLNYGFLGGPALLPYLGSGLRKTVSPCSPSVFHYIFSSWWICIVVGSHEQGDLKILHIDRITSHPNDK

SEQ ID NO: 3282 - protein, 311 aa, Oryza sativa subsp. Japonica
  misc_feature (1)..(311): useful for making plants with increased salt and oxidative stress tolerance as described in USSN 11/858,117
  misc_feature (1)..(311): Public GI ID no.56784330
  misc_feature (1)..(311): Score of 826.7 for HMM of FIGURE 6 of USSN 11/858,117.
  misc_feature (1)..(311): Functional Homolog Of Ceres GI ID no. 56784328
MESRLLRSAALLARAARLARAAATSTGRAVTAEHLAEVVASAAGDRGFPSGALRQAALALARSSAPEARPRATAEVVRAAAMVFRAAQEAGSPGVAEVAGDLAHAAHDCVRALVESGPAAERPRCLLRLWRRKNRHNKNAAGEADLEAPLLHPHERPSSSSSPIGASLSEIIELSESERDFINYGMFGALAIFPYLTRTGGLKSAYSPLSPSTFHIIFCTWWICVGLDVLCGNRGRAMMKNILAFILAFYARASARLAILGVSLLVILYSHLELAPNEIYTLYILLGAATCMHLLVWAMDYMSRAPGDAAD

SEQ ID NO: 3283 - protein, 311 aa, Oryza sativa subsp. indica
  misc_feature (1)..(311): useful for making plants with increased salt and oxidative stress tolerance as described in USSN 11/858,117
  misc_feature (1)..(311): Public GI ID no.125528718
  misc_feature (1)..(311): Score of 812.3 for HMM of FIGURE 6 of USSN 11/858,117.
  misc_feature (1)..(311): Functional Homolog Of Ceres GI ID no. 56784328
MESRLLRSAALLARAARLARAAATSTGRAVTAEHLAEVVASAAGDRGFPSGALRQAALALARSSAPEASPRAAAEVVHAAAMVFRAAQEAGSPGVAEVAGDLAHAAHDCVRALVESGPAAERPRCLLRLWRRKNRHNKNAAGEADLEAPLLHPHERPSSSSSPIGASLSDIIELSQSERDFINYGMFGALAIFPYLTRTGGLKSAYSPLSPSTFHIIFCTWWICVGLDVLCGNRGRAMMKNILAFILAFYARASARLAILGVSLLVILYSHLELAPNEIYTLYILLGAATCMHLLVWAMDYMSRAPGDAAD

SEQ ID NO: 3284 - protein, 250 aa, Oryza sativa subsp. japonica
  misc_feature (1)..(250): useful for making plants with increased salt and oxidative stress tolerance as described in USSN 11/858,117
  misc_feature (1)..(250): Public GI ID no.125572975
  misc_feature (1)..(250): Score of 571.2 for HMM of FIGURE 6 of USSN 11/858,117.
  misc_feature (1)..(250): Functional Homolog Of Ceres GI ID no. 56784328
MRGFPVPVTSWSSAALLGRSISSARDAAEASSPITAAEMVRVAKEVANAADACGVSGKKLLEAAEALSRSDTDAEPRRRAAERIFDAASMVAKEADASGASGLSDAAQNLTCATYAFSVAASGWGSLPESSTSGRDAGDLLTEPLLGSCQDKNEKMTGEGKDFSEMRNSAADSDPLQQSEIKESSLFGKCKELLNYGFLGGPALLPYLGSGLRKTVSPCSPSVFHYIFSSWWICIVVVDELFVRIIDCSQ

SEQ ID NO: 3285 - protein, 250 aa, Oryza sativa subsp. indica
  misc_feature (1)..(250): useful for making plants with increased salt and oxidative stress tolerance as described in USSN 11/858,117
  misc_feature (1)..(250): Public GI ID no.125528716
  misc_feature (1)..(250): Score of 567.3 for HMM of FIGURE 6 of USSN 11/858,117.
  misc_feature (1)..(250): Functional Homolog Of Ceres GI ID no. 56784328
MRGFPVPVTSWSSAALLGRAISSARDAAEASSPITAAEMVRVAKEVANAADACGVSDKKLLEAAEALSRSDTDAEPRRRAAERIFDAASMVAKEADASGASGLSDAAQNLTCATYAFSVAASGWGSLPESSTSGRDAGDLLTEPLLGSCQDKNEKMTGEGKDFSEMRNSAADSDPLQQSEIKESSLFGKCKELLNYGFLGGPALLPYLGSGLRKTVSPCSPSVFHYIFSSWWICIVVVDELFVRIIDCSQ

SEQ ID NO: 3286 - DNA, 1443 bp, Arabidopsis thaliana
  misc_feature (1)..(1443): useful for making plants with increased salt and oxidative stress tolerance as described in USSN 11/858,117
  misc_feature (1)..(1443): Ceres SEEDLINE ID no.ME06748
aattgtctcttcttttctttttgtacttgtcaaaaacaaaaagaacaacaaaaaaaatctcaaccgtagaaaattccgacaagagttcagttcatacaatgaactaagtatgggtttctttggaagactgttcggaagtaagaagcaagaaaaggcaacaccgaacagacgaagatggagcttcgctactagatcctcacatcccgagaatgattcgtcttctcatccaagcaagagacgtggggatgaagatgtcttaaacgccgacaagcatgcgatagccgtcgcggctgctacagctgcagtggctgaagccgcactcgctgctgctcgtgcggcggcggaagtcgtgagactcaccaatggtggtagaaactcgtcggtaaaacaaatcagtcggagtaatcgtcggtggtctcaagagtataaagcagctatccgcttttcgtggctacttggcgaggagggcgttgagagcactgaaggcattagtgaagcttcaagcgttggtgaagggacacatagtaaggaaacaaacggctgatatgctgcgtcgaatgcaaacgctggttcggctccaagcacgagctagagcttcgcgttcttctcacgtttctgactcttcccatccgccaacactaatgattccatcttccccacaatctttccatgcacgatgcgtttcagaggctgagtacagtaaagtcattgccatggatcaccaccacaacaaccaccgttcaccgatgggttcaagccggttattagaccaatggaggacagaggaaagtctatggagcgcaccaaagtacaatgaagatgatgacaaaatcctagaagtcgacacttggaagcctcacttcagagagtcaccaaggaaaagaggatctctagtggttcctacaagtgtggagaacagtccacaattaaggtctagaacaggaagcagcagtggtggttcaaggagaaaaactcccttcacgcctgcgagaagcgagtacgagtactactctgggtatcaccctaactacatggctaacactgagtcttacaaagcaaaagtccgatcacaaagcgcaccaagacagagactacaagatttaccttcagagagtggttacaagaggtctatacagggacagtattactactacacacctgctgcagagcgatcgtttgatcagcgttcggataacgggatcgcgggttacagaggagtttctgatgggttagatcgaaaccaaagtgacaaatcgaagatgtacacttcgtttttcagttctaatcctcttttctttcaatagtcgagaaaggatgaaaaaagtgagtggaatgtgtaaaattagatttcgacacacgagtacagagacagccagtgatcaatctgtgttttgtactattttctaattgactgtatccaacaagggtccattcttgtctgac

SEQ ID NO: 3287 - protein, 252 aa, Arabidopsis thaliana
  misc_feature (1)..(252): useful for making plants with increased salt and oxidative stress tolerance as described in USSN 11/858,117
  misc_feature (1)..(252): Ceres SEEDLINE ID no.ME06748
  misc_feature (1)..(252): Score of 176.1 for HMM of FIGURE 2 of USSN 11/858,117.
MLRRMQTLVRLQARARASRSSHVSDSSHPPTLMIPSSPQSFHARCVSEAEYSKVIAMDHHHNNHRSPMGSSRLLDQWRTEESLWSAPKYNEDDDKILEVDTWKPHFRESPRKRGSLVVPTSVENSPQLRSRTGSSSGGSRRKTPFTPARSEYEYYSGYHPNYMANTESYKAKVRSQSAPRQRLQDLPSESGYKRSIQGQYYYYTPAAERSFDQRSDNGIAGYRGVSDGLDRNQSDKSKMYTSFFSSNPLFFQ

SEQ ID NO: 3288 - protein, 517 aa, Arabidopsis thaliana
  misc_feature (1)..(517): useful for making plants with increased salt and oxidative stress tolerance as described in USSN 11/858,117
  misc_feature (1)..(517): Ceres SEEDLINE ID no.ME20711
  misc_feature (169)..(189): Pfam Name: IQ Pfam Description: IQ calmodulin-binding motif
  misc_feature (1)..(517): Score of 943.4 for HMM of FIGURE 2 of USSN 11/858,117.
  misc_feature (1)..(517): Functional Homolog Of Ceres SEEDLINE ID no. ME06748
MGKKGSWFSAIKRVFTPHSKEKQLSNNNQEPEIKSENKEKKKKGFGKKLRNGETNSFLPIFRQPSSIEKILSEAEREHNLVFRPPTPTDRANSSSTSVASPLVRPASPKVPSQRYVSSPKPISPRVAYPQVHYPKPPSPKPPSPRAVSPRIVQRREFVHRPEPSLLVKNAYAIKIQAAFRGYMARRSFRALKGLVRLQGVVRGHSVKRQTMNAMKYMQLLVRVQTQVQSRRIQMLENRARNDKDDTKLVSSRMSDDWDDSVLTKEEKDVRLHRKIDAMIKRERSMAYAYSHQLWKNSPKSAQDIRTSGFPLWWNWVDRQKNQNQPFRLTPTRPSLSPQPQSSNQNHFRLNNSFDTSTPNSSKSTFVTPSRPIHTPQPYSSSVSRYSRGGGRATQDSPFKDDDSLTSCPPFSAPSYMAPTVSAKAKLRANSNPKERMDRTPVSTNEKRRSSFPLGSFKWNKGSLFMSNNSNNKGPGSSSSGAVVLEKHKTLKSVGNLSIDSTVSMPATIGRRAFNRFA

SEQ ID NO: 3289 - protein, 383 aa, Arabidopsis thaliana
  misc_feature (1)..(383): useful for making plants with increased salt and oxidative stress tolerance as described in USSN 11/858,117
  misc_feature (1)..(383): Ceres SEEDLINE ID no.ME18973
  misc_feature (115)..(135): Pfam Name: IQ Pfam Description: IQ calmodulin-binding motif
  misc_feature (1)..(383): Score of 543.8 for HMM of FIGURE 2 of USSN 11/858,117.
  misc_feature (1)..(383): Functional Homolog Of Ceres SEEDLINE ID no. ME06748
MGRATRWFKGLFGIKPSSCSGTDSGTISNRLDRSLCDSYETIPPNISEKEAAWLRSFYAAGEEEKERRTHAIAVAAATAAAADAAVAAAKAAAAVVRLQGQGKSGPLGGGKSREHRAAMQIQCAFRGYLARKALRALRGVVKIQALVRGFLVRNQAAATLRSMEALVRAQKTVKIQRALRRNGNAAPARKSTERFSGSLENRNNGEETAKIVEVDTGTRPGTYRIRAPVLSGSDFLDNPFRRTLSSPLSGRVPPRLSMPKPEWEECSSKFPTAQSTPRFSGGSPARSVCCSGGGVEAEVDTEADANRFCFLSGEFNSGYMADTTSFRAKLRSHSAPRQRPESNASAGGWRRSIGGGGVRMQRQSCSGVREAVVGNIERRRMRW

SEQ ID NO: 3290 - protein, 460 aa, Arabidopsis thaliana
  misc_feature (1)..(460): useful for making plants with increased salt and oxidative stress tolerance as described in USSN 11/858,117
  misc_feature (1)..(460): Ceres SEEDLINE ID no.ME08732
  misc_feature (128)..(148): Pfam Name: IQ Pfam Description: IQ calmodulin-binding motif
  misc_feature (1)..(460): Score of 822.2 for HMM of FIGURE 2 of USSN 11/858,117.
  misc_feature (1)..(460): Functional Homolog Of Ceres SEEDLINE ID no. ME06748
MAKKKSWFSLVKRLFIWDTHSTQDKKEKRRKWIFGRLKSKRLPSIKAPLPSKGTTLSEAEQEQSKHALTVAIASAAAAEAAVTAAHAAAEVVRLTGQRNENSEESQPVKTRNGAPQSTYQCQREIKESAAAIKIQTAFRGYLARKALRALKGIVKLQAIIRGRAVRRQAMSSLKCLQSIVSIQSQVCARRLQMVEGRCDYSENEEMQDFKDKIIRMDSNSERKWDESTVLKEEVDTSCTSKRERTKEYSFNHRRSAESERSKVNGRWRYWLEQWVDTQLSKSKELEDLDSVFSSHSRAGEEYGGRQLKLRSNIQRQNPVEGLDSPILGSRRSFPHRRQCSVGEDHSFLSSPATPAYMAATESAKAKARSTSSPKIRTGGNVDMNSDSYSPCKKKLSIASSINSEMLSNGRVGKLSVNQQQRSPSFKGLSVPIKSSRTTIKDLSINSDCSLPNWDRQAFFK

SEQ ID NO: 3291 - protein, 403 aa, Arabidopsis thaliana
  misc_feature (1)..(403): useful for making plants with increased salt and oxidative stress tolerance as described in USSN 11/858,117
  misc_feature (1)..(403): Ceres SEEDLINE ID no.ME19657
  misc_feature (117)..(137): Pfam Name: IQ Pfam Description: IQ calmodulin-binding motif
  misc_feature (1)..(403): Score of 695.5 for HMM of FIGURE 2 of USSN 11/858,117.
  misc_feature (1)..(403): Functional Homolog Of Ceres SEEDLINE ID no. ME06748
MGFFGRLFGSKKKSDKAASSRDKRRWSFTTRSSNSSKRAPAVTSASVVEQNGLDADKHAIAVAAATAAVAEAALTAAHAAAEVVRLTSGNGGRNVGGGGNSSVFQIGRSNRRWAQENIAAMKIQSAFRGYLARRALRALKALVKLQALVRGHIVRKQTADMLRRMQTLVRLQSQARARASRSSHSSASFHSSTALLFPSSSSSPRSLHTRCVSNAEVSSLDHRGGSKRLDWQAEESENGDKILEVDTWKPHYHPKPLRSERNNESPRKRQQSLLGPRSTENSPQVGSSGSRRRTPFTPTSRSEYSWGCNNYYYSGYHPNYMANTESYKAKVRSQSAPKQRVEVSNETSGYKRSVQGQYYYYTAVEEESLDVGSAGYYGGGGGDSDRLNRNQSAKSRMHSSFLV

SEQ ID NO: 3292 - DNA, 1711 bp, Triticum aestivum
  misc_feature (1)..(1711): useful for making plants with increased salt and oxidative stress tolerance as described in USSN 11/858,117
  misc_feature (1)..(1711): Ceres CLONE ID no.835818
ccaaatccaatgctctacatttcttccttctcgtgccctttcttgatttgcgcatggacagtgacttgcgttgccagcaaagagccatcctgctaggccctttgccaacatctccgtagatcacattccagagcagatagacagaagaatggagaggaagaagaaggggtggttcgagcgcatcaagaggctcttcatctccgaacccaagcagaaacccaaaccagacaagaaggtgaagagcaagagatggctggtagggaagctcaagacccagcactcgtttgccctgccagctccggagccggagccggcgacgggtcagattcagataaggcaggcggaggaggagcagagcaagcacgcagtggcggtcgcgctcgcctccgcagcggccgcagaggcagccgtcgcggccgcccacgcggccgcggaggtggtccgcctcacaggaccgccctcgccggcgccggcgccggcgcgtgaggacgccgcgtcttccggccacgaactgttcgccgccgtcgcgatccagtcagcctaccgcggatacctcgcgcggagggcactgcgcgcgctcaagggcctggtgaggctgcaggcggtgatccgcgggcaggcggtgcggcggaagacggcggcgacgctgcggggcctcgagtcgctggtcaagatccaggcccggcagcgcgccagggccgacgtcgaccacgagcacgacggcgacggcatggacgccctgctgaggagaggccgggagctgtacgccgccgcgctgcaagagcagcagcagagcagccggggggtgggacggcagcaccctctccaaggaagagatgggcgccgtgatgaggagcagggaggaagccgccatcaagcgcgtgcgcgcgctgcagtacgcctccatccagaacgagaagatcggcatcaggaggcagcccatgtccagggacgagatggagacgctcaaccagcgctggagctggctggaggagtgggtcggctcgcagcccttcgacaaggacgtggccgtcgacgtggtcacccacccccacccgccgccgcctcgctccagggactccctcgcctgcctcgaggacgacgacgaccatgatgacgacggctatggcaggcggctcggctactcgtccaggcggtccttcggccgcgccaggcgcacgccagggagggggagcgtcgacgacgggctgcaggcctgctcgccggcggtggctttcccggggtacatggcgtccacggcgtccgccaaggccaagttccggtccatgagcacgcccaaggagcgcttcgccgtgccatccgacgcatactcggagcagtgcttcgccgaccgcctcatgtcacccatcccgtccatgtcgccgatgccgtccatcgccagcgacatgggttttgctcgctccagcaggccgccggttgcgcagcggtcgccgcgtgtcaagggggggccgatgacgccgtcgaggatccgctccaggaggtcccccagccgccacagcttcggctctgaagccgcgctgcaccagatgcagatggagcactacacccctattcgctagacacaaacaaacttctttgtaatgtgaccaatgctgccttgtttggcgggcttgctctctctgggtctgaccatggaaaccttctcaaactgaccgtgctgtgcgaatgcaatatggatctgcaaactttc

SEQ ID NO: 3293 - protein, 476 aa, Triticum aestivum
  misc_feature (1)..(476): useful for making plants with increased salt and oxidative stress tolerance as described in USSN 11/858,117
  misc_feature (1)..(476): Ceres CLONE ID no.835818
  misc_feature (1)..(476): Score of 855.1 for HMM of FIGURE 2 of USSN 11/858,117.
  misc_feature (122)..(142): Pfam Name: IQ Pfam Description: IQ calmodulin-binding motif
  misc_feature (1)..(476): Functional Homolog Of Ceres SEEDLINE ID no. ME06748
MERKKKGWFERIKRLFISEPKQKPKPDKKVKSKRWLVGKLKTQHSFALPAPEPEPATGQIQIRQAEEEQSKHAVAVALASAAAAEAAVAAAHAAAEVVRLTGPPSPAPAPAREDAASSGHELFAAVAIQSAYRGYLARRALRALKGLVRLQAVIRGQAVRRKTAATLRGLESLVKIQARQRARADVDHEHDGDGMDALLRRGRELYAAALQEQQQSSRGWDGSTLSKEEMGAVMRSREEAAIKRVRALQYASIQNEKIGIRRQPMSRDEMETLNQRWSWLEEWVGSQPFDKDVAVDVVTHPHPPPPRSRDSLACLEDDDDHDDDGYGRRLGYSSRRSFGRARRTPGRGSVDDGLQACSPAVAFPGYMASTASAKAKFRSMSTPKERFAVPSDAYSEQCFADRLMSPIPSMSPMPSIASDMGFARSSRPPVAQRSPRVKGGPMTPSRIRSRRSPSRHSFGSEAALHQMQMEHYTPIR

SEQ ID NO: 3294 - DNA, 1651 bp, Panicum virgatum
  misc_feature (1)..(1651): useful for making plants with increased salt and oxidative stress tolerance as described in USSN 11/858,117
  misc_feature (1)..(1651): Ceres CLONE ID no.1796745
gtagcactagccactctcactccccccggcggcatggagaaggagaagaggcggaggagctggttcgagcgcatcaggcggctcttcacctcctccgagcccaaggagaaacccaaacctgacaagaaggcgaagagcaagcggtggctaccggggaagctgaggacgcagcagtcgttcgctctgccggcgccggcatccgcggccgcggacctgcagatcaggcaggcggaggacgagcagagcaagcacgccgtgaccgtcgctctcgccaccgcggcggccgccgaggccgcggtcgccgccgcgcacgccgccgccgaggtcgtccgcctcaccggccagcaggccgcggccccgccggccgggcgggagcgggagctggaggaggaggagcatgccgccgtcttgatccaatcggcgtaccgcgggtacctggctcggcgggcgctgcgcgcgctcaagggtctggtgcggctgcaggcgctgatccgggggcaggcggtgcggcaccagacggcggccacgctgcgcggcctcgagtccctgatgaggatccaggcccagcaccgctcccgggccggcggccccgaccacccggcggcgctcgacggcaacgacgacgccttcctgctccggcgcggccgggagctctacgccgccgcggtccaccagcagcagcaggcgggcagcaaagggtgggacagcagcatcctcgccaaggaggagatgcgcgccgtgatgcggagccgggaggaggccgccctcaagcgcgtgcgcgcgctgcagtacgcgtccctgcagagcgagcggctgggcgtccggcggccgccgctgcccagggacgaggaggcggacgcgctccaccgccgctggagctggctcgaggagtgggtcggcgcgcagccgcccttcgacaaggacgtccccgtggcgcaccagtcgccctacagcagggacgacgccgccgccgccaggggccgccagacgccgggccgggccgtcgacccgctcgccggcctcggcggcggcgacgccgaccggctcggttgctcggcgcggcggtccttcgtgcggccgaggcgcgcgccggcgcgggcgggcgactacttctacgaggacgccgcgccgtgctcgccggcgacgttcccggggtacatggcgtccacggcctccgccaaggccaagttccggtccatgagcacgcccaaggagcgcttcgccggagccgacgccttctccgagcactgcttcccgttcgccgaccgcatgctctcgccgatcccgtccatgtcgcccatcccctccatcgccagcgacatgggcttcgccaggtccaccaggccgcccgccgcgcagagatcgccgcgggtggcggccaagggccccatgacgccggcgcggtcgcgctcacggaggtcgccgagccaccacagcttcggctccgaggccgcgctgcaccaactgcagatggagcactacaccccagtccggtgaacaagactacagagagtgccttgcttcgttacactcttttgtgaagatacaattccctgctcccattcttttgtttgttcacctttcttgacagaagggttcaactgttcaagtattcagtaatggaatgcaacaacgtaaaaaaaaaaaaaaa

SEQ ID NO: 3295 - protein, 487 aa, Panicum virgatum
  misc_feature (1)..(487): useful for making plants with increased salt and oxidative stress tolerance as described in USSN 11/858,117
  misc_feature (1)..(487): Ceres CLONE ID no.1796745
  misc_feature (1)..(487): Score of 472.4 for HMM of FIGURE 2 of USSN 11/858,117.
  misc_feature (121)..(141): Pfam Name: IQ Pfam Description: IQ calmodulin-binding motif
  misc_feature (1)..(487): Functional Homolog Of Ceres SEEDLINE ID no. ME06748
MEKEKRRRSWFERIRRLFTSSEPKEKPKPDKKAKSKRWLPGKLRTQQSFALPAPASAAADLQIRQAEDEQSKHAVTVALATAAAAEAAVAAAHAAAEVVRLTGQQAAAPPAGRERELEEEEHAAVLIQSAYRGYLARRALRALKGLVRLQALIRGQAVRHQTAATLRGLESLMRIQAQHRSRAGGPDHPAALDGNDDAFLLRRGRELYAAAVHQQQQAGSKGWDSSILAKEEMRAVMRSREEAALKRVRALQYASLQSERLGVRRPPLPRDEEADALHRRWSWLEEWVGAQPPFDKDVPVAHQSPYSRDDAAAARGRQTPGRAVDPLAGLGGGDADRLGCSARRSFVRPRRAPARAGDYFYEDAAPCSPATFPGYMASTASAKAKFRSMSTPKERFAGADAFSEHCFPFADRMLSPIPSMSPIPSIASDMGFARSTRPPAAQRSPRVAAKGPMTPARSRSRRSPSHHSFGSEAALHQLQMEHYTPVR

SEQ ID NO: 3296 - protein, 501 aa, Oryza sativa subsp. indica
  misc_feature (1)..(501): useful for making plants with increased salt and oxidative stress tolerance as described in USSN 11/858,117
  misc_feature (1)..(501): Public GI ID no.125543896
  misc_feature (1)..(501): Score of 538.7 for HMM of FIGURE 2 of USSN 11/858,117.
  misc_feature (122)..(142): Pfam Name: IQ Pfam Description: IQ calmodulin-binding motif
  misc_feature (1)..(501): Functional Homolog Of Ceres SEEDLINE ID no. ME06748
MERKRRGWLERIKRLFVSEPKQKPKPDKKVKSKRWMFAGKLKTQHSFALPAPAPAVEEEQIRQAEDEQSKHAMAVALATAAAAEAAVAAAHAAAEVVRLTGKTAALAPAPATTTTPTPYGHEHAALMIQSVYRGYLARRALRALKGLVRLQALIRGQAVRRQTAATLRGLESLMKIQARQRARASSAAAAGGDHNAANSPAPDGMDALLRRGRELYYAAAAAVHEQQLSKGWDSSTLSKEEMSAMSRSREEAALKRVRALQYASLHQSEKVRVRRQPMSREEMETLNQRWSWLEEWVGSQPPFDKDIPVAHQSPSRDAAGAAMNDDERPPPPPVLRSRSRADRLACVGGDDDDADRQLGYSARRSFTRAGRRTPARDDDGGGAAAFPGYMASTASAKAKFRSMSTPKERSGAGAADAYSEQCFPFADRLLSPIPSMSPIPSIASDIVFARSSRPAAAQRSPRVKGPMTPTRSRSRRSPGRHSFSSEAALHQLQMEQYTPIR

SEQ ID NO: 3297 - DNA, 1494 bp, Populus balsamifera subsp. trichocarpa
  misc_feature (1)..(1494): useful for making plants with increased salt and oxidative stress tolerance as described in USSN 11/858,117
  misc_feature (1)..(1494): Ceres ANNOT ID no.1483984
atgtcaggtctatcagagttgagaaatatgaaagttggaaaaaagatgggaggtcccatgagtcttgagaaggatgtttatatgagttgtggtgcttcaatggctaagaagagaagctggttctatcgagtgagaaggttatttacttctgacacacagtcaagacaagaaaaggaaaggagaagaaaatggatgttttttggaaagtttaaggtcaagaatagattggcctccattgcagctccatcatcaccactaagagaagaagcagagaaggagcagagcaagcatgctctaagtgttgctcttgccactgctgctgctgctgaggcagctgttgtagctgctcaggctgcggccgaggtggttttgctcactggtgttcctcattctatcaatgaatatgagaaagaaaccgaccatttagccttcgaagttcaaggtgatgcccctcattccactcatcaacatgcgagggggatcaaagaactggctgccatcaaaattcaagctacctttaggggttaccttgcaaggaaagctttgcgggcgctgaaggggatagtgaagcttcaagcaattatccgagggcggaacgtgagacgccaagccatgactactctaaaatgcttgcaatccattgtaaatatccagtcacaagtctgtgcaaaaaggatccaaatggtggaaggtgcttggacctgtagtgaaaataaacagttagaaaatttgagtgacaagataataaagatggatatgaatagtgaaagaagatgggatagcagccttctgacaaaggaagaggcagttgcctcgtttctaagcaagaaagaggccgcgattaagagagaacggataagagaatactggttcaaccgccggaattcagctgaatcggagcgaagcaagccaagtggaaggtggaggtactggttagatcaatgggtggatactcaacttgttaagagtaaagagcttgaagatttggactcagttttaacctcaaatccaaagcctggagtggaatatagaggaaagcagattaaactgagaggtttgcagagactgtatcaccttgacagtgtagattctcccatttcagctccaagaaaatccttccatagaaagcaatgctcgttgggagaagacaattccttttctagatctcctgtggttccaacttacatggcaacaactgaatctgccaaggcaaaaacaagatcaatgagctcaccaaagctaaggccagggagttttgatgcttactctgacagctattctccatgtaagaataagctttctctgatatcatctacaactactgaagtgccgagcagtgctaggtacggaaggcctagtgcttatcagcaaaggtctccaagcttgaagggccttccgggtccgataaaatgtaaccggccaacgtcgaaagttcttagctttgattcagattgctcattaaagacttgggataaacaaagttcctttagatga

SEQ ID NO: 3298 - protein, 464 aa, Populus balsamifera subsp. trichocarpa
  misc_feature (1)..(464): useful for making plants with increased salt and oxidative stress tolerance as described in USSN 11/858,117
  misc_feature (1)..(464): Ceres ANNOT ID no.1483984
  misc_feature (1)..(464): Score of 498.0 for HMM of FIGURE 2 of USSN 11/858,117.
  misc_feature (130)..(150): Pfam Name: IQ Pfam Description: IQ calmodulin-binding motif
  misc_feature (1)..(464): Functional Homolog Of Ceres SEEDLINE ID no. ME06748
MAKKRSWFYRVRRLFTSDTQSRQEKERRRKWMFFGKFKVKNRLASIAAPSSPLREEAEKEQSKHALSVALATAAAAEAAVVAAQAAAEVVLLTGVPHSINEYEKETDHLAFEVQGDAPHSTHQHARGIKELAAIKIQATFRGYLARKALRALKGIVKLQAIIRGRNVRRQAMTTLKCLQSIVNIQSQVCAKRIQMVEGAWTCSENKQLENLSDKIIKMDMNSERRWDSSLLTKEEAVASFLSKKEAAIKRERIREYWFNRRNSAESERSKPSGRWRYWLDQWVDTQLVKSKELEDLDSVLTSNPKPGVEYRGKQIKLRGLQRLYHLDSVDSPISAPRKSFHRKQCSLGEDNSFSRSPVVPTYMATTESAKAKTRSMSSPKLRPGSFDAYSDSYSPCKNKLSLISSTTTEVPSSARYGRPSAYQQRSPSLKGLPGPIKCNRPTSKVLSFDSDCSLKTWDKQSSFR

SEQ ID NO: 3299 - DNA, 1579 bp, Gossypium hirsutum
  misc_feature (1)..(1579): useful for making plants with increased salt and oxidative stress tolerance as described in USSN 11/858,117
  misc_feature (1)..(1579): Ceres CLONE ID no.1924654
aaggaaaaaaaactatagctttcttcgtttatgtaatggaattcctcgccaattctctctcaatctaagctatccaagttccaaagactaaagcttttttgaagcggtgattcctgtttgattctcccaaaatatttaagtattcagtgcaccttttatacacaatccatatggaatttaccactatactatattatataagatgatgttaggatgcagaaatgtaaaaattcagaatagtagtacctgaagaagtgagagttctttaatggcgaagaagaagagctggttcaatctagtgaagaggttctttctctttgagacacttataaatgcacaaaaggataacagaaggaaatggatgtttggaaggtttaggaccaaaaggttagcatccattaaagctccatcaccaccaagagacagcataaaatatgaaacagaggaggaccagaagaaacatgccttaacagtggcaattgccgcagtggctgctgctgaagcagctgttgcagctgctcaggttgcagccgaggttgttcgcctcacaggcaatgacgcccctaaagctaaagaagaacaaaccaatgatgttaaacctgactgttcttcatctagtgagcttggcaacaagttccaacaacttgctgctataaaaatccaggcttcttttcggggttaccttgcaaggaaagctttgagagcattgaaagggatagtgaagcttcaagcaattattcgaggccgagttgtgagacgacaagcattgactgctttaaaatgcttgcaatcgattgtaaacattcagtctcaagtttgtgcaaggagattccaaattgtagaaggcacttggcaacaacatgatgagaacaaagagttgataactttgaaagataagattcttaaggtggataccaacagtcaaacaagatgggacaattgtaatggaggattgaagtactggttagaccaatgggtggatactaaaagtaaagatgttgaagtcgaagacatagactcggtttggacttcgaaccgcaagcctacgaggctcaagactttttcgagacagtatcattgtgatgcagaaggggtagattctccggtacgggttcaaggacgacgatcatttcatggaaagcagagttctttaggagaagatagttcttttattacatctcctgtagttccaacttacatggcagcaacacaatctactaaagcaaaggtaaggtcaatgagttcaccaaagctaaggccaggaacttgtgatactcaatccgaaagctattcaccatataagaacaagtcgtgtctcctatcttcagttacaagcaagcctaacgcttatgagcagagatccccaacactaaagggtgtaaagtcaaagaaaaccttgaaggatcttagctttaactcttaatgttcattgcctaattgggtgcaaaaaagcaccttcaaatgactcgaccattgtgatgttttaggtcccttggaagcaagtctttgttattgtgtttgtgtgagattgctgatgctgttttgtgcttaaacaattgaatgaatcaagttttgtgtg

SEQ ID NO: 3300 - protein, 384 aa, Gossypium hirsutum
  misc_feature (1)..(384): useful for making plants with increased salt and oxidative stress tolerance as described in USSN 11/858,117
  misc_feature (1)..(384): Ceres CLONE ID no.1924654
  misc_feature (1)..(384): Score of 679.6 for HMM of FIGURE 2 of USSN 11/858,117.
  misc_feature (125)..(145): Pfam Name: IQ Pfam Description: IQ calmodulin-binding motif
  misc_feature (1)..(384): Functional Homolog Of Ceres SEEDLINE ID no. ME06748
MAKKKSWFNLVKRFFLFETLINAQKDNRRKWMFGRFRTKRLASIKAPSPPRDSIKYETEEDQKKHALTVAIAAVAAAEAAVAAAQVAAEVVRLTGNDAPKAKEEQTNDVKPDCSSSSELGNKFQQLAAIKIQASFRGYLARKALRALKGIVKLQAIIRGRVVRRQALTALKCLQSIVNIQSQVCARRFQIVEGTWQQHDENKELITLKDKILKVDTNSQTRWDNCNGGLKYWLDQWVDTKSKDVEVEDIDSVWTSNRKPTRLKTFSRQYHCDAEGVDSPVRVQGRRSFHGKQSSLGEDSSFITSPVVPTYMAATQSTKAKVRSMSSPKLRPGTCDTQSESYSPYKNKSCLLSSVTSKPNAYEQRSPTLKGVKSKKTLKDLSFNS

SEQ ID NO: 3301 - DNA, 1032 bp, Populus balsamifera subsp. trichocarpa
  misc_feature (1)..(1032): useful for making plants with increased salt and oxidative stress tolerance as described in USSN 11/858,117
  misc_feature (1)..(1032): Ceres ANNOT ID no.1468861
atgaaggcaaggagagcactaagggcactaaaagctttggtgaagcttcaagccttagtgagaggccacattgtgagaaagcaaacagcagacatgcttaggcgtatgcagacattagtgagactgcaggctcgagcccgtgctagtcgcagttatgtgtcggactcatcgcacactactggcaagtcctctcattctcgttatgctgtccctgcaagtccttcaaaggatcacctgtttcgtgtttctagtaccaaatttgatgggccctcgattctcaagagatgtggttcaaatgcaaactttagggagagcattgactttgacaaagtaaaatggggttcgaactggctagaccgttggatggaagaaagttttttgaatgaccatggcagcaatccaccgagaagtcgaaatgctgatgatgagaagagtgacaagattcttgaagtggacacttggaagccccatgtgaaatcccaacaaagtaatagaacatttcagacttcacagcatgctttggcttcagatcataacaatcagagctttatgacttttgactctatgtcaaaactatcaaaaaaagaaccgaatccaatgccgagcatctcttcaggagaaattttgcagtctcttaaattacctctaggaaatgatgaagcagtttataggaccgctgagaatagccctcgaatgttctctgcaacatctagacctggaagtagtggtcggagaggaggcccttttacaccaacaaggagtgagtgctcgtggggcttctttaatggatactcgggttaccccaactacatggctaacactgaatcatctcgagccaaggtcaggtcacaaagtgccccaaggcagaggctagagtttgagaaatatggttcaagcagaagatctgttcaggggtattctgattcagaaactcgttcagaaaggggttttgctcaaaatactgaacttcaaaacaaagcttacgtagcatctggctacttgaatagactagggacttccgacttgaggtga

SEQ ID NO: 3302 - protein, 343 aa, Populus balsamifera subsp. trichocarpa
  misc_feature (1)..(343): useful for making plants with increased salt and oxidative stress tolerance as described in USSN 11/858,117
  misc_feature (1)..(343): Ceres ANNOT ID no.1468861
  misc_feature (1)..(343): Score of 100.0 for HMM of FIGURE 2 of USSN 11/858,117.
  misc_feature (10)..(30): Pfam Name: IQ Pfam Description: IQ calmodulin-binding motif
  misc_feature (1)..(343): Functional Homolog Of Ceres SEEDLINE ID no. ME06748
MKARRALRALKALVKLQALVRGHIVRKQTADMLRRMQTLVRLQARARASRSYVSDSSHTTGKSSHSRYAVPASPSKDHLFRVSSTKFDGPSILKRCGSNANFRESIDFDKVKWGSNWLDRWMEESFLNDHGSNPPRSRNADDEKSDKILEVDTWKPHVKSQQSNRTFQTSQHALASDHNNQSFMTFDSMSKLSKKEPNPMPSISSGEILQSLKLPLGNDEAVYRTAENSPRMFSATSRPGSSGRRGGPFTPTRSECSWGFFNGYSGYPNYMANTESSRAKVRSQSAPRQRLEFEKYGSSRRSVQGYSDSETRSERGFAQNTELQNKAYVASGYLNRLGTSDLR

SEQ ID NO: 3303 - DNA, 1646 bp, Glycine max
  misc_feature (1)..(1646): useful for making plants with increased salt and oxidative stress tolerance as described in USSN 11/858,117
  misc_feature (1)..(1646): Ceres CLONE ID no.1641776
ctctctctcaaaacccaaaactattcccttgtgagaactgaggagacataataatgggtaaggcgtcgaagtggtttcgcgggcttcttggtctcaaaaaaacagagtatgccacctcacccgccaagcctcccaaagagaaacgccggtggagcttcgttaaatcatcatacacagaaaaagacaacaccactgccgccacgtgtccaccactaagaaacaacaacaaccacgcaatggcagtagcagcagccaccgctgcggtggccgaagcggcggtggctgccgccgaagcagccgccgtcgtggtgagactaactagtaacagcggcaggtgcgccgacggcggacccacccggattcgccaacattgggctgctgttaagattcaagccgcttttcgtggctgtttggcaaggagagcactgcgagcattaaagggattggtgaagttgcaagcattggtgagaggccacattgagagaaaacggacggcagagtggctgaaaagattgcaagcactcttacatgcacagacccaagtttctgcagggttgaccctgcatgcctcaccttcgagttcaaagttatcaagccacctccaaggtccagaaacacccgaaaaatttgaaagccccattagatctaagagcatgaaacatgagcactcacctatactcaagagaaatggctccaaatcctgtgccctgatcaatggctatcaagagatatgtgggagtagatcagagagtcaagggaatgaacaattatggaactcaggaagatcaatgaatagagcacacggctccaatgatgaaagaaatggcaaggttcttgaagttgattctggaaaaccgcacttcacactaaagcgtcgaaacctctcttactccacaggctctgatctttatagtaagagtttgaacagcacaaaggaatcaacatctcttcaatctgctcaaagtccatgttgtgaggttcagtctcacagttacagctcgcaaaaagtgaacaatgaggttgaggagagtccattctgcactgctgacaatagtccacaatacttatctgcctcttctaaagatgatggcttcaaaagaagcccttttactcctactagaagtgatggctctagaagctacattcgcggttaccctgattatcctagttacatggcatgcactgaatcttcaaaggcaaaggccagatctctgagtgcaccaaaacaaaggcctcaaagtgagaggtctggttcatcggatagatactcactcaatggatttgatatgtcaagattggccactcaaagggcaatgcaagcaagcttcaccaacaaagcatatccaggttctggtcgtttggacaagcttggtatgcctgtggggtacagattctgattgagttatgtttatggtaagagggttattttgtatcttttatttttcatagtcttaaagtcttaatatctgatcttgctaaccaaccggctgtactttgagcttccattgcgattttgtgtcagcattagaaatctacaaccaaattaagtgcatactgctaagtctcaactttcaagtcattttattacttggataaactgtgtaaaagaattattatctttgcctttcaaaaaaaaaaaaaaaaaa

SEQ ID NO: 3304 - protein, 447 aa, Glycine max
  misc_feature (1)..(447): useful for making plants with increased salt and oxidative stress tolerance as described in USSN 11/858,117
  misc_feature (1)..(447): Ceres CLONE ID no.1641776
  misc_feature (1)..(447): Score of 433.6 for HMM of FIGURE 2 of USSN 11/858,117.
  misc_feature (106)..(126): Pfam Name: IQ Pfam Description: IQ calmodulin-binding motif
  misc_feature (1)..(447): Functional Homolog Of Ceres SEEDLINE ID no. ME06748
MGKASKWFRGLLGLKKTEYATSPAKPPKEKRRWSFVKSSYTEKDNTTAATCPPLRNNNNHAMAVAAATAAVAEAAVAAAEAAAVVVRLTSNSGRCADGGPTRIRQHWAAVKIQAAFRGCLARRALRALKGLVKLQALVRGHIERKRTAEWLKRLQALLHAQTQVSAGLTLHASPSSSKLSSHLQGPETPEKFESPIRSKSMKHEHSPILKRNGSKSCALINGYQEICGSRSESQGNEQLWNSGRSMNRAHGSNDERNGKVLEVDSGKPHFTLKRRNLSYSTGSDLYSKSLNSTKESTSLQSAQSPCCEVQSHSYSSQKVNNEVEESPFCTADNSPQYLSASSKDDGFKRSPFTPTRSDGSRSYIRGYPDYPSYMACTESSKAKARSLSAPKQRPQSERSGSSDRYSLNGFDMSRLATQRAMQASFTNKAYPGSGRLDKLGMPVGYRF

SEQ ID NO: 3305 - DNA, 1434 bp, Populus balsamifera subsp. trichocarpa
  misc_feature (1)..(1434): useful for making plants with increased salt and oxidative stress tolerance as described in USSN 11/858,117
  misc_feature (1)..(1434): Ceres ANNOT ID no.1438750
atgggcaaagcttccaaatggttccgtgccgttctcggattaaaaaaacccgacccaccactagaccacccccaaaccactcgttctaaagacaaacggagatggagttttgttaagtcccgccgtgaaaaagaccacgaccaccaacagcgacaacaagatattgaagccagtaaaactggtgttctgtacgggcaggagtttgaggaggaccccaacaagcatgcggtcgctgtggctgctgctaccgctgcagtcgcggaggctgctgttgcagcggctcaggcagctgccgaggttgtgagacttacgagtagtgggaggtgtgttaataacagtgtcgcgaacgttagcgggagtcttggattacgtgaagacctcgctgctgttaagattcaagctgctttccgtggctacctggctaggagagcattacgggcgttaaaggcattggtgagacttcaagctctggtaagaggtcacattgagaggaagcgaactgcagagtggcttcatcgaatgcaagctttgctgcgagcgcagtctcgagcacgttctggacgtgcccaaatttctgaatcttctcattcaagtagcaagtcctctcgctttcaacaccctggtccgccaacccctgaaaaattcgagcatgccattcgtgccaggagtggaaaatatgaacaatcatcaatacttaagagaactgggtcaaaatgtaaaggcagagcaattggtgatctagacgttgcacacttatccttaaattggtcagagcgtcggatggatgatcaaacatgggatcaccaagtccctttggcaggaactggcactattgatgatgataagagtgacaagatccttgagattgatactggaaaaccccacattactcccaagcgtagaaatctctttcactcttctcacctttccctgtcagatcagtatagccatagtttcacaactacaaaagactcgacagcccatcaaactgttccaagtccctcatcttgtgaagttcaatctttaagtccattgaagttttctcatgttgtcgaagaagcattatgcactgctgaaaatagcccacagttctactctgcatcatcaaggggtggtagtagtaagagaagtcccttcactcccagtaggagtgatggctcaagaaacttcctaatcggttattatggctacccaaattatatgtgtaacactgaatcttcgagggctaaggcgagatctcttagcgctccaaaacaaagaccccaatatgagagatccagttcaaccaggagatactcggttctcgggtgtggtgagccaagatcgagtagtgcacagcatgcttctgccttgcgtgcaagtttttcaagcaaagcttaccctggatctggtcgcttggacaagctgggaatgcctattgggcagggatactaa

SEQ ID NO: 3306 - protein, 477 aa, Populus balsamifera subsp. trichocarpa
  misc_feature (1)..(477): useful for making plants with increased salt and oxidative stress tolerance as described in USSN 11/858,117
  misc_feature (1)..(477): Ceres ANNOT ID no.1438750
  misc_feature (1)..(477): Score of 852.9 for HMM of FIGURE 2 of USSN 11/858,117.
  misc_feature (126)..(146): Pfam Name: IQ Pfam Description: IQ calmodulin-binding motif
  misc_feature (1)..(477): Functional Homolog Of Ceres SEEDLINE ID no. ME06748
MGKASKWFRAVLGLKKPDPPLDHPQTTRSKDKRRWSFVKSRREKDHDHQQRQQDIEASKTGVLYGQEFEEDPNKHAVAVAAATAAVAEAAVAAAQAAAEVVRLTSSGRCVNNSVANVSGSLGLREDLAAVKIQAAFRGYLARRALRALKALVRLQALVRGHIERKRTAEWLHRMQALLRAQSRARSGRAQISESSHSSSKSSRFQHPGPPTPEKFEHAIRARSGKYEQSSILKRTGSKCKGRAIGDLDVAHLSLNWSERRMDDQTWDHQVPLAGTGTIDDDKSDKILEIDTGKPHITPKRRNLFHSSHLSLSDQYSHSFTTTKDSTAHQTVPSPSSCEVQSLSPLKFSHVVEEALCTAENSPQFYSASSRGGSSKRSPFTPSRSDGSRNFLIGYYGYPNYMCNTESSRAKARSLSAPKQRPQYERSSSTRRYSVLGCGEPRSSSAQHASALRASFSSKAYPGSGRLDKLGMPIGQGY

SEQ ID NO: 3307 - DNA, 1431 bp, Populus balsamifera subsp. trichocarpa
  misc_feature (1)..(1431): useful for making plants with increased salt and oxidative stress tolerance as described in USSN 11/858,117
  misc_feature (1)..(1431): Ceres ANNOT ID no.1447395
atgggtaaagcttccaaatggttccgtgccgttctcggcctcaaaaaacccgacccaccaccagaccgccccgttacaactcgttctaaagaaaaaaggagatggagttttgtcaagtcccaccgtgaaaaagaccaacaccatcaccaacagcaacaacaagagacggaagccgttaaagcaggcgttttgtacgggcaggagtttgaggaggacccaaacaagcatgcgatcgctgtggctgctgctactgctgcagttgcggaggctgcagttgctgccgcgcaggcagctgcagaggtggtgcggttaacaagcagtgggaggtgtgttgataacagtgttgcgtacgttagcgggagtcctggcttacgtgaagacttcgctgctgttaagatcgaagctgcttttcgtggctacctggcaaggagagcgttaagagcattaaaagcgttggtgaggcttcaggcactggtaagaggtcaccttgagaggaagcgaacagcagagtggcttcatcgaatgcaagcattgctgagagcgcaggctcgagcacgtgcaggacgtgcccaaatttctgaatcctcccactcaagcagcaagtcttctcgctatcacctccctggtctgccaacccatgaaaaatccgagcatgccattcgtgctacgagtggaaaatatgaacaatcatcaatgcttaagagaactgggtcaaaaactaaaggcagagaaattgccgatcaagatgttgcacacttatccttcaattggtcagaacatggaatggatagtagaacatgggatcatcaagccccttcgccaggaactggccccattgatgatgacaagatccttgagattgattctggaaaaccacatattactcctaaacgcagaaatctctttcacccttctcacctttccttgtctgcggatcagtatagccatagtttcacaacatcaaaaggctccacagtccgtcaagcagttccaagcccctcatctggcgaagttcaatctttcagtccattgaaattctctcatgaggttgaggaagcattttgcaccgctgataatagcccgcaattctgctctgcatcatcaaggggtggcagtggtaagagaagtcccttcactcccagtaggagtggtggctctagaagcttcatgagtggatactctgactacccaaattatatgtgtaacactgaatcttcaagggctaaggtgagatctctaagcgctccaaaacaaagaccccagtatgagagatccagctcaaccaagagatactcggttctcggctttggtgaacaaagatcgagtagtgcacagagtgcttctgccttgcgtgcaagttttacaagtaaagcttaccctggatctggtcgtttggacaggctgggaatgcctgttgggcagaaatactaa

SEQ ID NO: 3308 - protein, 476 aa, Populus balsamifera subsp. trichocarpa
  misc_feature (1)..(476): useful for making plants with increased salt and oxidative stress tolerance as described in USSN 11/858,117
  misc_feature (1)..(476): Ceres ANNOT ID no.1447395
  misc_feature (1)..(476): Score of 696.6 for HMM of FIGURE 2 of USSN 11/858,117.
  misc_feature (149)..(169): Pfam Name: IQ Pfam Description: IQ calmodulin-binding motif
  misc_feature (1)..(476): Functional Homolog Of Ceres SEEDLINE ID no. ME06748
MGKASKWFRAVLGLKKPDPPPDRPVTTRSKEKRRWSFVKSHREKDQHHHQQQQQETEAVKAGVLYGQEFEEDPNKHAIAVAAATAAVAEAAVAAAQAAAEVVRLTSSGRCVDNSVAYVSGSPGLREDFAAVKIEAAFRGYLARRALRALKALVRLQALVRGHLERKRTAEWLHRMQALLRAQARARAGRAQISESSHSSSKSSRYHLPGLPTHEKSEHAIRATSGKYEQSSMLKRTGSKTKGREIADQDVAHLSFNWSEHGMDSRTWDHQAPSPGTGPIDDDKILEIDSGKPHITPKRRNLFHPSHLSLSADQYSHSFTTSKGSTVRQAVPSPSSGEVQSFSPLKFSHEVEEAFCTADNSPQFCSASSRGGSGKRSPFTPSRSGGSRSFMSGYSDYPNYMCNTESSRAKVRSLSAPKQRPQYERSSSTKRYSVLGFGEQRSSSAQSASALRASFTSKAYPGSGRLDRLGMPVGQKY

SEQ ID NO: 3309 - protein, 484 aa, Arabidopsis thaliana [sequence omitted]

SEQ ID NO: 3310 - protein, 543 aa, Arabidopsis thaliana
  misc_feature (1)..(543): useful for making plants with increased salt and oxidative stress tolerance as described in USSN 11/858,117
  misc_feature (1)..(543): Public GI ID no.3292832
  misc_feature (1)..(543): Score of 277.0 for HMM of FIGURE 2 of USSN 11/858,117.
  misc_feature (167)..(187): Pfam Name: IQ Pfam Description: IQ calmodulin-binding motif
  misc_feature (1)..(543): Functional Homolog Of Ceres SEEDLINE ID no. ME06748
MGKASRWFRSLFGVKKPDPGYPDLSVETPSRSTSSNLKRRWSFVKSKREKESTPINQVPHTPSLPNSTPPPPSHHQSSPRRRRKQKPMWEDEGSEDSDKHAIAVAAATAAVAEAAVAAANAAAAVVRLTSTSGRSTRSPVKARFSDGFDDVVAHGSKFYGHGRDSCELAVIKIQSIFRGYLAKRALRALKGLVRLQAIVRGHIERKRMSVHLRRMHALVRAQARVRATRVIVTPESSSSQSNNTKSSHFQNPVSLVKFPMIVPFNLKHGPPTPEKLEHSISSRSSKLAHSHLFKVLHFQLLFVSSVFVACGPISSKFQRLYKLLTLLYVQNKSNLKNWNGSKASDNNRLYPAHRETFSATDEEEKILQIDRKHISSYTRRNRPDMFYSSHLILDNAGLSEPVFATPFSPSSSHEEITSQFCTAENSPQLYSATSRSKRSAFTASSIAPSDCTKSCCDGDHPSYMACTESSRAKARSASAPKSRPQLFYERPSSKRFGFVDLPYCGDTKSGPQKGSALHTSFMNKAYPGSGRLDRLGMPIGYRY

SEQ ID NO: 3311 - DNA, 1799 bp, Zea mays
  misc_feature (1)..(1799): useful for making plants with increased salt and oxidative stress tolerance as described in USSN 11/858,117
  misc_feature (1)..(1799): Ceres CLONE ID no.1559074
aagactctcccagtcccttcctctcctgctgcctttctctcttctcggtgaagcgtgtgttcatttcactgttttggtttcatctcccgctctttctttaccccgtgctccggccaagtgctggaaccaagaaagcctcatggggcggccggccgacgggcggtagagaggcggagatgggctgggcgcctaggtggctgcgcgggctgctcggcggcggcaggaaggccgccgtgacgaagccggcgaaggagaagaagctctggggattcgggaagtccttccgggaaaaggaccccgcgccagcgccggaacggcctcggacgccttcggtgcagcccacggcgacgcctcgccgggggtttgcggcggcgccggatgaggcggacgacgagcagagcaagcgtgctatcgctgtggccgcggcgacggcggcggtggcagaggccgccgtcgctgctgcccaggcggccgccgccgtggtgcggttgacgagctccggccggtgcccaccgccggccgccgcgaagcgggaggagtgggcggctgttcggatccaggccgctttccgtggctacctggcgaggcgggcgctgaaggcgttgagggggctggtgaagctgcaggcgctggtccggggcaacattgtgcggcggcaggcggcggagacgctgcgatgcatgcacgcgctcgtccgcgtccaggcgcgcgcgcgcgcgtgtcgcgcaattcgctcgcagcatgtcgcggctcatccggatccgccaacgccggagaagtacgatcaggcgggtgcccccaggcacgcccgttccggctctctgaaggcaaactcttccaagacgccgggcggcgagaggctgggtagggagaggtcggaatcttgcgggaggaactggctggaccgctgggtggaggagaggtacacggacgacgagaagaacgccaagattctcgaagtggacaacggcaagccagggcggcacggttccaagcggcgcggcggcaaccatcaccagtcgccgtgctcgacgatgacctccgagcagaacagccggagctacgcgaccatgccggagtcgccgtccaaggactcgacgaccgcgcagcagtccgtgccgagcccgtcgtccgtgggcatggctgccgaggccctgagcccgctgcgcgtgccagcggacatcgccgagctctgcgacagcccccagttcttctcggcgacgtcgcggcccgggagctccaggagggggggcgcgttcacgccggcggccaagagcgagtgctcgcgcagcctcttcggcggctactccgactgccccaactacatggcgaacacggagtcgttccgcgccaaggcgcgttcccagagcgcgcccaagcagaggccgcagcagcagtacgagaagtcgggctccctccgcagggcgtcggcgcacgccctcgcggcggggccggcagcggcacagaggtcggtggcctcgttgcacgccatgaaggcgtatccgggctccggcagattggaccgacttggcatgccggtcaggtactgatccggatcctacctagctcgcttcaggataatgtggtgctgcgcctgaactgattgatacccagtgtctcaactcaagcgatgaggatgaagtgaattctactagtggtcgttattagatcttgttccttcggtggtgcctattaccgtcaacagttttctgtttgttgctttgtgtagcgaagtgtaagttgctggtacgtagctggtaatactatgcgtgcttaaccgcgaaaaaaaaaaaaaaaaa

SEQ ID NO: 3312 - protein, 457 aa, Zea mays
  misc_feature (1)..(457): useful for making plants with increased salt and oxidative stress tolerance as described in USSN 11/858,117
  misc_feature (1)..(457): Ceres CLONE ID no.1559074
  misc_feature (1)..(457): Score of 855.0 for HMM of FIGURE 2 of USSN 11/858,117.
  misc_feature (121)..(141): Pfam Name: IQ Pfam Description: IQ calmodulin-binding motif
  misc_feature (1)..(457): Functional Homolog Of Ceres SEEDLINE ID no. ME06748
MGWAPRWLRGLLGGGRKAAVTKPAKEKKLWGFGKSFREKDPAPAPERPRTPSVQPTATPRRGFAAAPDEADDEQSKRAIAVAAATAAVAEAAVAAAQAAAAVVRLTSSGRCPPPAAAKREEWAAVRIQAAFRGYLARRALKALRGLVKLQALVRGNIVRRQAAETLRCMHALVRVQARARACRAIRSQHVAAHPDPPTPEKYDQAGAPRHARSGSLKANSSKTPGGERLGRERSESCGRNWLDRWVEERYTDDEKNAKILEVDNGKPGRHGSKRRGGNHHQSPCSTMTSEQNSRSYATMPESPSKDSTTAQQSVPSPSSVGMAAEALSPLRVPADIAELCDSPQFFSATSRPGSSRRGGAFTPAAKSECSRSLFGGYSDCPNYMANTESFRAKARSQSAPKQRPQQQYEKSGSLRRASAHALAAGPAAAQRSVASLHAMKAYPGSGRLDRLGMPVRY

SEQ ID NO: 3313 - DNA, 1821 bp, Panicum virgatum
  misc_feature (1)..(1821): useful for making plants with increased salt and oxidative stress tolerance as described in USSN 11/858,117
  misc_feature (1)..(1821): Ceres CLONE ID no.1726548
gtctagacccttcctttctctcctgctgtcccttttgctcttctcggtgtaagcgtgtgcgcgtttcactgctttggtttcatctcccgctctttctttcctccccactgctcctccggccaagtgctggaacgaggaagcctcatgcggccgccggccggggagcggtagagcgccggagatgggctgggcgcccaggtggctgcgcgggctgctcggcggcggcaacaaggccgccgagacgaagcccgtgaaggaaaagaggcgctgggggttcgggaagtccttcagggagaaggcgccggcgccggtggcggcgcggcctccgacgccgccggtgcagcccacggcgacgcctcgccggggctacgcgccggcgccggacgaggcggacgacgagcagagcaagcgcgccatcgcggtggccgcggccactgcggcggttgcggaggccgccgtagccgcggcgcaggcggccgccgccgtggtgcggctgacgagcagcgggcggtgcgcgccggccgccgccaagcgggaggagtgggcggctgttcggatccaggccgctttccgtggatacctggcgaggcgggcgctcaaggcgctgcgggggctggtgaagctgcaggcgctggttcggggcaacatcgtgcggcggcaggcggcggagacgctgcggtgcatgcacgcgctcgtccgcgtccaggcgcgcgcccgcgcctgccgcgcaattcgctcgcagcaggtcccggctcacccagatccgccgacgccggagaagtacgatcaggcgggtgcccccaggcacgggcgttccggctctctaaaggggagctcgtcgaagacaccgggcagcgagaggctgggcagggagaggtcggaatcttgcgggaggaactggctggaccggtgggtggaggagaggtacatggacgacgagaagaacgccaagatcctggaggtggacaacggcaagccagggcggtatgcttccaagaggcgcggcggcggcggcaaccagcaccagtcgccgtgctcgacgatgacgtccgaccagaacagccggagctacgcgaccatgccggagtcgacgaccgcgcagcggtccgtgccgagcccgccgtcggtgggcatgggcgaggccctgagcccgctccgcctgcccgtggacattgccgagctctgcgacagcccacagttcttctcggcgtcgtctcggccggggagctcccggcgggggcccttcaccccgagcaagagcgagtgctcccgcagcctcttcgggggctactccgactaccccaactacatggccaacacggagtcgttccgcgccaaggcgcgctcccagagcgcgcccaagcagaggccgcactacgacaagtccagctccctccgcaaggcgtcggcggcgcaggcctacttgacggggccgtgcgcgccgacggcgcagcagaggtcggcggcctcgctgcacgccaagttcaccaacaaggcgtacccgggctctggcaggctggatcgactcggcatgcccgtcaagtactgatcctgttatgttatcctaccaaagttgctttctggagtggtgttgcttcttgagcgatcagtgtctcagctctcgagcaaggtcgatgaagtaaaatctagtagtggtcgttaggcttttgtgtgccttcctggtgctgttaccctcgacagttttctgtttcttgctttttaatagcgaagtgtaagttggtagtagctgcactgtaatactatctgtgctttaacagtttaactgctaagtgctaactccaaaaaaaaaaaaaaaaaaaa

SEQ ID NO: 3314 - protein, 455 aa, Panicum virgatum
  misc_feature (1)..(455): useful for making plants with increased salt and oxidative stress tolerance as described in USSN 11/858,117
  misc_feature (1)..(455): Ceres CLONE ID no.1726548
  misc_feature (1)..(455): Score of 892.2 for HMM of FIGURE 2 of USSN 11/858,117.
  misc_feature (120)..(140): Pfam Name: IQ Pfam Description: IQ calmodulin-binding motif
  misc_feature (1)..(455): Functional Homolog Of Ceres SEEDLINE ID no. ME06748
MGWAPRWLRGLLGGGNKAAETKPVKEKRRWGFGKSFREKAPAPVAARPPTPPVQPTATPRRGYAPAPDEADDEQSKRAIAVAAATAAVAEAAVAAAQAAAAVVRLTSSGRCAPAAAKREEWAAVRIQAAFRGYLARRALKALRGLVKLQALVRGNIVRRQAAETLRCMHALVRVQARARACRAIRSQQVPAHPDPPTPEKYDQAGAPRHGRSGSLKGSSSKTPGSERLGRERSESCGRNWLDRWVEERYMDDEKNAKILEVDNGKPGRYASKRRGGGGNQHQSPCSTMTSDQNSRSYATMPESTTAQRSVPSPPSVGMGEALSPLRLPVDIAELCDSPQFFSASSRPGSSRRGPFTPSKSECSRSLFGGYSDYPNYMANTESFRAKARSQSAPKQRPHYDKSSSLRKASAAQAYLTGPCAPTAQQRSAASLHAKFTNKAYPGSGRLDRLGMPVKY

SEQ ID NO: 3315 - protein, 464 aa, Oryza sativa subsp. japonica
  misc_feature (1)..(464): useful for making plants with increased salt and oxidative stress tolerance as described in USSN 11/858,117
  misc_feature (1)..(464): Public GI ID no.115459996
  misc_feature (1)..(464): Score of 886.1 for HMM of FIGURE 2 of USSN 11/858,117.
  misc_feature (124)..(144): Pfam Name: IQ Pfam Description: IQ calmodulin-binding motif
  misc_feature (1)..(464): Functional Homolog Of Ceres SEEDLINE ID no. ME06748
MGWASRWLRGLLGGGKKPNSGSGDPKPAREKKRWGFGKSFREKSPAHPPPPPPPSAAVQRAVTPRRAYTASDEGDDEQSKRAIAVAAATAAVAEAAVAAAQAAAAVVRLTSSGRCAPAAAKREEYAAVRIQAAFRGYLARRALKALRGLVKLQALVRGNIVRRQAAETLRCMHALVRVQRRARACRAIRSQHVSAHPGPPTPEKYDQATHEGVPKHGRSGSLKGSSSKTPGSERLTRERSESCGRNWLDKWVEERYLDDEKNAKILEVDTGKPGRHASRRRSGSHHHHSSCSSMTSEQKSRSYATMPESPSKDSTTAQQSVPSPPSVGMAEALSPLLMAVDIAELCDSPQFFSATSRPGSSRSRAFTPTKSECSRSLFGGYSDYPNYMANTESFRAKARSQSAPKQRPQYEKSSSLRKASAHAFGPGSCAPVAQRTTASLHSKFTNKAYPGSGRLDRLGMPVKY

SEQ ID NO: 3316 - DNA, 1736 bp, Triticum aestivum
  misc_feature (1)..(1736): useful for making plants with increased salt and oxidative stress tolerance as described in USSN 11/858,117
  misc_feature (1)..(1736): Ceres CLONE ID no.697034
gcctagactcttcgtctccgtcctgcacctttttcttctctggcaagcctgtgcctgtgcgcgtcgcgccgttttgggtttcatctcccgctctttcttcctcctccctgctccggccaagtgctggaaccaagagaaggcgatgggggcggcggcggaggagcagtagccggagggaggggatggggtgggcttcaaggtggctccgcgggctgcttggcggcggcaagaaggccggtcccgcctccggcgagcacaagccggagagggagaagaagcgctggggcttcggcaagtccttccgggagaaggacccggtgcgtccaccgacgcctcctgtgcagcgggcggcgacgccccgccgcacctacgcgacgtcggatgacggcggcgacgagcagaacaaacgcgctatcgccgtggcggcggcgacggcggctgtggccgaggccgccgttgccgcggcgcaggcggccgccgccgtggtgcggctgacgagcagcgggcggtgcccgccggccggggcgaagcatgaggagtgggcggccgtccggatccaggccgctttccgtggctacctggcgaggcgcgcactgaaggcgctccgcgggctggtgaagctgcaggcgctggtccgcggcaacatcgtccggcggcaggcggccgagacgctccggtgcatgcaggcgctcgtcagcgtgcagtcccgcgcgcgcgccagccgcgcaacccgatcccgccaggccgcggcacacccgggcgcgacgacgccggagaagtacgagcaggcggcatacgatggcgcgctcaggcacggccgttcaggctcactcaagggaggctcgtcaaagacaccgggcagcgagaggatgagcagggagaggtcagaatcttgcgggaggaactggctggatcggtgggtggaggagaggtacatggatgacgagaagaacgccaagattctcgaggtggaccccggcaagcccggccggcacgcttccaagaggcgaagcagcggcggcggccaccaccagtcgtcgtgctcaaccaggacatcagagcagaacagccggagctacgcgacgatgccggactcgccgtccagggactcgacgacggcgcagcagtccgtgcccagcccgtcgtcggtgggcatgggcgcgggcgaggccctcagcccgctgcacatgccggcagacctcgcggcggagctgtacgagagcccgcagttcttctcggcgacgtcgcggccggggagctcgaagcggggcgccttcttcacgccgaccaagagcgagtgcgcgcgcagcctcttcggcggctactccgactaccccaactacatgtccaacacggagtcgttccgggccaaggcgcggtcgcagagcgcgcccaagcagcggccgctgtacgagaagtccgggtccctccggaaggcgtcggcacacgccttcgcgccggggcagaggtcgtcggcgtcggcgtccctgcacgccaggttcaccaataaggcgtaccctggctccggcaggctggaccggctgggcatgcctgtcaagtactgaaccctgccgccatgtgaccagtgttaggtttgagcttttgtgatgctattaccgtcagaaagtactttcctgttattgactgtgacttgttaagtgtaagttgctactgtactggtgttcccgcaaaaaaaagtgtaagttgctagtaatcacccaaaaaaaaaaaaaaaa

SEQ ID NO: 3317 - protein, 460 aa, Triticum aestivum
  misc_feature (1)..(460): useful for making plants with increased salt and oxidative stress tolerance as described in USSN 11/858,117
  misc_feature (1)..(460): Ceres CLONE ID no.697034
  misc_feature (1)..(460): Score of 750.1 for HMM of FIGURE 2 of USSN 11/858,117.
  misc_feature (119)..(139): Pfam Name: IQ Pfam Description: IQ calmodulin-binding motif
  misc_feature (1)..(460): Functional Homolog Of Ceres SEEDLINE ID no. ME06748
MGWASRWLRGLLGGGKKAGPASGEHKPEREKKRWGFGKSFREKDPVRPPTPPVQRAATPRRTYATSDDGGDEQNKRAIAVAAATAAVAEAAVAAAQAAAAVVRLTSSGRCPPAGAKHEEWAAVRIQAAFRGYLARRALKALRGLVKLQALVRGNIVRRQAAETLRCMQALVSVQSRARASRATRSRQAAAHPGATTPEKYEQAAYDGALRHGRSGSLKGGSSKTPGSERMSRERSESCGRNWLDRWVEERYMDDEKNAKILEVDPGKPGRHASKRRSSGGGHHQSSCSTRTSEQNSRSYATMPDSPSRDSTTAQQSVPSPSSVGMGAGEALSPLHMPADLAAELYESPQFFSATSRPGSSKRGAFFTPTKSECARSLFGGYSDYPNYMSNTESFRAKARSQSAPKQRPLYEKSGSLRKASAHAFAPGQRSSASASLHARFTNKAYPGSGRLDRLGMPVKY

SEQ ID NO: 3318 - DNA, 1433 bp, Zea mays
  misc_feature (1)..(1433): useful for making plants with increased salt and oxidative stress tolerance as described in USSN 11/858,117
  misc_feature (1)..(1433): Ceres CLONE ID no.353438
atgatgtgtaacctacgagctgctctggtaaccgcttcccctccagcaaggagaacgccaccttgtggcgtcagctctgccgtcgtctttactgcctgcgccttccaggcttcttcgtttcaggaagcaaggcgaggcgggcgctgaaggcgttgcgggggctggtgaagctgcaggcgctggtccggggcaacatcgtgcggcggcaggcggcggagacgctgcgatgcatgcacgcgctcgtccgcgtccaggcgcgcgcgcgcgcctgccgcgcaattcgctcgcagcatgtcacggcgcatccggacccgccgacgccggagaagtacgagcaggcgggtgcggccaggcacggccgttccggctctctgaaggcgaactcttcgaggacaccgggcggcgagaggctgggcagggagaggtcggaatcctgcgggaggaactggctggaccgctgggtggaggagaggtacatggacgacgagaagaacgccaagattctcgaggtggacaacggcaagccagggcgccggtatgcttccaagaggcgcggcggcggcggcgtcggcggaaaccaccaccaccagcaccaccagtcgccgtgctcgacgacgatgggctccgagcagaacagccggagctacgcgaccatgccggagtcgccgtccaaggactcgacgaccgcgcagcagtcggtgccgagcccgccgtcggtgggcatggccgaggaggaggccctgagcccgctgcgcgtgcccgtgcccgcggacgtggccgagctctgcgacagcccccagttcttctcggccacgtcgtcgcggcccgggagctcgaggcggggcccgttcacgccgacggccaagagcgagtgctcgcgcagcctcttcggcggctactccgactacccgaactacatggccaacacggagtcgttccgcgccaaggcgcggtcgcagagcgcgccgaagcagaggccgcagtacgagcggtccagctccctacgcagggcgtcggcggcgcagaggtcggcggcggcggcggcctcctccctgcacgccaagttcaccaacaaggcgtacccgggctctggcaggctggatcggcttggcttgccggccaggtactgatactgagcctgcctaattcgcgtcaggatgatgtgctgccgctgtgtctcgagcgaggaggacgacgacgaagaagtgcaatcgactagtggtagttaggttccgccgtgccttggttgtgctattaccatcaacagttttttctgtttcttgctttgtgtagctagccatgtctaaagttgctggtagctgtaatgatgctataatgcgtgcttaactgctgacgaacctttttcctctacatttccgtggtatatatatatgtgccgtcaaatcatgcatgggaattgaatgtgttgttgc

SEQ ID NO: 3319 - protein, 299 aa, Zea mays
  misc_feature (1)..(299): useful for making plants with increased salt and oxidative stress tolerance as described in USSN 11/858,117
  misc_feature (1)..(299): Ceres CLONE ID no.353438
  misc_feature (1)..(299): Score of 204.3 for HMM of FIGURE 2 of USSN 11/858,117.
  misc_feature (1)..(299): Functional Homolog Of Ceres SEEDLINE ID no. ME06748
MHALVRVQARARACRAIRSQHVTAHPDPPTPEKYEQAGAARHGRSGSLKANSSRTPGGERLGRERSESCGRNWLDRWVEERYMDDEKNAKILEVDNGKPGRRYASKRRGGGGVGGNHHHQHHQSPCSTTMGSEQNSRSYATMPESPSKDSTTAQQSVPSPPSVGMAEEEALSPLRVPVPADVAELCDSPQFFSATSSRPGSSRRGPFTPTAKSECSRSLFGGYSDYPNYMANTESFRAKARSQSAPKQRPQYERSSSLRRASAAQRSAAAAASSLHAKFTNKAYPGSGRLDRLGLPARY

SEQ ID NO: 3320 - protein, 499 aa, Oryza sativa subsp. japonica
  misc_feature (1)..(499): useful for making plants with increased salt and oxidative stress tolerance as described in USSN 11/858,117
  misc_feature (1)..(499): Public GI ID no.125593074
  misc_feature (1)..(499): Score of 112.2 for HMM of FIGURE 2 of USSN 11/858,117.
  misc_feature (134)..(154): Pfam Name: IQ Pfam Description: IQ calmodulin-binding motif
  misc_feature (1)..(499): Functional Homolog Of Ceres SEEDLINE ID no. ME06748
MGKAARWFRNMWGGGRKEQKGEAPASGGKRWSFGKSSRDSAEAAAAAAAAAAEASGGNAAIARAAEAAWLRSVYADTEREQSKHAIAVAAATAAAADAAVAAAQAAVAVVRLTSKGRSAPVLAATVAGDTRSLAAAAVRIQTAFRGFLAKKALRALKALVKLQALVRGYLVRRQAAATLQSMQALVRAQATVRAHRSGAGAAANLPHLHHAPFWPRRSLVRRWLNLADDIAMYMFDVDVVCWRWMQQERCAGDDTRSEHGVAAYSRRLSASIESSSYGYDRRPQDRGGGHRGGPSRGRRRRGGRAPPLLLDARWVRERRRGLVRQLHVVAAPVLPPRRRAAAPHRRPDVAPLPRLRLVRAGEGPAGDGAEHAAVRARAADADQERVRRRRRRRHPLVAAQLPELHVQHAVVRGRRCRSQSAPKQRPETGGAGAGGGRKRVPLSEVVVVESRASLSGVGMQRSCNRVQEAFNFKTAVVGRLDRSSESGENDRHAFLQRRW

SEQ ID NO: 3321 - DNA, 1807 bp, Gossypium hirsutum
  misc_feature (1)..(1807): useful for making plants with increased salt and oxidative stress tolerance as described in USSN 11/858,117
  misc_feature (1)..(1807): Ceres CLONE ID no.1920115
ctcctttcctcagtaagcttacgaaacttcttcttcgcttcttctctgcaaatgaatcccgagaaacctcccaaacccttatcttattaccctttttcaccttcttctccatcaccaaactaacgtttccgtacacaacgaacaaaatcaaagcaatgggtaaagcttccaagtggttccgcagcatcctcggcttcaaaaatccgacccccataaccaaccttctccttcttcttcaaaaccaacttcccataaagacaaacggcgttggagtttcgtcaaatcgtaccgtgaaaaagactcctccacgaacaatagtaatgcgaagttgccgtcgtcttcgcagcaacagaaagactctgtttccttcgttgaaaggaaaggtgacaatgaagtaacggatcctagcaagcacgccatcgctgttgctgccgctactgccgccgttgccgaagcagccgttgcggctgctcaagctgccgctgcggtggttaggctcactagtaacagtggtaggtgcgcgcgtgaatcggcagcggtttacgtttgcaacaacaatagctatatagcacacgatgagtcatccgccattaagatacaatctgcatttcgtggatacctggcaagaagagcattgcgagcactaaaaggattagtgagactccaagcattggttagaggtcatatagaaaggaagagaactgcagaatggttaagaaggatgcaagcattattgagagcacaagcacgtgctcgtgctggccgggcccaaatttccgagtcttcccaatcaagctgcaaatcgtctcacttccatcatccggatccagcaacccctgaaaaatttgaacatgttattcgatccaagggtacaaaatatgaacaatcatcaatgttgaagagaaatggatcaaagtcaagtggaaggactgttgataatcaagagaaattacactcaggttggtatcgccgtgttgatgagcaaacatgggagcattcaacaagaattggtcctaatgatgatgaaaagaatgacaaaatccttgaagttgacactgggaaaccaaatttcatctctaaacggagaaacctctttcattcaacacatctttctctgaattctgatttatatagctgtagtttcactaattcgagagactcacaccaaacagctcctagtccttcatctggtgaagttcagtctttaactccattgatgctgtctcactctgaagcaatacaggaaagccctttctgcggtgctgttgatgataatagtccacaattctattctgcatcatcaaaaggagctagttccaagagaagccccttcactcctgctaagagtgatggcactagaagctacctaagtggttactcagaccatccaaattacatgtcttacactgaatcgtcaaaagctaaggtaaggtctttcagtgctccaaaacaaaggcctcattatgaaagatctagttcaacaaagaggtactccattcatggttttggtgaattgaaatcaactacacaaaggtctgccatgcatgcaaacttcgccagcaaagcttaccccggttcgggtaggttggacaggctaggaatgccccttgggtatagatactaaataatggttttaccatttggctaaggaatgttatgtagtttatgtttagatgttaacgatgatgactctcacctaccctaatgtatccatcctttaatgttttagtgcatgtgagttcccaagttaaaaagaatagtagctgctttacaagaagttaaattagaaaaaaaaaaaaaaaaaaaa

SEQ ID NO: 3322 - protein, 300 aa, Gossypium hirsutum
  misc_feature (1)..(300): useful for making plants with increased salt and oxidative stress tolerance as described in USSN 11/858,117
  misc_feature (1)..(300): Ceres CLONE ID no.1920115
  misc_feature (1)..(300): Score of 34.2 for HMM of FIGURE 2 of USSN 11/858,117.
  misc_feature (1)..(300): Functional Homolog Of Ceres SEEDLINE ID no. ME06748
MQALLRAQARARAGRAQISESSQSSCKSSHFHHPDPATPEKFEHVIRSKGTKYEQSSMLKRNGSKSSGRTVDNQEKLHSGWYRRVDEQTWEHSTRIGPNDDEKNDKILEVDTGKPNFISKRRNLFHSTHLSLNSDLYSCSFTNSRDSHQTAPSPSSGEVQSLTPLMLSHSEAIQESPFCGAVDDNSPQFYSASSKGASSKRSPFTPAKSDGTRSYLSGYSDHPNYMSYTESSKAKVRSFSAPKQRPHYERSSSTKRYSIHGFGELKSTTQRSAMHANFASKAYPGSGRLDRLGMPLGYRY

SEQ ID NO: 3323 - DNA, 1614 bp, Arabidopsis thaliana
  misc_feature (1)..(1614): useful for making plants with increased salt and oxidative stress tolerance as described in USSN 11/858,117
  misc_feature (1)..(1614): Ceres CLONE ID no.21821
ataatttgatgaacagtcttcttctctgatgcagaaaccctctccctgaatcttgattctctcacaatcaagatttgaagcaaacgttttgagaaaaatcttttgacaccatcaaatttggttggcggattgtgggaggaattccagagcaatatagcaggtgatggttgtacaacaatggctaagaagaagggcttgttcactgtattgaaaaggatttttatttcagaagttaattcagaaaagaaagagaagagaagaaaatggacattttggaagcttaggattaagaaaagattaccttccattacagcacctccagagcacaggacaagtcatgaatcgcatgaggaacagaaggaggaaattgtgtcagatgtgggtgagatcagccaagtgtcttgtagtcgacagttagattccatagaagagtcaaaaggttcaacatcaccagaaactgctgatctggtagtccagtatcaaatgtttcttaatagacaggaagaagttcttgctgctactcgcattcagaccgcctttcggggtcatcttgcaaggaaagctctacgtgccttgaagggaatagtgaagctccaagcatatatcagaggtcgtgctgtgagacgccaagcaatgactacactaaaatgcctgcaatctgttgtgaacattcagtcacaagtctgtggtaagagaacacagattcccggaggtgttcacagagattatgaagagagcaatatattcaatgataacattctcaaggtggacacaaacggtcaaaagagatgggacgatagtcttttaacaaaggaagaaaaggaagcagtggtaatgagcaagaaagaagcttcactaagaagagaaaggataaaggaatatgcagtcacccaccggaaatctgcggagtcataccagaaacgaagtaacactaaatggaagtactggttagacgaatgggtagatacacaactaaccaagagcaaggagctcgaagatctcgacttctcttcgaaaacaaaaccgaaagacgaaactttgaacgagaagcagcttaaaactccaaggaactcatcaccaagaagattagtgaataatcatagaagacaagtttcaataggtgaagatgaacaaagccctgccgcggtcactatcactacaccaacttatatggttgcaacagagtcagcaaaggcaaagtcaagatcattaagctccccaaggataagaccgagaagttttgacacacagtcagagagttactcgccatataagaacaagctatgcctgacgacatcaatgatgagtgaagcaccaagcaaagtaaggattgccaacaatggcagtaacactagaccaagtgcataccagcaacggtctccagggttaaggggatttaacataggccctttgaaatcatgcaataataataatactctattgaacgatctcagcattaattcagaaagatctctacctagctggaacaagcagagcagcttgagatgagtggatattgaaccctgtatatatacatactacatacgttccaatgtttcttttgacttttgagggtcacactcacatatgtgtatcatcaaatattgtttcgtt

SEQ ID NO: 3324 - protein, 443 aa, Arabidopsis thaliana
  misc_feature (1)..(443): useful for making plants with increased salt and oxidative stress tolerance as described in USSN 11/858,117
  misc_feature (1)..(443): Ceres CLONE ID no.21821
  misc_feature (1)..(443): Score of 237.2 for HMM of FIGURE 2 of USSN 11/858,117.
  misc_feature (111)..(131): Pfam Name: IQ Pfam Description: IQ calmodulin-binding motif
  misc_feature (1)..(443): Functional Homolog Of Ceres SEEDLINE ID no. ME06748
MAKKKGLFTVLKRIFISEVNSEKKEKRRKWTFWKLRIKKRLPSITAPPEHRTSHESHEEQKEEIVSDVGEISQVSCSRQLDSIEESKGSTSPETADLVVQYQMFLNRQEEVLAATRIQTAFRGHLARKALRALKGIVKLQAYIRGRAVRRQAMTTLKCLQSVVNIQSQVCGKRTQIPGGVHRDYEESNIFNDNILKVDTNGQKRWDDSLLTKEEKEAVVMSKKEASLRRERIKEYAVTHRKSAESYQKRSNTKWKYWLDEWVDTQLTKSKELEDLDFSSKTKPKDETLNEKQLKTPRNSSPRRLVNNHRRQVSIGEDEQSPAAVTITTPTYMVATESAKAKSRSLSSPRIRPRSFDTQSESYSPYKNKLCLTTSMMSEAPSKVRIANNGSNTRPSAYQQRSPGLRGFNIGPLKSCNNNNTLLNDLSINSERSLPSWNKQSSLR

SEQ ID NO: 3325 - DNA, 1689 bp, Glycine max
  misc_feature (1)..(1689): useful for making plants with increased salt and oxidative stress tolerance as described in USSN 11/858,117
  misc_feature (1)..(1689): Ceres CLONE ID no.560066
ttttttatgggatttgaaaaaatggatcacagacattgaagttgacctatgtgttgatattcttaaatggccaaaaagaagagctggtttagtctggtgaagaggctctttatatgggacacacattccacacaagataagaaggagaaaagaaggaaatggatatttggaaggctaaagagcaagagattgccttcaattaaagctccactaccctcaaaaggaacaacactaagtgaggcagagcaagaacagagcaagcatgctttaacagtggccattgcctcagcagcagctgctgaagctgctgttactgctgctcatgctgctgctgaggttgttcgcctcactgggcaacgcaacgaaaactcagaagaatctcaacctgttaaaactaggaatggtgctccacaatccacataccagtgccagagggagattaaagaatctgctgcagccatcaaaattcaaactgcatttcggggttacctggcaaggaaggctttgagggcgttgaagggaatagtgaagcttcaagctatcattcgtggcagagccgtaagacgccaagctatgagtagtcttaagtgcttacagtccattgtgagcatccagtcacaggtctgtgcaaggaggctccaaatggttgaagggagatgtgattactctgaaaatgaagagatgcaagattttaaagacaaaataattaggatggactcaaacagtgaaagaaagtgggatgaaagcactgtattgaaggaagaggtagacacctcttgcacaagcaagagagaaagaacaaaagaatactcatttaaccacagaaggtcagcagagtcagaaagaagtaaagtaaatggaagatggaggtactggctagagcagtgggtagatacacaactttcaaagagtaaagagcttgaagatttagactcagtttttagctcacattctagagctggggaggaatatggaggaaggcaacttaagctgagaagtaatattcagagacaaaatccagttgaaggattggattctccaatacttggttcaagaagatcttttcctcataggaggcagtgttcagtgggagaggaccactcatttttaagctctcctgcaactccagcatacatggctgcaacagaatcagcaaaagcaaaagcaagatcaacaagctccccaaaaataaggactggggggaatgtggacatgaactctgatagctattcaccatgcaagaaaaagctatccattgcatcttctattaacagtgaaatgcttagtaatggtagggtgggcaagctcagtgttaaccagcagcaaagatcaccaagctttaagggactttcagtgcctataaaatcaagccgaacaactatcaaggatctcagtattaattcagattgctcactccctaattgggatcgacaggctttcttcaaatgaatctatgaatgctgatgttactctttcttgcattaacacaattccttgtatcatgtgaaggcttggaaacaataactgtttataaatatgtatgatatactatatgctattggatgttattttggttgggaattgaacattaatgtgacagaaaatagttattctggagatataagatgaattgtatgattaagaaagaagagatataagatggattgtatgattaagaaagaaggaaag

SEQ ID NO: 3326 - protein, 460 aa, Glycine max; identical to SEQ ID NO: 3290
  misc_feature (1)..(460): useful for making plants with increased salt and oxidative stress tolerance as described in USSN 11/858,117
  misc_feature (1)..(460): Ceres CLONE ID no.560066
  misc_feature (1)..(460): Score of 822.2 for HMM of FIGURE 2 of USSN 11/858,117.
  misc_feature (128)..(148): Pfam Name: IQ Pfam Description: IQ calmodulin-binding motif
  misc_feature (1)..(460): Functional Homolog Of Ceres SEEDLINE ID no. ME06748

SEQ ID NO: 3327 - protein, 501 aa, Oryza sativa subsp. japonica
  misc_feature (1)..(501): useful for making plants with increased salt and oxidative stress tolerance as described in USSN 11/858,117
  misc_feature (1)..(501): Public GI ID no.115453071
  misc_feature (1)..(501): Score of 546.0 for HMM of FIGURE 2 of USSN 11/858,117.
  misc_feature (122)..(142): Pfam Name: IQ Pfam Description: IQ calmodulin-binding motif
  misc_feature (1)..(501): Functional Homolog Of Ceres SEEDLINE ID no. ME06748
MERKRRGWLERIKRLFVSEPKQKPKPDKKVKSKRWMFAGKLKTQHSFALPAPAPAVEEEQIRQAEDEQSKHAMAVALATAAAAEAAVAAAHAAAEVVRLTGKTAALAPAPATTTTPTPYGHEHAALMIQSVYRGYLARRALRALKGLVRLQALIRGQAVRRQTAATLRGLESLMKIQARQRARASSAAAAGGDHNAANSPAPDGMDALLRRGRELYYAAAAAVHEQQLSKGWDSSTLSKEEMSAMSRSREEAALKRVRALQYASLHQSEKVGVRRQPMSREEMETLNQRWSWLEEWVGSQPPFDKDIPVAHQSPSRDAAGAAMNDDERPPPPPVLRSRSRADRLACVGGDDDDADRQLGYSARRSFTRAGRRTPARDDDGGGAAAFPGYMASTASAKAKFRSMSTPKERSGAGAADAYSEQCFPFADRLLSPIPSMSPIPSIASDIVFARSSRPAAAQRSPRVKGPMTPTRSRSRRSPGRHSFGSEAALHQLQMEQYTPIR

SEQ ID NO: 3328 - DNA, 1814 bp, Gossypium hirsutum
  misc_feature (1)..(1814): useful for making plants with increased salt and oxidative stress tolerance as described in USSN 11/858,117
  misc_feature (1)..(1814): Ceres CLONE ID no.1968211
aatttcccccttcctctctccctcctttcctcagtaagcttacgaaacttcttcttcgcttcttctctgcaaatgaatcccgagaaacctcccaaacccttatctttttaccctttttcaccttcttctccatcaccaaactaacgtttccgtacacaacgaacaaaatcaaagcaatgggtaaagcttccaagtggttccgcagcatcctcggcttcaaaaaatccgacccccataaccaaccttctccttcttcttcaaaaccaacttcccataaagacaaacggcgttggagtttcgtcaaatcgtaccgtgaaaaagactcctccacgaacaatagtaatgcgaagttgccgtcgtcttcgcagcaacagaaagactctgtttccttcgttgaaaggaaaggtgacaatgaagtaacggatcctagcaagcacgccatcgctgttgctgccgctactgccgccgttgccgaagcagccgttgcggctgctcaagctgccgctgcggtggttaggctcactagtaacagtggtaggtgcgcgcgtgaatcggcagcggtttacgtttgcaacaacaatagctatatagcacacgatgagtcatccgccattaagatacaatctgcatttcgtggatacctggcaagaagagcattgcgagcactaaaaggattagtgagactccaagcattggttagaggtcatatagaaaggaagagaactgcagaatggttaagaaggatgcaagcattattgagagcacaagcacgtgctcgtgctggccgggcccaaatttccgagtcttcccaatcaagctgcaaatcgtctcacttccatcatccggatccagcaacccctgaaaaatttgaacatgttattcgatccaagggtacaaaatatgaacaatcatcaatgttgaagagaaatggatcaaagtcaagtggaaggactgttgataatcaagagaaattacactcaggttggtatcgccgtgttgatgagcaaacatgggagcattcaacaagaattggtcctaatgatgatgaaaagaatgacaaaatccttgaagttgacactgggaaaccaaatttcatctctaaacggagaaacctctttcattcaacacatctttctctgaattctgatttatatagctgtagtttcactaattcgagagactcacaccaaacagctcctagtccttcatctggtgaagttcagtctttaactccattgatgctgtctcactctgaagcaatacaggaaagccctttctgcggtgctgttgatgataatagtccacaattctattctgcatcatcaaaaggagctagttccaagagaagccccttcactcctgctaagagtgatggcactagaagctacctaagtggttactcagaccatccaaattacatgtcttacactgaatcgtcaaaagctaaggtaaggtctttcagtgctccaaaacaaaggcctcattatgaaagatctagttcaacaaagaggtactccattcatggttttggtgaattgaaatcaactacacaaaggtctgccatgcatgcaaacttcgccagcaaagcttaccccggttcgggtaggttggacaggctaggaatgccccttgggtatagatactaaataatggttttaccatttggctaaggaatgttatgtagtttatgtttagatgttaacgatgatgactctcacctaccctaatgtatccatcctttaatgttttagtgcatgtgagttcccaagttaaaaagaatagtagctgctttacaaaaaaaaaaaaaaaaaaaa

SEQ ID NO: 3329 - protein, 489 aa, Gossypium hirsutum
  misc_feature (1)..(489): useful for making plants with increased salt and oxidative stress tolerance as described in USSN 11/858,117
  misc_feature (1)..(489): Ceres CLONE ID no.1968211
  misc_feature (1)..(489): Score of 555.8 for HMM of FIGURE 2 of USSN 11/858,117.
  misc_feature (142)..(162): Pfam Name: IQ Pfam Description: IQ calmodulin-binding motif
  misc_feature (1)..(489): Functional Homolog Of Ceres SEEDLINE ID no. ME06748
MGKASKWFRSILGFKKSDPHNQPSPSSSKPTSHKDKRRWSFVKSYREKDSSTNNSNAKLPSSSQQQKDSVSFVERKGDNEVTDPSKHAIAVAAATAAVAEAAVAAAQAAAAVVRLTSNSGRCARESAAVYVCNNNSYIAHDESSAIKIQSAFRGYLARRALRALKGLVRLQALVRGHIERKRTAEWLRRMQALLRAQARARAGRAQISESSQSSCKSSHFHHPDPATPEKFEHVIRSKGTKYEQSSMLKRNGSKSSGRTVDNQEKLHSGWYRRVDEQTWEHSTRIGPNDDEKNDKILEVDTGKPNFISKRRNLFHSTHLSLNSDLYSCSFTNSRDSHQTAPSPSSGEVQSLTPLMLSHSEAIQESPFCGAVDDNSPQFYSASSKGASSKRSPFTPAKSDGTRSYLSGYSDHPNYMSYTESSKAKVRSFSAPKQRPHYERSSSTKRYSIHGFGELKSTTQRSAMHANFASKAYPGSGRLDRLGMPLGYRY

SEQ ID NO: 3330 - protein, 464 aa, Oryza sativa subsp. indica
  misc_feature (1)..(464): useful for making plants with increased salt and oxidative stress tolerance as described in USSN 11/858,117
  misc_feature (1)..(464): Public GI ID no.116310011
  misc_feature (1)..(464): Score of 886.7 for HMM of FIGURE 2 of USSN 11/858,117.
  misc_feature (124)..(144): Pfam Name: IQ Pfam Description: IQ calmodulin-binding motif
  misc_feature (1)..(464): Functional Homolog Of Ceres SEEDLINE ID no. ME06748
MGWASRWLRGLLGGGKKPNSGSGDPKPAREKKRWGFGKSFREKSPAHPPPPPPPSAAVQRAVTPRRAYTASDEGDDEQSKRAIAVAAATAAVAEAAVAAAQAAAAVVRLTSSGRCAPAAAKREEYAAVRIQAAFRGYLARRALKALRGLVKLQALVRGNIVRRQAAETLRCMHALVRVQRRARACRAIRSQHVSAHPGPPTPEKYDQATHEGVPKHGRSGSLKGSSSKTPGSERLTRERSESCGRNWLDKWVEERYLDDEKNAKILEVDTGKPGRHASRRRSGSHHHHSSCSSMTSEQKSRSYATMPESPSKDSTTAQQSVPSPPSVGMAEALSPLRMAVDIAELCDSPQFFSATSRPGSSRSRAFTPTKSECSRSLFGGYSDYPNYMANTESFRAKARSQSAPKQRPQYEKSSSLRKASAHAFGPGSCAPVAQRTTASLHSKFTNKAYPGSGRLDRLGMPVKY

SEQ ID NO: 3331 - DNA, 1019 bp, Arabidopsis thaliana
  misc_feature (1)..(1019): useful for making plants with increased salt and oxidative stress tolerance as described in USSN 11/858,117
  misc_feature (1)..(1019): Ceres SEEDLINE ID no.ME08768
gttactaatctcacgcacattctttctctctctaaattctgcaccacaatccgcaaaatgaccaaatacttcttgctgtgaatgtcgaaaatgcctgcaggcacaacatgtgaagtgatgcaaaacggcaacacttgtttcaccagatcctttcgtcattgatggggaagaaaggaggcagctggttctcatctgtgaagaaagttttcaagtcatcttctaaagattcgccccagcctgagaagaagaaggacaacacacagaaattacagcatgaagtggcagaggtggtgtcctttgagcattttcctgcagagagttctccagataatgtgagcaatgcagagatgagtacgacatcaacgccagtgaccaacgaagatagaagccatgcgattgccgttgcagcagcaactgccgcagctgcagaagctgctgtggtggctgctcaagcagctgcaagagttgtaagattggcaggaagttacgggcggcagtccaaggaagaaagagcagcaacactcattcaatcatactatagaggctacctggctcgacgtgcactacgagcattgaagggattagtgaggctgcaagcactggtgaggggacacaatgtgcggaagcaagcgcagatgacgatgcggtgcatgcaagcactggtgagggtgcaggcacgagtacgggctcgccgattccaattgagtcacgcggatcaggaaagagagaagaaagaagagcccaagcccatacccgtgcccgtgcccatgagccccctgagaagaatagacgacattaatgactgggacaataggcgtcaaagtagctacaaaattaaggaaaacgatttgcggaaacatgaagctgtaatgaagagagagagagctcttgcatacgctttcaactatcaacaggttagttaatttgtcatgattaaatgggaatatagtggataaaatagcttagtctaatattctttcaaaacggtacgtgcaatttaatttatctatatcttcttt

SEQ ID NO: 3332 - protein, 253 aa, Arabidopsis thaliana
  misc_feature (1)..(253): useful for making plants with increased salt and oxidative stress tolerance as described in USSN 11/858,117
  misc_feature (1)..(253): Ceres SEEDLINE ID no.ME08768
  misc_feature (1)..(253): Score of 467.7 for HMM of FIGURE 1 of USSN 11/858,117.
  misc_feature (116)..(136): Pfam Name: IQ Pfam Description: IQ calmodulin-binding motif
MGKKGGSWFSSVKKVFKSSSKDSPQPEKKKDNTQKLQHEVAEVVSFEHFPAESSPDNVSNAEMSTTSTPVTNEDRSHAIAVAAATAAAAEAAVVAAQAAARVVRLAGSYGRQSKEERAATLIQSYYRGYLARRALRALKGLVRLQALVRGHNVRKQAQMTMRCMQALVRVQARVRARRFQLSHADQEREKKEEPKPIPVPVPMSPLRRIDDINDWDNRRQSSYKIKENDLRKHEAVMKRERALAYAFNYQQVS

SEQ ID NO: 3333 - DNA, 1906 bp, Gossypium hirsutum
  misc_feature (1)..(1906): useful for making plants with increased salt and oxidative stress tolerance as described in USSN 11/858,117
  misc_feature (1)..(1906): Ceres CLONE ID no.1943807
atcttttttatcttcacagtgttggtgtcttggctccttcttcaaagcttcttttagctgtaaatgtagcttggtttaaccctatccttttgaatggggatgaaaggagggacttcatggttgactgctgtgaaaagggcttttagatctcctactaaagatacccatgaagatgaaaaggtaagtgtttcaatctattttaatggctgtttatgaatctaaaaagaaaaccctttgatttttttttatatagaagagagataaacggaggtggatctttaggaaacaaaatacaagtcctgtgaagagtgtaggtaataatggtggtggtggtgcaagtacggcagcagcggagcaaagacatgctattgctgtggcggtggctaaagcagctgaagctgaagctgcggtggcgacggcacaagcagctttacaagctgctcggttgactaaacctagttatggcaggaaacatcactttgctgctattgttattcagacagcttttagaggctacctggccaggagagctctacgtgcgttaaaagggctagtgaagttacaagctttagtgagaggtcacaacgtgagaaagcaagccaagatgacgcttcgttgcatgcaagcactggttaaagttcagtctcgtgttttagaccaaagaatgaggctctcgcacgatggttgcagccggaaatcagcatttagcgacaccaacagtgtatgggaatcacggtatcttcaagatatatcggatagaagatcattatcgagagaaggaagtagcatagcagatgattgggacgaaaggccacacacagttgaagaagtgaaagctatgttacaacataggaaagaagctgctttgaaacgtgaaaagagcttgtcacaagcactgtcacaacagatgaggagagctcgaaggagtccatcaatggggggacaagatgagtggcttgatcgttggatgcctgctaaaccatgggataacagaggaagagcttcaatggatcaaagagataatgtcaaaactgttgaaatggacacttcacagccttattcatatttagcaccaaattatagaagaacaaattcaaaccattatcaccaaaggcctagttcacctctccatagggctcaacacaatgcacaacctttccacccttctccaattacaccctctccatcgaaaacacgtccggttcaagtacggtccgcgagccctcgttgcgttagggaagaccgaacatcgttttcatcatcacaaacaccaagtttaaggtccaattattattacacaggaagggttagtactcaagctagtactagcataaacaatgctactacattgcctaattacatggcagcaacagagtctgcaaaggctaggattaggtctcaaagtgcaccaagacagaggccatcgacaccagagagggaccgaatcggttcagcaaggaaaaggctatcgtttcccgtcccggaaccatatggtatcgggatggggtacggaggttatggtcatagcttgaggagcccgagttttaaaagtgtaagcgggtcgcaattcggattggaacgacagtctaactattcatcttgttgtactgagagccttggtggtgaaatgtcaccatcttcaactagtgatctaagaaggtggttgaggtgatcccatcaatgtagctgttggtttttactagttttatagtgtgtttccattgttgattttaccaattcttggttgaaattcaagctttataagtgaggcaactgcgatgaacccttccttactgggatctttcatgagattcataaccaaattgagtgtgtaatactataaagtaactctgtaattctgttttgtcataactttttaatatattaaagcttatcatcttttccg

SEQ ID NO: 3334 - protein, 355 aa, Gossypium hirsutum
  misc_feature (1)..(355): useful for making plants with increased salt and oxidative stress tolerance as described in USSN 11/858,117
  misc_feature (1)..(355): Ceres CLONE ID no.1943807
  misc_feature (1)..(355): Score of 667.2 for HMM of FIGURE 1 of USSN 11/858,117.
  misc_feature (1)..(355): Functional Homolog Of Ceres SEEDLINE ID no. ME08768
MTLRCMQALVKVQSRVLDQRMRLSHDGCSRKSAFSDTNSVWESRYLQDISDRRSLSREGSSIADDWDERPHTVEEVKAMLQHRKEAALKREKSLSQALSQQMRRARRSPSMGGQDEWLDRWMPAKPWDNRGRASMDQRDNVKTVEMDTSQPYSYLAPNYRRTNSNHYHQRPSSPLHRAQHNAQPFHPSPITPSPSKTRPVQVRSASPRCVREDRTSFSSSQTPSLRSNYYYTGRVSTQASTSINNATTLPNYMAATESAKARIRSQSAPRQRPSTPERDRIGSARKRLSFPVPEPYGIGMGYGGYGHSLRSPSFKSVSGSQFGLERQSNYSSCCTESLGGEMSPSSTSDLRRWLR

SEQ ID NO: 3335 - DNA, 1677 bp, Populus balsamifera subsp. trichocarpa
  misc_feature (1)..(1677): useful for making plants with increased salt and oxidative stress tolerance as described in USSN 11/858,117
  misc_feature (1)..(1677): Ceres ANNOT ID no.1471392
atggggaagaagggaggtagctcatggttgaccgttgtgaaaagggcttttagatctcctaataaagaaaatgacaagagaactgctgggactacaggccatgaccaagaagaagatgaagaaaagaagagagagaagaggaggtggctgtttaggaaacctacgaatcaagaaacagtgacacaacagatcctatcaaaggcaggaaatgtcaaggcctccacgggtggtggtggaggtgcaccgacagaccatgtgtcggcagctgcagcagctgagcaaaggcatgcaattgctgtagctgttgccactgcagctgcagctgaaactgcattagccactgcccaggcggccgtggaggtggctaggctcactaggccttcttatcaccctagagaacgttccgctgccattgtcattcaaaccgcttttagaggatacctggcaaggcgggctcttcgcgcgcttaaagggctagtgaagttgcaagctttagtgaggggacacaatgtgagaaagcaggccaagatgaccctgagatgcatgcaagctctggttcgagtgcaggctcgagtacttgaccaacgcatgaggctttcacatgaaggcagcagggaatctgcattcagtgacaccaatagcgtgtttgaatcgcgatatcttcaagaaatttcagaaagaaagtcgatgtcaagagacggcagcagcattgcagatgattgggatgatcggccacgcacaattgaggaagtcaaggccatgttgcaacgcaggaaagaagttgcattcaagcgtgagaaggccttatctcaaggtttctctcaacagatatggagaaaccgtaggagcccatcaatgggcaatgaaggtgagctccaagaaagatcacaatggcttgatcattggatgcctgcaaagccgtgggacaatagcagcagagcacgagcctcaactgatcaaagaaaccccatcaaaactgtagaaattgaaacctcccaaccttgctcatatttagctcctaattttggaagaacgaaccaaaaccaatatcaccaacaccagagatccaattcaataaacaatggtgttacatgctcggctcctcctccactccatagagctcatcaaaatgcttctctccgcaactctcctattacaccctccccgtcaagaactaggcctcttcaggttcgttcagcgagtccccgatgtgctagagaagatagaagctgtaattcctctcgaacaccgagtttaaggtccaattacctctataatggcaatctgaaacaacatggaatcaggggtggtgctgctagtgttagtggaaatgctaatgctacattgccaaattacatggctacaactgagtccgccaaggctagattgagatcacagagtgcgccaaggcaaagaccatcaacaccagagcgagacagggttgggtctgcaagaaaacggcttttgtatcctgtccccgacccttacggtgtcgggatgggttatggtggtgttggttacgggcatggtttcaggagtcccagctttaaaagtgtaagtggttcacattttggtggattagaacaacaatctaactattcttcttgctgcactgataccttcggtgctgagatttccccttcttcaacgagcgaccagagaaggtggttgagataa

SEQ ID NO: 3336 - protein, 382 aa, Populus balsamifera subsp. trichocarpa
  misc_feature (1)..(382): useful for making plants with increased salt and oxidative stress tolerance as described in USSN 11/858,117
  misc_feature (1)..(382): Ceres ANNOT ID no.1471392
  misc_feature (1)..(382): Score of 422.0 for HMM of FIGURE 1 of USSN 11/858,117.
  misc_feature (1)..(382): Functional Homolog Of Ceres SEEDLINE ID no. ME08768
MTLRCMQALVRVQARVLDQRMRLSHEGSRESAFSDTNSVFESRYLQEISERKSMSRDGSSIADDWDDRPRTIEEVKAMLQRRKEVAFKREKALSQGFSQQIWRNRRSPSMGNEGELQERSQWLDHWMPAKPWDNSSRARASTDQRNPIKTVEIETSQPCSYLAPNFGRTNQNQYHQHQRSNSINNGVTCSAPPPLHRAHQNASLRNSPITPSPSRTRPLQVRSASPRCAREDRSCNSSRTPSLRSNYLYNGNLKQHGIRGGAASVSGNANATLPNYMATTESAKARLRSQSAPRQRPSTPERDRVGSARKRLLYPVPDPYGVGMGYGGVGYGHGFRSPSFKSVSGSHFGGLEQQSNYSSCCTDTFGAEISPSSTSDQRRWLR

SEQ ID NO: 3337 - protein, 527 aa, Arabidopsis thaliana
  misc_feature (1)..(527): useful for making plants with increased salt and oxidative stress tolerance as described in USSN 11/858,117
  misc_feature (1)..(527): Public GI ID no.6715635
  misc_feature (1)..(527): Score of 916.5 for HMM of FIGURE 1 of USSN 11/858,117.
  misc_feature (121)..(141): Pfam Name: IQ Pfam Description: IQ calmodulin-binding motif
  misc_feature (1)..(527): Functional Homolog Of Ceres SEEDLINE ID no. ME08768
MGKKNGSSSWLTAVKRAFRSPTKKDHSNDVEEDEEKKREKRRWFRKPATQESPVKSSGISPPAPQEDSLNVNSKPSPETAPSYATTTPPSNAGKPPSAVVPIATSASKTLAPRRIYYARENYAAVVIQTSFRGYLARRALRALKGLVKLQALVRGHNVRKQAKMTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTPERDRAGLVKKRLSYPVPPPAEYEDNNSLRSPSFKSVAGSHFGGMLEQQSNYSSCCTESNGVEISPASTSDFRNWLR

SEQ ID NO: 3338 - DNA, 1946 bp, Triticum aestivum
  misc_feature (1)..(1946): useful for making plants with increased salt and oxidative stress tolerance as described in USSN 11/858,117
  misc_feature (1)..(1946): Ceres CLONE ID no.910109
atcaaaccccccactgcccgcgccagccagccgcggcaataataataactccgccgcctcctgccatgccgcacgctagtagtagcacgctaggatcgagtagctcgtagcgtagccgtgcgagggagggaggtgggtcgatgcccgcggccgtgcaaccacagcaaccgcgagccggtggtgttggccatggggaataagaagggcgggtcgtcgtggctcaccgccgtcaagcgggccttccgctcgccgtccaaggaggacagccccaagaagtctgcacgcctccgcgaggaccctgacgccgacgaggacaagaccaagagggagaggaggagatggctcttcaggagatcctcgtccccgtctccgtctccggcgtctgcccccgcgccgccggagcagcagcagtcggcgtcgaggtcggcacctgcacccgctgtgacggacgagcagcgtcacgccatcgcgctggccgtggcgaccgcggcgacggccgaggctgccgtggccacggcgcaggcggcggccgaggtcgtccgcctgacccgcccctcctccagcttcgtgcgggagcactacgctgccatcgtcgtacagaccgccttccgaggctacctggcgaggcgtgctctgcgcgcgctcaaggggctggtgaagctgcaagcgctagtgcgcgggcacaacgtgcggaagcaggccaacatgacgctgcggtgcatgcaggcgctggtgcgcgtccaggcgcgggtgcgcgaccagcggctgcgactctcccaggagtccttgtccgccgccggtgcggctgcgtgcggcagcagcaaatcctcgtacagcgttgacacctccgctttctgggactccaagtacacccaagaatacgccgaacgccgctctgtggagcggtcgcgagacggcagcagcttcgccgccgaagactgggacgaccggccgcggacgatagaggagattcaggcgatgctgcagacgaggaaagacgctgctctcaagcgtgagagagcgctctcatacgccttttctcaccaaatttggaggaacgccgctccgtcagtcgaggaggagatgaacgtcgacgggcagccgcgctgggcggagaagtggatggcgtcgcgcgcgtcgtttgatacaaacaggagcagcgcccgaactgccgcggcggcggctgctgcggcaccagggcgcgcgtccacggaccaccgcgaccaggtcaagacgttggagatcgacaccgcacggccattctcctactccacgcctcgccggcatgccccaccgtcgcagcacgggaacggctcgccgatgcaccgtgcgcaccaccaggcttcggtcacgccgtcaccggggaaggcgaggccaccgattcaggtgcgctccgcgagcccgcgagtggagcgcggcacaagtggtggaggaggaagctacacaccgagcttgcactcccagcgccacgcgtcctccggctcggcggtgccgaactacatggcggccacggaatctgcaaaggcacgtatccgctcccagagcgcgccacggcaacgccctgcaaccccggagcgcgaccggccacagaccgcctataaccccgccggagggagcgccaagaagcggctgtcgttccccgtcccgcaggacccgtacggcgttgggtacgcgcagagcctgcggagcccgagcttcaagagcgcgacggggcggttcacctccgagcagcgttcgaccgtctcgtctctgtcgtgcgcagagagcgtcggcggggaaccagtctccccgtcgtccaccactgacctccgccgctggctccgttgagttgagcccccggcgaggtgttcgttgtaatacctgcgttgctaattttctcgtaatctcctcggagaaaaatgaccttctcgtaatctatttttttgctgctaaaaaaaaaaaaaaaa

SEQ ID NO: 3339 - protein, 543 aa, Triticum aestivum
  misc_feature (1)..(543): useful for making plants with increased salt and oxidative stress tolerance as described in USSN 11/858,117
  misc_feature (1)..(543): Ceres CLONE ID no.910109
  misc_feature (1)..(543): Score of 1259.0 for HMM of FIGURE 1 of USSN 11/858,117.
  misc_feature (130)..(150): Pfam Name: IQ Pfam Description: IQ calmodulin-binding motif
  misc_feature (1)..(543): Functional Homolog Of Ceres SEEDLINE ID no. ME08768
MGKKAGTTSSWLTAVKRAFRSPSKDDSPNKAARLRDDTDDDKGKRERRRWLFRKSSSPSPAPPTPPPPQQQQQQSRAAAVTEEQRHAIALAVATAATAEAAVATAQAAAEVVRLTRPSSSFVREHYAAIVVQTAFRGYLARRALRALKGLVKLQALVRGHNVRKQANMTLRCMQALVRVQARVRDQRMRLSQDSISLSAAAASAAPCGSSKSSYSVDTSTFWDSKYTHDFAAADRRSIERSRDGSSFAAGDDWDDRPRTIEEIQAMLQTRKDAALKRERALSYAFSHQIWRNPAPSVEEMDVDGQPRWAERWMASRASFDTSRSTVRASAAAAPGRASTDHRDQVKTLEIDTARPFSYSTPRRHGNASYHASSSPMHRAHHHSPVTPSPSKARPPIQVRSASPRVERGGGGGGSYTPSLHSHRHHASSGGAAAVPNYMAATESAKARVRSQSAPRQRPATPERDRMSFGGGGGGGGAKKRLSFPVPIDPYGAYAQSLRSPSFKSAAGRFSSEQRSNVSSSCAESLGGDVVSPSSTTDLRRWLR

SEQ ID NO: 3340 - protein, 543 aa, Oryza sativa subsp. japonica; identical to SEQ ID NO: 3339
  misc_feature (1)..(543): useful for making plants with increased salt and oxidative stress tolerance as described in USSN 11/858,117
  misc_feature (1)..(543): Public GI ID no.115474509
  misc_feature (1)..(543): Score of 1167.6 for HMM of FIGURE 1 of USSN 11/858,117.
  misc_feature (125)..(145): Pfam Name: IQ Pfam Description: IQ calmodulin-binding motif
  misc_feature (1)..(543): Functional Homolog Of Ceres SEEDLINE ID no. ME08768

SEQ ID NO: 3341 - DNA, 1812 bp, Panicum virgatum
  misc_feature (1)..(1812): useful for making plants with increased salt and oxidative stress tolerance as described in USSN 11/858,117
  misc_feature (1)..(1812): Ceres CLONE ID no.1780908
gtgaccagccagccatggagcgcggccaacgccccccgcgccagcaataatacaacccccccaccacccgggccgcgcctgcccgtcgccggacatgggcaagaagggcggcgccacgtcctgactcaccgccgtcaagcgggccttccgctcgccctccaaggacgacgccgcctcgcccgcaaggaaggcctcgcgcctccgcgaccgcgacgacgcccccgccgacgccgaccaagacaagcaggggaagcgggagcagcgccggcgatggctgttccggaggtcctcctccccgtccccgtcccctgcccccgccgcgccggagcacccggccgtcacggaggagcagcgccacgccatcgcgctggcgctggcgaccgccgccacggccgaggccgccgtggccacggcgcaggcggcggcggaggtggtccgcctcaccctccccggcggcctcgccgcccgcgagcactacgccgccgtcctcatccagaccgccttccggggctacctggcgcgccgcgcgctgcgggcgctcaggggcctcgtcaagctgcaaacgctcgtgcgcggccacaacgtccgcaagcaggccaacatgacgctccgctgcatgcaggcgctggtgcgcgtccaggcgcgcgtccgggaccagcggatgcgcctctcccaggactccatgtccctgtccatgccgctgtccgccgccggcgccgccgcggcgccgtgcggcagcagcaagtcgtcgtacagcgtcgacacatccacgttctgggactccaagtacacccacgactacgccgaccgccgctccgtcgagcggtcgcgcgacggcagcagcttcgccgccgacgactgggacgaccggccgcggacgatagaggagatccaggccatgctgcagacgaggaaggacgcggcgctcaagcgtgagagggcgctgtcctacgccttctcgcatcaactttggaggaacccggcgccggcggcggatgagatggacgtggacggcggcgggcagcagccgcggtggatgacgtcgcgcgcgtccttcgacacgaaccggagcagcagcatccgcggcgcggcggtgcccgggcgcgcgtccatggaccaccgcgagcccgtgaagacgctggggatggacacggcgcggcccttctcgtactcgacgccgcggcagcaggcgccgtcgtcctcgccgatgcaccaccgcgggcactcgccggtgacgccgtcgccggggaaggcgcggcccccgatccaggtccggtcggcgagcccgcgcgtggaccgcggcgcgggcggcgggagctacacgccgagcctgctgcactcccagcggcaccaccaccaccaggcgggggcggcggtgcccaactacatggcggcgacggagtcggccaaggcccgggtgcggtcccagagcgcgccgcggcagcggcccgcgacgcccgagcgcgaccggctctccggcggcggcgggagcgcgaagaagcggctgtcgttcccggcggcggcagaggcgtacgcgcagtccctgcggagcccgagcttcaagagcgcggcggggcggttctcgtcggagcagcggtcgacggtgtcgtcgtcgtgcgcggagagcctcggcggagagccggcgtcgccgtcgtccaccaccgacctccgccgctggctccgctgagggccggccggccgtccgttctccgttgtagcagtaacgccgccttttggctcggcagacacgaccacgtgcccctgtagcatcatcttctctctcggtgtaattcatggcagcttttttcgagc

SEQ ID NO: 3342 - protein, 361 aa, Panicum virgatum
  misc_feature (1)..(361): useful for making plants with increased salt and oxidative stress tolerance as described in USSN 11/858,117
  misc_feature (1)..(361): Ceres CLONE ID no.1780908
  misc_feature (1)..(361): Score of 598.0 for HMM of FIGURE 1 of USSN 11/858,117.
  misc_feature (1)..(361): Functional Homolog Of Ceres SEEDLINE ID no. ME08768
MTLRCMQALVRVQARVRDQRMRLSQDSMSLSMPLSAAGAAAAPCGSSKSSYSVDTSTFWDSKYTHDYADRRSVERSRDGSSFAADDWDDRPRTIEEIQAMLQTRKDAALKRERALSYAFSHQLWRNPAPAADEMDVDGGGQQPRWMTSRASFDTNRSSSIRGAAVPGRASMDHREPVKTLGMDTARPFSYSTPRQQAPSSSPMHHRGHSPVTPSPGKARPPIQVRSASPRVDRGAGGGSYTPSLLHSQRHHHHQAGAAVPNYMAATESAKARVRSQSAPRQRPATPERDRLSGGGGSAKKRLSFPAAAEAYAQSLRSPSFKSAAGRFSSEQRSTVSSSCAESLGGEPASPSSTTDLRRWLR

SEQ ID NO: 3343 - DNA, 1398 bp, Populus balsamifera subsp. trichocarpa
  misc_feature (1)..(1398): useful for making plants with increased salt and oxidative stress tolerance as described in USSN 11/858,117
  misc_feature (1)..(1398): Ceres ANNOT ID no.1520883
atggggaagaaaggaaaaggatggtttacatctgtgaagagagtgttcaaatcatcatctcctaaggaattaccagtagggaaaaagaaagacaacgcagagaaatggcaacatgaggctccagaagttgtgtcattagagcattttcctactggaagttctcctgatgttacaaatgatgagagcaatgtatcaactccagtaactgaagatagaaatcatgccattgctgtggcagtagcgactgctgccgcagcagaagctgcggttgcagctgctcaagcggcggctaaagttgttcgcttagctggttatggacgacaatcaaaggaagaaagagctgccatcctcatacaatcattctataggggctaccttgctcggcgtgccttacgcgcattgaagggattggtgaggctccaagcattagtgagaggccacaatgtaagaaagcaagcacaaatgacaatgagaagcatgcaagctcttgttcgtgtgcaagcaagagtaagagcaagaagacttgaattagctcacgagaagcttcaaaggaagacagaggaagaagatgaacgaagactaccagtggacgaagactttatgaatccaaagaatccattgaagagttataaatgggataggaggaatcaaagttcagataatttcaaagaaaatgcttcaaagaagcatgatgctgtcatgaaaagagagagagcccttgcttatgcttatgccttccagcagcagcagcagcaacaattactctcacaaaatagtcctaatggtaaagaaacaggacattttgtgaacgaacacgagaagatgcaatggggatggaattggcttgagagatggatgtcagcacaatcatataacgtgcgtcaatcgggtccaaatgaagggtcttacgtgacagtaaacacaactacaaccacgaccaccacagaggacatgtccgagaagacagtagagatggacatggtgaccccaacaggcactagcaatcccaacatgggcatgctagacaccaatccatattcgaatcgaccccaatggcaatcaagttcaagcaatgtacgtagctacatggctccgacccagtccgcaaaggcgaaagtgcgttctcaaagtttgatcaagcaacgtgccccagcgacacctctgtggaatccatccaccaagaaagattcaagcattgttggtccaggttgtgattcttccagttcaggtggtggaacaacaacttatcacgctccaagaagtcctagccccaaacataacgggatgcgcctgcattcgagaagacatgctggtggatatagccctgatttcaatggcggtgatgattggaggttgcctcctcttgatggtcatggatggaggaatgattttggttga

SEQ ID NO: 3344 - protein, 309 aa, Populus balsamifera subsp. trichocarpa
  misc_feature (1)..(309): useful for making plants with increased salt and oxidative stress tolerance as described in USSN 11/858,117
  misc_feature (1)..(309): Ceres ANNOT ID no.1520883
  misc_feature (1)..(309): Score of 495.7 for HMM of FIGURE 1 of USSN 11/858,117.
  misc_feature (1)..(309): Functional Homolog Of Ceres SEEDLINE ID no. ME08768
MRSMQALVRVQARVRARRLELAHEKLQRKTEEEDERRLPVDEDFMNPKNPLKSYKWDRRNQSSDNFKENASKKHDAVMKRERALAYAYAFQQQQQQQLLSQNSPNGKETGHFVNEHEKMQWGWNWLERWMSAQSYNVRQSGPNEGSYVTVNTTTTTTTTEDMSEKTVEMDMVTPTGTSNPNMGMLDTNPYSNRPQWQSSSSNVRSYMAPTQSAKAKVRSQSLIKQRAPATPLWNPSTKKDSSIVGPGCDSSSSGGGTTTYHAPRSPSPKHNGMRLHSRRHAGGYSPDFNGGDDWRLPPLDGHGWRNDFG

SEQ ID NO: 3345 - DNA, 1445 bp, Arabidopsis thaliana
  misc_feature (1)..(1445): useful for making plants with increased salt and oxidative stress tolerance as described in USSN 11/858,117
  misc_feature (1)..(1445): Ceres CLONE ID no.148018
  misc_feature (1033)..(1033): s is g or c
  misc_feature (1037)..(1037): r is g or a
  misc_feature (1051)..(1051): r is g or a
  misc_feature (1052)..(1052): y is t/u or c
  misc_feature (1056)..(1056): s is g or c
attgggatttcatttagataatttttttttgggtcttgatctaagttttgttctttctaatttggtaaggcaagaagagcattaagagcattaaaagggttagtgaagctacaagcattggtgaggggacataatgtgagaaagcaagctaaaatgacattaaggtgtatgcaagctctggttcgagtccagtctcgtgtgcttgaccaacgcaaacgcttgtctcatgacggtagtcgcaaatccgcgttcagtgactctcacgctgtttttgaatctcgctatcttcaagatttgtcagatcgacaatccatgtcaagagaaggaagcagcgccgcggaagattgggatgaccgaccacacacgatagacgcagtgaaagtgatgctacaacggagacgggacacagcattgagacatgacaagactaatttgtcacaagctttctctcaaaagatgtggaggacggttggtaaccaatccacggaaggacaccacgaggtagaacttgaagaggaaaggccaaaatggcttgaccggtggatggctactagaccgtgggataaacgagctagtagtagagcttcggttgaccaaagggtttcagttaaaaccgttgaaatcgacacttctcagccttactcaagaacaggagcaggaagcccgagtcgtggccaaagacctagttccccatcaagaactagccaccattaccaatcccgcaataatttctcagccactccatctccggctaagtctagaccaatacttattcggtcagctagtccacggtgccagagagacccgagggaagaccgtgaccgagcagcttatagttatacatcaaacacaccaagcttgagatccaattatagtttcacagctaggagtggatgtacattagtaccacaatggttaataatgcatcattgttgcctaattacatggcgagtacagagtcagctaaagcgaggatccggtctcatagtgcaccgaggcaacggccctcaactcccgagagggaccgtgcggstttrgctacaagaaacgrytctsgtatccggtaccaccgccagcggagtatgaggacaataatagcttaaggagtccaagctttaagagtgtggctggttcacattttggtggaatgttagagcagcaatcgaattactcttcatgttgcactgagtctaacggtgttgagatctctccagcttctactagtgactttaggaattggcttagatgattggtggtgatgccaaatcaactgtcaagatctttcatcatcctccaggaaaagaacgttttaaaattttatattccagaagaaaacaaacacttttatattgtgtcgttgaggttgatttgtgtttggaagataagtttattgacctattgatctgtaacttcataagattttgaaacgttagaagattcaaaag

SEQ ID NO: 3346 - protein, 310 aa, Arabidopsis thaliana
  misc_feature (1)..(310): useful for making plants with increased salt and oxidative stress tolerance as described in USSN 11/858,117
  misc_feature (1)..(310): Ceres CLONE ID no.148018
  misc_feature (1)..(310): Score of 458.7 for HMM of FIGURE 1 of USSN 11/858,117.
  misc_feature (1)..(310): Functional Homolog Of Ceres SEEDLINE ID no. ME08768
  misc_feature (294)..(294): Xaa is any aa, unknown or other
  misc_feature (295)..(295): Xaa is any aa, unknown or other
  misc_feature (300)..(300): Xaa is any aa, unknown or other
  misc_feature (301)..(301): Xaa is any aa, unknown or other
MTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCTLVPQWLIMHHCCLITWRVQSQLKRGSGLIVHRGNGPQLPRGTVRXXLQETXXVSGTTASGV

SEQ ID NO: 3347 - protein, 364 aa, Arabidopsis thaliana
  misc_feature (1)..(364): useful for making plants with increased salt and oxidative stress tolerance as described in USSN 11/858,117
  misc_feature (1)..(364): Public GI ID no.18378797
  misc_feature (1)..(364): Score of 546.8 for HMM of FIGURE 1 of USSN 11/858,117.
  misc_feature (1)..(364): Functional Homolog Of Ceres SEEDLINE ID no. ME08768
MTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTPERDRAGLVKKRLSYPVPPPAEYEDNNSLRSPSFKSVAGSHFGGMLEQQSNYSSCCTESNGVEISPASTSDFRNWLR

SEQ ID NO: 3348 - protein, 364 aa, Arabidopsis thaliana
  misc_feature (1)..(364): useful for making plants with increased salt and oxidative stress tolerance as described in USSN 11/858,117
  misc_feature (1)..(364): Public GI ID no.21553500
  misc_feature (1)..(364): Score of 524.9 for HMM of FIGURE 1 of USSN 11/858,117.
  misc_feature (1)..(364): Functional Homolog Of Ceres SEEDLINE ID no. ME08768
  misc_feature (288)..(288): Xaa is any aa, unknown or other
  misc_feature (294)..(294): Xaa is any aa, unknown or other
  misc_feature (296)..(296): Xaa is any aa, unknown or other
  misc_feature (300)..(300): Xaa is any aa, unknown or other
  misc_feature (301)..(301): Xaa is any aa, unknown or other
MTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTARSGCSISTTMVNNASLLPNYMASTESAKARIRSHSAPRQRPSTXERDRAXLXKKRXXYPVPPPAEYEDNNSLRSPSFKSVAGSHFGGMLEQQSNYSSCCTESNGVEISPASTSDFRNWLR

SEQ ID NO: 3349 - DNA, 1713 bp, Populus balsamifera subsp. trichocarpa
  misc_feature (1)..(1713): useful for making plants with increased salt and oxidative stress tolerance as described in USSN 11/858,117
  misc_feature (1)..(1713): Ceres ANNOT ID no.1444522
atggggaagaagggaggtagctcatggttgactgctgtgaaaagggcgtttagatctccaactaaagaaagtgacaagagggctactggggttggccatgaccaagaagaagatgaagaaaagaagagagggaagagaagatggttatttaggaaacctacaaatcaagaaacggcgacacaacagaacctgtcaaaggcaggaaatgttaaggcatccccaggtggtggtggaggtgctccagcagaccatgtgtcggcagctgcagcagctgagcaaaggcatgcaattgcagtagcagttgctactgcagctgcagctgaagctgctgtagccactgcccaggcggcggcggaggttgctcggctcactaggccttcatatcatcctagagaacattatgctgccattgtcattcaaacagcttttagaggatacttggcaaggcgggctcttcgtgcacttaaagggctagtgaagttgcaagctttagtaaggggacacaatgtgagaaaacaggccaagatgaccctgcgatgcatgcaagctctggctcgagtgcaggctcgagtgcttgatcaacgcgtgagactttcacatgaaggcagcaggaaatctgcatttagtgacaccaatagcgtgcttgaatcgcgatatcttcaagacatttcagatagaaaatccatgtcaagagaaagcagtagcattgcagatgattgggatgatcggccacactccattgaggaagtcaaggccatgttgcaacgcaggaaagaagctgcgttcaagcgtgaaaagaccttatctcaagctttctctcagcagctcatggctaattggttcaattttttcaaacccatgtccaagatatggagaaatggcagaagcccatcaaatggcaatgaagatgagctccaagaaagaccacaatggcttgatcaatggatgcctgcaaagccatgggacaatagcagcagagcaagagcttcaactgatcaaagagaccccatcaaaactgtagaaattgacacctcccaaccttattcatatttagttcctaattttagaagaacaaaccaaaaccaacatcaccaacaccagagatccaattcatcaaacaatggtgtggcacactctgctccttctccactccatagagctcatcaaactgctccactccaccactctcctatcacaccctccccatcaaaaactaggcctcttcaggttcgttcagctagtccacgatgtgcaagagaagatagaagttgtaattcctctcaaacaccaagtttaaggtccaattatttttacaatggaagtttgaatcaacatggaatcaggggtggtgctagtgttagtagtaatggtaatgctacattgccaaattacatggctgcaaccgagtctgccaaggctagattgagatcacagagtgcaccaaggcaaagaccatcaacaccagaacgagaccggattgggtctgcaagaaaacggctttcgtatccagcccccgacccttgtgatgtcggtatagtttatggcggtgctggttacggccatggtttaaggagtccaagctttaagagcgtgagcggttcacgtttgggtggactagaacaacagtctaactattcttcttgctgtacggatagctttggtggtgagctttccccttcttcaactaacgatcttaggaggtggttgagatga

SEQ ID NO: 3350 - protein, 395 aa, Populus balsamifera subsp. trichocarpa
  misc_feature (1)..(395): useful for making plants with increased salt and oxidative stress tolerance as described in USSN 11/858,117
  misc_feature (1)..(395): Ceres ANNOT ID no.1444522
  misc_feature (1)..(395): Score of 439.2 for HMM of FIGURE 1 of USSN 11/858,117.
  misc_feature (1)..(395): Functional Homolog Of Ceres SEEDLINE ID no. ME08768
MTLRCMQALARVQARVLDQRVRLSHEGSRKSAFSDTNSVLESRYLQDISDRKSMSRESSSIADDWDDRPHSIEEVKAMLQRRKEAAFKREKTLSQAFSQQLMANWFNFFKPMSKIWRNGRSPSNGNEDELQERPQWLDQWMPAKPWDNSSRARASTDQRDPIKTVEIDTSQPYSYLVPNFRRTNQNQHHQHQRSNSSNNGVAHSAPSPLHRAHQTAPLHHSPITPSPSKTRPLQVRSASPRCAREDRSCNSSQTPSLRSNYFYNGSLNQHGIRGGASVSSNGNATLPNYMAATESAKARLRSQSAPRQRPSTPERDRIGSARKRLSYPAPDPCDVGIVYGGAGYGHGLRSPSFKSVSGSRLGGLEQQSNYSSCCTDSFGGELSPSSTNDLRRWLR

SEQ ID NO: 3351 - DNA, 1443 bp, Populus balsamifera subsp. trichocarpa
  misc_feature (1)..(1443): useful for making plants with increased salt and oxidative stress tolerance as described in USSN 11/858,117
  misc_feature (1)..(1443): Ceres ANNOT ID no.1467519
atggggaagaaaggaaaaggatggtttacatctgtgaagagagtgttcaaatcatcatctcctaaggaattaccagtagggaaaaagaaagacaacgcagagaaatggcaacatgaggctccagaagttgtgtcattagagcattttcctactggaagttctcctgatgttacaaatgatgagagcaatgtatcaactccagtaactgaagatagaaatcatgccattgctgtggcagtagcgactgctgccgcagcagaagctgcggttgcagctgctcaagcggcggctaaagttgttcgcttagctggttatggacgacaatcaaaggaagaaagagctgccatcctcatacaatcattctataggggctaccttgtaatccctttcttcatttcactttattttgatcaatataatctggctcggcgtgccttacgcgcattgaagggattggtgaggctccaagcattagtgagaggccacaatgtaagaaagcaagcacaaatgacaatgagaagcatgcaagctcttgttcgtgtgcaagcaagagtaagagcaagaagacttgaattagctcacgagaagcttcaaaggaagacagaggaagaagatgaacgaagactaccagtggacgaagactttatgaatccaaagaatccattgaagagttataaatgggataggaggaatcaaagttcagataatttcaaagaaaatgcttcaaagaagcatgatgctgtcatgaaaagagagagagcccttgcttatgcttatgccttccagcagcagcagcagcaacaattactctcacaaaatagtcctaatggtaaagaaacaggacattttgtgaacgaacacgagaagatgcaatggggatggaattggcttgagagatggatgtcagcacaatcatataacgtgcgtcaatcgggtccaaatgaagggtcttacgtgacagtaaacacaactacaaccacgaccaccacagaggacatgtccgagaagacagtagagatggacatggtgaccccaacaggcactagcaatcccaacatgggcatgctagacaccaatccatattcgaatcgaccccaatggcaatcaagttcaagcaatgtacgtagctacatggctccgacccagtccgcaaaggcgaaagtgcgttctcaaagtttgatcaagcaacgtgccccagcgacacctctgtggaatccatccaccaagaaagattcaagcattgttggtccaggttgtgattcttccagttcaggtggtggaacaacaacttatcacgctccaagaagtcctagccccaaacataacgggatgcgcctgcattcgagaagacatgctggtggatatagccctgatttcaatggcggtgatgattggaggttgcctcctcttgatggtcatggatggaggaatgattttggttga

SEQ ID NO: 3352 - protein, 309 aa, Populus balsamifera subsp. trichocarpa; identical to SEQ ID NO: 3344
  misc_feature (1)..(309): useful for making plants with increased salt and oxidative stress tolerance as described in USSN 11/858,117
  misc_feature (1)..(309): Ceres ANNOT ID no.1467519
  misc_feature (1)..(309): Score of 495.7 for HMM of FIGURE 1 of USSN 11/858,117.
  misc_feature (1)..(309): Functional Homolog Of Ceres SEEDLINE ID no. ME08768

SEQ ID NO: 3353 - protein, 291 aa, Oryza sativa subsp. indica
  misc_feature (1)..(291): useful for making plants with increased salt and oxidative stress tolerance as described in USSN 11/858,117
  misc_feature (1)..(291): Public GI ID no.125559938
  misc_feature (1)..(291): Score of 403.9 for HMM of FIGURE 1 of USSN 11/858,117.
  misc_feature (1)..(291): Functional Homolog Of Ceres SEEDLINE ID no. ME08768
MQRLQERSRDGSSFAAGDDWDDRPRTIEEIQAMLQTRKDAALKRERALSYAFSHQIWRNPAPSVEEMDVDGQPRWAERWMASRASFDTSRSTVRASAAAAPGRASTDHRDQVKTLEIDTARPFSYSTPRRHGNASYHASSSPMHRAHHHSPVTPSPSKARPPIQVRSASPRVERGGGGGGSYTPSLHSHRHHASSGGAAAVPNYMAATESAKARDVIRGAARRGAKKRLSFPVPIDPYGAYAQSLRSPSFKSAAGRFSSEQRSNVSSSCAESLGGDVVSPSSTTDLRRWLR

SEQ ID NO: 3354 - DNA, 1509 bp, Arabidopsis thaliana
  misc_feature (1)..(1509): useful for making plants with increased salt and oxidative stress tolerance as described in USSN 11/858,117
  misc_feature (1)..(1509): Ceres SEEDLINE ID no.ME19173
acattctccgatattctctctctctctatcaatctctcactctcaaactttctacatacctgaagaaaaaaataatctacgaattcgagccaaaaagatcgaaactttttaatctatgggtgcttcagggaaatgggtcaagtccattatcggtctcaagaagctagagaaggatgaaatcgaaaagggtaatgggaaaaacaagaaatggaagctatggaggactacttcagtagattcatggaagggttttcgaggaaaacatcggtctgattcagacggtgttgattcttctactgtttactctgctgctgttgctactgttcttagagctcctcctaaagatttcaaagctgttagagaagaatgggctgctattagaatccaaaccgcttttcgtggattcttggcgagaagagcgttgagggcattgaaagggatagtgaggttacaagctttagtgagaggaagacaagttaggaaacaagcagctgttacattgagatgcatgcaagctttggtgagagtacaagctcgtgttagagctcgtcgtgtgaggatgactgttgaaggacaagctgttcaaaagcttttagatgaacatagaaccaaatctgatctcttgaaagaagtcgaggaagggtggtgtgataggaaaggtactgtggatgatattaagtcaaagttgcagcagagacaagaaggtgcttttaagagggaacgtgctttggcttatgctcttgctcaaaagcaatggaggtcaactactagctcaaaccttaagacgaatagttcgatttcgtatcttaaaagtcaagagtttgataagaatagttggggatggagttggttggagcgttggatggctgctaggccatgggagactagacttatggacactgttgataccgctgccacgcctcctcctctgcctcataaacatttgaaatcaccggaaactgcggatgttgttcaagttagaagaaacaatgtgaccactagagtatctgcaaaacctcctcctcatatgctgtcttcaagtcctggttatgagtttaacgagagctcaggttcatcctcgatttgtacttcaactacgcctgtttctggaaaaactggacttgtttcagataactctagcagtcaagcaaaaaagcacaagccaagttacatgagcttgactgaatcgacaaaggctaagcgaagaactaaccgcggtctcaggcaatctatggatgagtttcagtttatgaagaactctggaatgtttacaggggaattgaagactagtccttcctcagatccttttgttagtttctccaaaccactcggtgttcctactcgattcgagaagccgagaggttaaatgtgaccttgttagattggagtttcaacagcttgttgttgtcttgtgtgttgtgagatatctgtgtatgttgttaattgttctttttcctttggaactacattggagttttgaatttaaatataaatttcagtcttgctttt

SEQ ID NO: 3355 - protein, 416 aa, Arabidopsis thaliana
  misc_feature (1)..(416): useful for making plants with increased salt and oxidative stress tolerance as described in USSN 11/858,117
  misc_feature (1)..(416): Ceres SEEDLINE ID no.ME19173
  misc_feature (1)..(416): Score of 954.4 for HMM of FIGURE 3 of USSN 11/858,117.
  misc_feature (84)..(104): Pfam Name: IQ Pfam Description: IQ calmodulin-binding motif
MGASGKWVKSIIGLKKLEKDEIEKGNGKNKKWKLWRTTSVDSWKGFRGKHRSDSDGVDSSTVYSAAVATVLRAPPKDFKAVREEWAAIRIQTAFRGFLARRALRALKGIVRLQALVRGRQVRKQAAVTLRCMQALVRVQARVRARRVRMTVEGQAVQKLLDEHRTKSDLLKEVEEGWCDRKGTVDDIKSKLQQRQEGAFKRERALAYALAQKQWRSTTSSNLKTNSSISYLKSQEFDKNSWGWSWLERWMAARPWETRLMDTVDTAATPPPLPHKHLKSPETADVVQVRRNNVTTRVSAKPPPHMLSSSPGYEFNESSGSSSICTSTTPVSGKTGLVSDNSSSQAKKHKPSYMSLTESTKAKRRTNRGLRQSMDEFQFMKNSGMFTGELKTSPSSDPFVSFSKPLGVPTRFEKPRG

SEQ ID NO: 3356 - protein, 442 aa, Oryza sativa subsp. japonica
  misc_feature (1)..(442): useful for making plants with increased salt and oxidative stress tolerance as described in USSN 11/858,117
  misc_feature (1)..(442): Public GI ID no.115435054
  misc_feature (1)..(442): Score of 949.2 for HMM of FIGURE 3 of USSN 11/858,117.
  misc_feature (109)..(129): Pfam Name: IQ Pfam Description: IQ calmodulin-binding motif
  misc_feature (1)..(442): Functional Homolog Of Ceres SEEDLINE ID no. ME19173
MGGSGKWVKSLIGLKKPDREDCKEKLQVPSVNGRGGGKGRKWKLWRSSSGDHGSLWRGSRGGGGGGGHHRSASSDASDDASSAAADPFTAAVATVARAPAKDFMAVRQEWAAIRVQTAFRGFLARRALRALKGLVRLQAIVRGRQVRKQAAVTLRCMQALVRVQARIRARRVRMSTEGQAVQKLLEARRTKLDILREAEEGWCDSQGTLEDVRVKLQKRQEGAIKRERAIAYAYSQQIEGATKCNQQPKPTSYGRLNQSGMLLKHQHFDKSNGNWSWLERWMAARPWENRLMEEHNQTNSSSPDLLSSKNCEDSFGILGDFSEPNSVKVRKNNVSKRVCAKPPVVSHHQRIKAQSISSLSTELHNDESSASSSSCFASTPISFSTFVTTEKTEDSIRARPNYMNMTESIKAKRKACNAQRTTAGKLMEDRKASGVELKVAQV

SEQ ID NO: 3357 - DNA, 1661 bp, Gossypium hirsutum
  misc_feature (1)..(1661): useful for making plants with increased salt and oxidative stress tolerance as described in USSN 11/858,117
  misc_feature (1)..(1661): Ceres CLONE ID no.1847857
attttttttctctttgagtcttgttgaagacttgaggttctctcccccccccccacctttttttggtgcaaaaagatttcctttttgtcactcatactctgttatcaattgtttccatcgtagcccatttcctttttcttttcttaaataacagttgtttgtatctctgagaaaaatatatactttgaaactaccatgggtgcttcagcgaaatgggtgaaatctcttattggtctcaagaaaactgtaaaagatgaccaagaaaagatgggtggcaagagcaagaaatggaagctatggaggagttcttcaggggatggaataggttcctcatggaagggttttaaaggaaagtttaaagcagattacgaaggatctgattcttcaccaaggtctgaagctttctctgctgccatggctgctgtggttcgagctcctcctaaagatttcagggttgtaaggcaagaatgggctgctatccgcattcaaactgctttccgaggcttcttggcaagaagggctttaagggctttaaagggagtcgttaggatccaagcctttgttcgcggtcgacaggtgaggaaacaggctgctgtgacactccggtgcatgcaagctctcgttcgtgtccaagctcgtgttagagctcgtcgtgtccgaatgtccatcgagggccaggcagttcaaaagatactcgatgaacaccgcagcaaggccgaactcttgaaacaagccgaggagggctggtgtgatagtaaaggaacattggatgatgttacaataaagctacaactgagacaagaaggtgctttcaagagagaacgagcacttgcttattctcttgcacaaaagcaatggagattgaacatggattcaaatactcgaacaaatagttcggtttcagttccatatctcaaaaaccaagtgtttgataagaatagttggggatggagttggcttgaacgttggatggcagcccggccgtgggaaactcgattgatggagcaatcacaggcagacccttccgaaccaactccaccatcgaaaacttgttcagagtctagaaagattactagaccgaccgaaccatgttcagtgaaggtacgaaagaacaatgtcacaactaggatttcagcaaagcctccccatattggtcaaggtactagatcatcatcgagtccaagttccgaattccggttcgaagagagctccgcatcatcatcgatatgcacatctacaacacgggtctcgtggaatacaatgccgacttcagagagaacggagaagacggggaatagtaggccaaactatatgaacttgacagagtctaccaaggccaaacaaagagctgcaaatcatgccttacgaagaatccaaatgcagtccatggatgagttccagttaaagaaaacagctggtttgtatgatggggattcaaagagtagtgtggggtcggatcctacggtccatatgtctcggccactgtatccaccaacaagattaggttaaaagtggttgtgtctgtgattaagtagatcgtcagttttattatgttttccaacatcttgtttagttttagtgtgatgtagcaaacaagttgttgagtgtttttgtatctaattcgacggcaattcattctgcaaaaaaaaaaaaaaaaaaaa

SEQ ID NO: 3358 - protein, 437 aa, Gossypium hirsutum
  misc_feature (1)..(437): useful for making plants with increased salt and oxidative stress tolerance as described in USSN 11/858,117
  misc_feature (1)..(437): Ceres CLONE ID no.1847857
  misc_feature (1)..(437): Score of 1019.5 for HMM of FIGURE 3 of USSN 11/858,117.
  misc_feature (91)..(111): Pfam Name: IQ Pfam Description: IQ calmodulin-binding motif
  misc_feature (1)..(437): Functional Homolog Of Ceres SEEDLINE ID no. ME19173
MGASAKWVKSLIGLKKTVKDDQEKMGGKSKKWKLWRSSSGDGIGSSWKGFKGKFKADYEGSDSSPRSEAFSAAMAAVVRAPPKDFRVVRQEWAAIRIQTAFRGFLARRALRALKGVVRIQAFVRGRQVRKQAAVTLRCMQALVRVQARVRARRVRMSIEGQAVQKILDEHRSKAELLKQAEEGWCDSKGTLDDVTIKLQLRQEGAFKRERALAYSLAQKQWRLNMDSNTRTNSSVSVPYLKNQVFDKNSWGWSWLERWMAARPWETRLMEQSQADPSEPTPPSKTCSESRKITRPTEPCSVKVRKNNVTTRISAKPPHIGQGTRSSSSPSSEFRFEESSASSSICTSTTRVSWNTMPTSERTEKTGNSRPNYMNLTESTKAKQRAANHALRRIQMQSMDEFQLKKTAGLYDGDSKSSVGSDPTVHMSRPLYPPTRLG

SEQ ID NO: 3359 - DNA, 1353 bp, Populus balsamifera subsp. trichocarpa
  misc_feature (1)..(1353): useful for making plants with increased salt and oxidative stress tolerance as described in USSN 11/858,117
  misc_feature (1)..(1353): Ceres ANNOT ID no.1455219
atgggtgcatcaggaaaatgggtgaaatccattataggtctaaaaaagtctgataaagatcaagaccaatatgagaaggtgagtggaaagagcaagaaatggaagctatggaggagttcatcaggagatttggggtcttcatggaagggtttcaaagggaaccacagagcagcatcagaggcatcgggttcttcaccactggctgatccatttactgctgcaatggctactgtggttagagctcctcctaaggatttcagggttgtcaggcaagaatgggctgctatcaggattcaaactgcttttcgtggattcttggcaagaagggctctgagggccttgaaaggagtggtgagactccaagctctagttcgaggtcgacaagtgaggaagcaggctgcagtgacacttaagtgcatgcaagctcttgttcgtgttcaagctcatgttagggctcgtcgtgtgcgaatgtccttagaagggcaggcagtgcagaatatgctgaatgagcgacgtagcaaggctgacctcttgaaacatgctgaggaagggtggtgtgatagaaaggggacattagaagacgtgaagtcaaaactgcaaatgaggcaagaaggagccttcaagagagaaagagctattgcttactcccttgctcaaaaacaatggagatcaaaccccagctcaaacactcgacccaataactcggtatattctttcaagaatgaggagtttgataagaatagctggggatggagttggcttgaacgttggatggcagccaagccatgggagactagattgatggaacaaacccatactgatccctcagtgactccaccacccaagtcctgtgtagatgcaagcacacattcgaaatcctttgaacaaagttcagtgaaagtgagaaagaacaatgtaaccactagaatttcagcgagacctccaatcgggcatgttactcgctcatcttcaagtccaagttctgaagtccgctttgatgagagctcagcttcttcatcaatttgtacttctacaacaccaatatcaggaaacactggcttggcctcagataaaacagaggagagtggtaacagcaggccaaactacatgaacctgaccgagtcaaccaaggcaaagcaaaacacatccagtcatttatttcataggattcaaaggcagtccatggatgagtttcagtttttcaaaaagtcagcggcgttctcaaatggagattcaaaaagcagtgctggttctgatccttcagttaatttatccaagccactttgcttgccgacaagatttgataagaactcgatgaaacaaataagaggaacggatcatttgtatgcctag

SEQ ID NO: 3360 - protein, 450 aa, Populus balsamifera subsp. trichocarpa
  misc_feature (1)..(450): useful for making plants with increased salt and oxidative stress tolerance as described in USSN 11/858,117
  misc_feature (1)..(450): Ceres ANNOT ID no.1455219
  misc_feature (1)..(450): Score of 1091.4 for HMM of FIGURE 3 of USSN 11/858,117.
  misc_feature (92)..(112): Pfam Name: IQ Pfam Description: IQ calmodulin-binding motif
  misc_feature (1)..(450): Functional Homolog Of Ceres SEEDLINE ID no. ME19173
MGASGKWVKSIIGLKKSDKDQDQYEKVSGKSKKWKLWRSSSGDLGSSWKGFKGNHRAASEASGSSPLADPFTAAMATVVRAPPKDFRVVRQEWAAIRIQTAFRGFLARRALRALKGVVRLQALVRGRQVRKQAAVTLKCMQALVRVQAHVRARRVRMSLEGQAVQNMLNERRSKADLLKHAEEGWCDRKGTLEDVKSKLQMRQEGAFKRERAIAYSLAQKQWRSNPSSNTRPNNSVYSFKNEEFDKNSWGWSWLERWMAAKPWETRLMEQTHTDPSVTPPPKSCVDASTHSKSFEQSSVKVRKNNVTTRISARPPIGHVTRSSSSPSSEVRFDESSASSSICTSTTPISGNTGLASDKTEESGNSRPNYMNLTESTKAKQNTSSHLFHRIQRQSMDEFQFFKKSAAFSNGDSKSSAGSDPSVNLSKPLCLPTRFDKNSMKQIRGTDHLYA

SEQ ID NO: 3361 - DNA, 1433 bp, Zea mays
  misc_feature (1)..(1433): useful for making plants with increased salt and oxidative stress tolerance as described in USSN 11/858,117
  misc_feature (1)..(1433): Ceres CLONE ID no.352452
cccacacggcagcaggcagggcgccatctcctagcagctcctcccatggcgtcctctgcccttcttctcctccatggccgccgaagcccctcccatggccgacgctctctgctccagcccctccagcagctatggcgtcccccctcctccccttcttcttcctcaagccagcaggcacctccctctactccctgcgcgcagcagcagccatggcgctgcctctcttctccatggcgagtagcagctcattcacctctctctcccatggcgtgctgctccagtcggcctcccttctccccctcggctccttcctccaggccgggccgtgcagaagctgctcgaggcgcgccgcacccagatggatatcctcagggaagccgaggaaggatggtgtgacagccagggaacacttgaacaagtgagggtcaagctgcagaagcggcaggagggcgcaatcaagcgtgagcgggctatcgcctatgcatattcgcagcaggccgacggtgctgccaaatgcaatccaccgaagcttacttccaatggactggtgaaccactccggcatgctgctcaagcaccagaacttagacaagggcaacggcaactggagctggctggagaggtggatggcagcgcggccatgggagaacaggctgatggaggagcacaactccagctccccggacttccggtcctccaagaactgcgaggactcctttggtgtgctcggcgacttctctgaaccgaactcagtgaaggtgcgcaagaacaatgtcagcaagcgggtctgcgcaaaacctccagggccaacacacgcccacggacatcatcagcgcctcaaggcccagtcgatctcgtctctgagcactgagctgcacaacgacgagagctccgcgtcctcctcgtcttgctttgcgtctacccctatatcattcacacttgtggcttcggagaagaccgaggacagcgtcaggacgagacccaactacatgagcatgacggagtcgatcaaggctaagcagaaggcatgcagcgcccagaggacggtggcgctgaagcaatgtgatgataggaaagccatgagcgccgagttgaaggtcgctcaggtgtgactgtttcgtggaactccatgcagagatggagccgacttcgacatcctctctatgccctaggatgtgttgcttggtgtcttgccacattcttgagtggctcggtgctgcattcctgagttgtcctcctgttgctgggtgtctgattattcaacttcttgttgtcagattgcatctttgttcagtcattgtggctgcatctttgttcagccgttgtggctttgtcagtggtagagtctctgtaagatagttctttgagtagacagcattgtggatttctttcctgggtgttgatttcaggtcaaaaaagacaggataatttact

SEQ ID NO: 3362 - protein, 250 aa, Zea mays
  misc_feature (1)..(250): useful for making plants with increased salt and oxidative stress tolerance as described in USSN 11/858,117
  misc_feature (1)..(250): Ceres CLONE ID no.352452
  misc_feature (1)..(250): Score of 121.9 for HMM of FIGURE 3 of USSN 11/858,117.
  misc_feature (1)..(250): Functional Homolog Of Ceres SEEDLINE ID no. ME19173
MDILREAEEGWCDSQGTLEQVRVKLQKRQEGAIKRERAIAYAYSQQADGAAKCNPPKLTSNGLVNHSGMLLKHQNLDKGNGNWSWLERWMAARPWENRLMEEHNSSSPDFRSSKNCEDSFGVLGDFSEPNSVKVRKNNVSKRVCAKPPGPTHAHGHHQRLKAQSISSLSTELHNDESSASSSSCFASTPISFTLVASEKTEDSVRTRPNYMSMTESIKAKQKACSAQRTVALKQCDDRKAMSAELKVAQV

SEQ ID NO: 3363 - DNA, 1949 bp, Triticum aestivum
  misc_feature (1)..(1949): useful for making plants with increased salt and oxidative stress tolerance as described in USSN 11/858,117
  misc_feature (1)..(1949): Ceres CLONE ID no.787908
acacaggcaggcagccgagccgagcgagcaataattcgcaccggcacacaggagcggcagtaatggccgcgtggtgccggtgccagtagcaggcaggcaggcaggggagtagcgccactgcactgggcactgctgacgcttcgagcccacgctcttccctccacccttgcccctccctcccgaaactccctccctcccttggcctcctcaggcctcccaatctcgcagagcggcggccgtcattggccggcggcggtgcgcggccccggttgtttcctccggcgtcaggtgcccgtgatctggttgttgcagaggcggcgaggtgaggtgacgcggcggcgcgatgaggtggctcaagtcgttggttgggctgaggaaggtggagaggcagcagcagcgccgcaaggaggatggcgacgccggcccaacaaaaacagatgccgtcgatcagttccacttccaggatcagcactcccaggatcacgctagccttgtcggaccagaagagttccctgatgaaaatggtccgtcagaagatgagtgcgatacaccttcatgctcaggacctggtttcagtatgcttagtgtgccactgcctcaaacagaagaggagctcaaagagatctgggctgccacaattattcagactgcatatagagccctactggctaggagagcccgccgagctttaaaaggactggttaggcttcaagcccttgtaaggggtcatatagtgagaaagcaagctgctataacacttcggtgtatgcaagctttggtcagggtacaagcccgtgttagagcaaggcgggttcgtgtggccttggaaaatcagatggatgagcaacaaaataatgtagaagagcaaacggacgaggcacatgttcgagaagttgaggatgggtggtgcgatagtatagggtctgtggaagacatccaagcaaaattgttgaagaggcaggaagcagcagccaagcgtgagagagccatggcctatgccctttctcaccagtggcaagcaggttcaaggcaacaggcagccattacagcttctgaactagacaggaacagctggagctggaattggctggagagatggatggccgtccgcccgtgggagagtcggttccttggcatgtacgcagcagatggaattgccattgataccggagcgcacaatgctgagggaaatgcaaccaaggctccatacaggaaacctgtgaaaaagcaggtttcagctcttcattcaagtgtgttgatccagaaggcccgcccctcgaactcggagggtggtggctccttgtcgaacccgtctgccggttcggcgtcagctaaaccgaaacggaagctgccaccaaaggaaggttctgatgaagtctcgtctcgtctttcgggacttggtgcccggagcagtagtaatcctaaggagaggcctgggcagttacaacctcgggccaacaagaggttctccttgcctggcactggcacagaagttggcaaacggcaagtgaataaacctgcggtgaaccgatcccccaaggctaccgaagactccccagcgctggaagggaagcatcgccgtgccggttccgttggtctgctgctcaagagagttgagctgcaggcttgacaagccatctgaagccccatctaccgtcgtcaaggttcgaagtcagcatgctgcgctctgatacatgggcggccttagattctggaaggtccattggagcaatgtgcatttatttcttagccatattataggtatgcagtcaaaatgctcatctcaggagatgagatctagctagtgcttggatatgtatgtgctggtcagctggtgcctctagtcctggaggttaccatagcttgtactgttgtatttgtagctaagagcaagtatgggctcacattttctggaactattttttgtacaatgaaaaaaaaaaaaaaaa

SEQ ID NO: 3364 - protein, 428 aa, Triticum aestivum
  misc_feature (1)..(428): useful for making plants with increased salt and oxidative stress tolerance as described in USSN 11/858,117
  misc_feature (1)..(428): Ceres CLONE ID no.787908
  misc_feature (1)..(428): Score of 891.9 for HMM of FIGURE 3 of USSN 11/858,117.
  misc_feature (94)..(112): Pfam Name: IQ Pfam Description: IQ calmodulin-binding motif
  misc_feature (1)..(428): Functional Homolog Of Ceres SEEDLINE ID no. ME19173
MRWLKSLVGLRKVERQQQRRKEDGDAGPTKTDAVDQFHFQDQHSQDHASLVGPEEFPDENGPSEDECDTPSCSGPGFSMLSVPLPQTEEELKEIWAATIIQTAYRALLARRARRALKGLVRLQALVRGHIVRKQAAITLRCMQALVRVQARVRARRVRVALENQMDEQQNNVEEQTDEAHVREVEDGWCDSIGSVEDIQAKLLKRQEAAAKRERAMAYALSHQWQAGSRQQAAITASELDRNSWSWNWLERWMAVRPWESRFLGMYAADGIAIDTGAHNAEGNATKAPYRKPVKKQVSALHSSVLIQKARPSNSEGGGSLSNPSAGSASAKPKRKLPPKEGSDEVSSRLSGLGARSSSNPKERPGQLQPRANKRFSLPGTGTEVGKRQVNKPAVNRSPKATEDSPALEGKHRRAGSVGLLLKRVELQA

SEQ ID NO: 3365 - protein, 442 aa, Oryza sativa subsp. Japonica; identical to SEQ ID NO: 3356
  misc_feature (1)..(442): useful for making plants with increased salt and oxidative stress tolerance as described in USSN 11/858,117
  misc_feature (1)..(442): Ceres LOCUS ID no. Os01m00929_AP002743
  misc_feature (1)..(442): Score of 949.2 for HMM of FIGURE 3 of USSN 11/858,117.
  misc_feature (109)..(129): Pfam Name: IQ Pfam Description: IQ calmodulin-binding motif
  misc_feature (1)..(442): Functional Homolog Of Ceres SEEDLINE ID no. ME19173

SEQ ID NO: 3366 - DNA, 1801 bp, Zea mays
  misc_feature (1)..(1801): useful for making plants with increased salt and oxidative stress tolerance as described in USSN 11/858,117
  misc_feature (1)..(1801): Ceres CLONE ID no.246398
  misc_feature (1458)..(1458): r is g or a
  misc_feature (1772)..(1772): k is g or t/u
  misc_feature (1773)..(1773): r is g or a
  misc_feature (1774)..(1774): y is t/u or c
  misc_feature (1778)..(1778): w is a or t/u
  misc_feature (1782)..(1782): k is g or t/u
  misc_feature (1787)..(1787): k is g or t/u
  misc_feature (1791)..(1791): k is g or t/u
  misc_feature (1796)..(1796): r is g or a
  misc_feature (1797)..(1797): k is g or t/u
  misc_feature (1800)..(1800): k is g or t/u
gtctcgtctctacgcccgctctccactcttcctcccaaagcctgccgccgcgtggggggttgcttgctggctgcccgctcctctccctgctcctcctgtgtctgccgcccaccgcttccgggaacaagtccggttgccgccgccgccgtcgctgctctgtccgagaggagggaggaacagagcgggatgggagggtccgggaagtgggtcaagtcgctgatagggctcaagaagcagcccgagaaggaagactgcaaggacaagctgcagctcccatcagtccacggcggaggattgcgaggcaagggccgcaggtggaagctgtggcggacctcctccggcgaccagggctccatgtggcgcggctccagaggcggcagccagcgctcggcggcgtcggaggcctcggacgacgcgtcctcggtggccgccgtccccgccgacccgttcacggccgccgtcgccaccgtcgcccgcgccccggccagggacttcatggccgtccgccaggagtgggccgccatccgcgtccagaccgcgttccgcgggttcttggctcggcgggcgctccgggcgctcaaggggctggtgcggctccaggcgatcgtgcgcgggcggcaggtgcggaagcaggcggccgtgacgctgcggtgcatgcaggcgctggtgcgggtgcaggcgcgcatccgggcgcgccgcgtgcgcatgtccaccgagggccaggccgtgcagaagctgctcgaggcgcgccgcacccagatggatatcctcagggaagccgaggaaggatggtgtgacagccagggaacacttgaacaagtgagggtcaagctgcagaagcggcaggagggcgcaatcaagcgtgagcggggctatcgcctatgcatattcgcagcaggccgacggtgctgccaaatgcaatccaccgaagcttacttccaatggactggtgaaccactccggcatgctgctcaagcaccagaacttagacaagggcaacggcaactggagctggctggagaggtggatggcagcgcggccatgggagaacaggctgatggaggagcacaactccagctccccggacttccggtcctccaagaactgcgaggactcctttggtgtgctcggcgacttctctgaaccgaactcagtgaagatgcgcaagaacaatgtcagcaagcgggtctgcgcaaaacctccagggccaacacacgcccacggacatcatcagcgcctcaaggcccagtcgatctcgtctctgagcactgagctgcacaacgacgagagctccgcgtcctcctcgtcttgctttgcgtctacccctatatcattcacacttgtggcttcggagaagaccgaggacagcgtcaggacgagacccaactacatgagcatgacggagtcgatcaaggctaagcagaaggcatgcagcgcccagaggacggtggcgctgargcaatgtgatgataggaaagccatgagcgccgagttgaaggtcgctcaggtgtgactgtttcgtggaactccatgcagagatggagccgacttcgacatcctctctatgccctaggatgtgttgcttggtgtcttgccacattcttgagtggctcggtgctgcattcctgagttgtcctcctgttgctgggtgtctgattattcaacttcttgttgtcagattgcatctttgttcagtcattgtggctgcatctttgttcagccgttgtggctttgtcagtggtagagtctctgtaagatagttctttgagtakryagtwttgkggatktctktcctrkgtkt

SEQ ID NO: 3367 - protein, 318 aa, Zea mays
  misc_feature (1)..(318): useful for making plants with increased salt and oxidative stress tolerance as described in USSN 11/858,117
  misc_feature (1)..(318): Ceres CLONE ID no.246398
  misc_feature (1)..(318): Score of 291.2 for HMM of FIGURE 3 of USSN 11/858,117.
  misc_feature (109)..(129): Pfam Name: IQ Pfam Description: IQ calmodulin-binding motif
  misc_feature (1)..(318): Functional Homolog Of Ceres SEEDLINE ID no. ME19173
MGGSGKWVKSLIGLKKQPEKEDCKDKLQLPSVHGGGLRGKGRRWKLWRTSSGDQGSMWRGSRGGSQRSAASEASDDASSVAAVPADPFTAAVATVARAPARDFMAVRQEWAAIRVQTAFRGFLARRALRALKGLVRLQAIVRGRQVRKQAAVTLRCMQALVRVQARIRARRVRMSTEGQAVQKLLEARRTQMDILREAEEGWCDSQGTLEQVRVKLQKRQEGAIKRERGYRLCIFAAGRRCCQMQSTEAYFQWTGEPLRHAAQAPELRQGQRQLELAGEVDGSAAMGEQADGGAQLQLPGLPVLQELRGLLWCARRLL

SEQ ID NO: 3368 - protein, 440 aa, Oryza sativa subsp. indica
  misc_feature (1)..(440): useful for making plants with increased salt and oxidative stress tolerance as described in USSN 11/858,117
  misc_feature (1)..(440): Public GI ID no.125527441
  misc_feature (1)..(440): Score of 619.5 for HMM of FIGURE 3 of USSN 11/858,117.
  misc_feature (87)..(107): Pfam Name: IQ Pfam Description: IQ calmodulin-binding motif
  misc_feature (1)..(440): Functional Homolog Of Ceres SEEDLINE ID no. ME19173
MGASGKWIRTLVGLRPAAEREKERGGGGGKGRKWSRLWRSSSSQRGGGNASASEVYSETSSSADALSSVVAAVVRAPPRDFRLIRQEWAAVRIQTAFRAFLARRALRALRGIVRLQALVRGRRVRKQLAVTLKCMQALVRVQARARDRRARISADGLDSQDMLDERGGRVDPVKEAEAGWCDSQGTADDVRSKIHMRHEGAIKRERALTYAQSHQRCSNHGGRPSSPAVSLKHHGNGATRSNHSWSYLEGWMATKPWESRLMEQTHTENSTNSRCSESVEEVSVGGPKLSDASSVKIRRNNVTKRVAAKPPSMISATSSDFVCDESSPSTSSVTPLSANNSLATERRSDCGQVGGPSYMSLTKSAKARLSGYGSHKPPLQRQRSGDLLHHNRMAFSSIDVQSTAGSEVSVTSKRLNSLALKGRATRSLDKENERRPSSLL

SEQ ID NO: 3369 - protein, 420 aa, Oryza sativa subsp. japonica
  misc_feature (1)..(420): useful for making plants with increased salt and oxidative stress tolerance as described in USSN 11/858,117
  misc_feature (1)..(420): Public GI ID no.125595056
  misc_feature (1)..(420): Score of 536.3 for HMM of FIGURE 3 of USSN 11/858,117.
  misc_feature (79)..(99): Pfam Name: IQ Pfam Description: IQ calmodulin-binding motif
  misc_feature (1)..(420): Functional Homolog Of Ceres SEEDLINE ID no. ME19173
MGASGKWIKSLVSLKAAPEGTTKGRRWTRLWRSSSSASASASTAGDASESASSEADAFSSVVAAVVRAPPRDFRVIRQEWAAVRVQAAFRAFLARRALKALRGIVRLQALVRGRLVRRQLAVTLKCMNALLRVQERARERRARCSADGRDSQDAVGERDGRADPIKQAEALILQLLPPFHNEQWCDSQGSVSEVRSKIHMRHDAVAKRERAIAYALSHQPRSSKQSARPSSPARSLRNHESNRCNHDWSYIEGWMATKPWESRLMEQSHAELKCSKNSGELNLAGAQLSNASSVKMRGNRVAAKPPSVLSASSSDFPCDVSSASTSSATPARSDGGHGEGPSYMSLTKSAKARQSCNSPFQIQRQRSGGMSSYKRVALSPLDVQSNACSEFSVTSRKLNSLSLKGRSMTRSLDKENDNLF

SEQ ID NO: 3370 - DNA, 1682 bp, Zea mays
  misc_feature (1)..(1682): useful for making plants with increased salt and oxidative stress tolerance as described in USSN 11/858,117
  misc_feature (1)..(1682): Ceres CLONE ID no.236071
acatcccagtgccgagtgtccccacacaaccaagcggaagcttcggtcgaacagagggagtaagcagttgcgtttcgcattgcgcggcgccgatgggggcgtcggggaagtggatcaagtcgctggtggccctgaaggcgcccgagaaggcggcggggcacaagggcggtcgcaaatggcgtctctggcggagctcgtcggccacgtccagggccagcgccggcgagggcagtgcgctggcgtccgagtcttcttcggcgtcggccgactcgttcaactcggtcctcgccgccgtggtccgcgcgccgcccagggatttcctgctcatcaggcaggaatgggccgccgtccgcatccataccgccttccgcggattcttggcgagacgggcgttgaaggcgctgaggggcatcgtccggctgcaggcgctggtgcgcggccggcgcgtgcgcaagcaactggccgtcacgctcaagtgcatgcacgcactgctgcgggtgcaggaacgcgcccgggagcgccgggcgcgctcctccgctgatggccacggctcacagggccaggacgcgctcaacggctgtgccagttctaccaaagacgctatggaacaatggtgtgaccgccacggatctgttgctgaagtaagatcaaatttacacatgaagcatgaaggtgcagcaaagagagaaagggcaattgcctatgctgtgtctcaccagcctcggggttcaagacagaaggggagaccaagctctcctgctaactgcgttagaagccatgatcctaatgggtgcgatcaggacttcagttacttagacggatggatggcaacgaagccatgggagaccagatctacggagcgaaaccatagcgactcgcagctcgcgaagcacgaggagctgaacttgcccgcctccaagctttccgatgccagctcagttaagatcagaagaaacaatgtcacaactagggtatctgcagcaaagcgtcctcctccatcttcagtgctgtcagctgcttcttccgactccgcgtgcggcggcgagagctctcggtcgagaccatcggtgaccctgacgtctgctaccaccaacactgtcttagcgtcagaagcaagatcagacagtggcgacaccggaggcccgaactacatgagcttgaccaagtctgccaaggcgaggctgagtggatgcagcggcagcagccatcacaggtcgttccagcgaccacggtccggggacatgtcgagggtgacactgtcttcgatcgacacccagagcaacgcgggctcggagatttcagtcacctcgaagagactgaacagcatgtccctgaacctgaaaggccggagcttggacaaggagaacgaggaggattgatccatccaccaacggacaaagcagctgtcgtaggtctggtgcagtactaccacgcgttcaaagcagcatctctgtatttacggaatttacggaggaagacgcggtttatctctttcataaactccacacatgtcacatgtgagagagctctggcactaggtcaccgcttctatcatcattatcatccttagtttagtttagtgcgtaagttttgtacacatccaatcgatgtccagttcctaatttccttgtctctagtttgtacccataaattagtaatataagtacttatatcagcacgcg

SEQ ID NO: 3371 - protein, 428 aa, Zea mays
  misc_feature (1)..(428): useful for making plants with increased salt and oxidative stress tolerance as described in USSN 11/858,117
  misc_feature (1)..(428): Ceres CLONE ID no.236071
  misc_feature (1)..(428): Score of 873.4 for HMM of FIGURE 3 of USSN 11/858,117.
  misc_feature (82)..(102): Pfam Name: IQ Pfam Description: IQ calmodulin-binding motif
  misc_feature (1)..(428): Functional Homolog Of Ceres SEEDLINE ID no. ME19173
MGASGKWIKSLVALKAPEKAAGHKGGRKWRLWRSSSATSRASAGEGSALASESSSASADSFNSVLAAVVRAPPRDFLLIRQEWAAVRIHTAFRGFLARRALKALRGIVRLQALVRGRRVRKQLAVTLKCMHALLRVQERARERRARSSADGHGSQGQDALNGCASSTKDAMEQWCDRHGSVAEVRSNLHMKHEGAAKRERAIAYAVSHQPRGSRQKGRPSSPANCVRSHDPNGCDQDFSYLDGWMATKPWETRSTERNHSDSQLAKHEELNLPASKLSDASSVKIRRNNVTTRVSAAKRPPPSSVLSAASSDSACGGESSRSRPSVTLTSATTNTVLASEARSDSGDTGGPNYMSLTKSAKARLSGCSGSSHHRSFQRPRSGDMSRVTLSSIDTQSNAGSEISVTSKRLNSMSLNLKGRSLDKENEED

SEQ ID NO: 3372 - protein, 455 aa, Oryza sativa subsp. indica
  misc_feature (1)..(455): useful for making plants with increased salt and oxidative stress tolerance as described in USSN 11/858,117
  misc_feature (1)..(455): Public GI ID no.125524760
  misc_feature (1)..(455): Score of 926.5 for HMM of FIGURE 3 of USSN 11/858,117.
  misc_feature (109)..(129): Pfam Name: IQ Pfam Description: IQ calmodulin-binding motif
  misc_feature (1)..(455): Functional Homolog Of Ceres SEEDLINE ID no. ME19173
MGGSGKWVKSLIGLKKPDREDCKEKLQVPSVNGGGGGKGRKWKLWRSSSGDHGSLWRGSRGGGGGGGHHRSASSDASDDASSAAGDPFTAAVATVARAPAKDFMAVRQEWAAIRVQTAFRGFLARRALRALKGLVRLQAIVRGRQVRKQAAVTLRCMQALVRVQARIRARRVRMSTEGQAVQKLLEARRTKLDILREAEEGWCDSQGTLEDVRVKLQKRQEGAIKRERAIAYAYSQQIEGATKCNFWTKCVIFLVFAQQQPKPTSYGRLNQSGMLLKHQHFDKSNGNWSWLERWMAARPWENRLMEEHNQTNSSSPDLLSSKNCEDSFGILGDFSEPNSVKVRKNNVSKRVCAKPPVVSHHQRIKAQSISSLSTELHNDESSASSSSCFASTPISFSTFVTTEKTEDSIRARPNYMNMTESIKAKRKACNAQRTTAGKLMEDRKASGVELKVAQV

SEQ ID NO: 3373 - protein, 455 aa, Oryza sativa subsp. japonica
  misc_feature (1)..(455): useful for making plants with increased salt and oxidative stress tolerance as described in USSN 11/858,117
  misc_feature (1)..(455): Public GI ID no.125569365
  misc_feature (1)..(455): Score of 926.7 for HMM of FIGURE 3 of USSN 11/858,117.
  misc_feature (109)..(129): Pfam Name: IQ Pfam Description: IQ calmodulin-binding motif
  misc_feature (1)..(455): Functional Homolog Of Ceres SEEDLINE ID no. ME19173
MGGSGKWVKSLIGLKKPDREDCKEKLQVPSVNGRGGGKGRKWKLWRSSSGDHGSLWRGSRGGGCCGGHHRSASSDASDDASSAAADPFTAAVATVARAPAKDFMAVRQEWAAIRVQTAFRGFLARRALRALKGLVRLQAIVRGRQVRKQAAVTLRCMQALVRVQARIRARRVRMSTEGQAVQKLLEARRTKLDILREAEEGWCDSQGTLEDVRVKLQKRQEGAIKRERAIAYAYSQQIEGATKCNFWTECVIFLVFAQQQPKPTSYGRLNQSGMLLKHQHFDKSNGNWSWLERWMAARPWENRLMEEHNQTNSSSPDLLSSKNCEDSFGILGDFSEPNSVKVRKNNVSKRVCAKPPVVSHHQRIKAQSISSLSTELHNDESSASSSSCFASTPISFSTFVTTEKTEDSIRARPNYMNMTESIKAKRKACNAQRTTAGKLMEDRKASGVELKVAQV

SEQ ID NO: 3374 - protein, 441 aa, Oryza sativa subsp. japonica
  misc_feature (1)..(441): useful for making plants with increased salt and oxidative stress tolerance as described in USSN 11/858,117
  misc_feature (1)..(441): Public GI ID no.115439499
  misc_feature (1)..(441): Score of 617.2 for HMM of FIGURE 3 of USSN 11/858,117.
  misc_feature (87)..(107): Pfam Name: IQ Pfam Description: IQ calmodulin-binding motif
  misc_feature (1)..(441): Functional Homolog Of Ceres SEEDLINE ID no. ME19173
MGASGKWIRTLVGLRPAAEREKERGGGGGKGRKWSRLWRSSSSQRGGGNASASEVYSETSSSADALSSVVAAVVRAPPRDFRLIRQEWAAVRIQTAFRAFLARRALRALRGIVRLQALVRGRRVRKQLAVTLKCMQALVRVQARARDRRARISADGLDSQDMLDERGGRVDHVKEAEAGWCDSQGTADDVRSKIHMRHEGAIKRERARTYAQSHQRCSNHGGRPSSPAVSLKHHGNGATRSNHSWSYLEGWMATKPWESRLMEQTHTENSTNSRCSESVEEVSVGGPKLSDASSVKIRRNNVTTRVAAKPPSMISATSSDFVCDESSPSTSSVTPLSANNSLATERRSDCGQVGGPSYMSLTKSAKARLSGYGSHKPPLQRQRSGDLLHHNNRMAFSSIDVQSTAGSEVSVTSKRLNSLALKGRATRSLDKENERRPSSLL

SEQ ID NO: 3375 - protein, 416 aa, Arabidopsis thaliana; identical to SEQ ID NO: 3355
  misc_feature (1)..(416): useful for making plants with increased salt and oxidative stress tolerance as described in USSN 11/858,117
  misc_feature (1)..(416): Public GI ID no.15225258
  misc_feature (1)..(416): Score of 954.4 for HMM of FIGURE 3 of USSN 11/858,117.
  misc_feature (84)..(104): Pfam Name: IQ Pfam Description: IQ calmodulin-binding motif
  misc_feature (1)..(416): Functional Homolog Of Ceres SEEDLINE ID no. ME19173

SEQ ID NO: 3376 - protein, 408 aa, Oryza sativa subsp. japonica
  misc_feature (1)..(408): useful for making plants with increased salt and oxidative stress tolerance as described in USSN 11/858,117
  misc_feature (1)..(408): Public GI ID no.115465173
  misc_feature (1)..(408): Score of 554.2 for HMM of FIGURE 3 of USSN 11/858,117.
  misc_feature (79)..(99): Pfam Name: IQ Pfam Description: IQ calmodulin-binding motif
  misc_feature (1)..(408): Functional Homolog Of Ceres SEEDLINE ID no. ME19173
MGASGKWIKSLVSLKAAPEGTTKGRRWTRLWRSSSSASASASTAGDASESASSEADAFSSVVAAVVRAPPRDFRVIRQEWAAVRVQAAFRAFLARRALKALRGIVRLQALVRGRLVRRQLAVTLKCMNALLRVQERARERRARCSADGRDSQDAVGERDGRADPIKQAEEQWCDSQGSVSEVRSKIHMRHDAVAKRERAIAYALSHQPRSSKQSARPSSPARSLRNHESNRCNHDWSYIEGWMATKPWESRLMEQSHAELKCSKNSGELNLAGAQLSNASSVKMRGNRVAAKPPSVLSASSSDFPCDVSSASTSSATPARSDGGHGEGPSYMSLTKSAKARQSCNSPFQIQRQRSGGMSSYKRVALSPLDVQSNACSEFSVTSRKLNSLSLKGRSMTRSLDKENDNLF

SEQ ID NO: 3377 - DNA, 1164 bp, Populus balsamifera subsp. trichocarpa
  misc_feature (1)..(1164): useful for making plants with increased salt and oxidative stress tolerance as described in USSN 11/858,117
  misc_feature (1)..(1164): Ceres ANNOT ID no.1477059
atgggtgcatcaggaaaatgggtgaaatcccttataggttttaaaaagtctgataaagatcaagaccatgtaaatggcaagagcaagaaatggaagctatggaggagctcatctggtgacttggggtcttcatggaaggattttaaagggaaacatagaacagcgtcagaggcatcgggttcttcaccattaactgatccatttactaccgcaatggctactgtggttagagctcctcctaagggttttagggttgtcaggcaagagtgggctgctatcaggattcaaactgctttccgtggattcttggcaagaagggctctgagggctttgaaagcagtggtgagactccaagctatagttcgaggtcgacaagtgagaaagcaggctgctgtgatgctttggtgtatgcaggctcttgttcgagttcaagctcgagtcagggctcatcctgtgcgaatgtccatagaagggcaggcagtgcagaatatgctaaatgagcgacatagcaaggctgatctcttgaaacatgctgaggaagggtggtgcgatggcaaggggacattggaagatgtgaagtcaaaactgcaaatgaggcaagaaggagccttcaagagagaaagagcaattgcatactcccttgctcagaaacaatggagatcaaaccccagctcaaatactcgaaccaatagctcagtatactcattcaagaatcaggagtttgataagaatagctggggatggactaggcctccaattgggcatattactcgctcatcttccagtccaagttctgaattccgctttgatgagagttcagcttcttcatcaatttgtacatctacaacaccaatatcaggaaacactggcttggcctctgataaaacagaggagagtggtaacagtaggccaaattacatgaacctgaccgagtcaaccaaggcaaagcaaaaaacatccggtcatttatctcataggatccaaaggcagtctatggatgagtttcagtttctcaaaaagtcaggagcattctcaaatggagattcgaaaaacagtactggttctgatccgtcagttaatttatctaagccactttgcttgccaacaagatttgataagaactcgacgaaacaactaagaggaatggatcatttgtatgattag

SEQ ID NO: 3378 - protein, 387 aa, Populus balsamifera subsp. trichocarpa
  misc_feature (1)..(387): useful for making plants with increased salt and oxidative stress tolerance as described in USSN 11/858,117
  misc_feature (1)..(387): Ceres ANNOT ID no.1477059
  misc_feature (1)..(387): Score of 765.3 for HMM of FIGURE 3 of USSN 11/858,117.
  misc_feature (89)..(109): Pfam Name: IQ Pfam Description: IQ calmodulin-binding motif
  misc_feature (1)..(387): Functional Homolog Of Ceres SEEDLINE ID no. ME19173
MGASGKWVKSLIGFKKSDKDQDHVNGKSKKWKLWRSSSGDLGSSWKDFKGKHRTASEASGSSPLTDPFTTAMATVVRAPPKGFRVVRQEWAAIRIQTAFRGFLARRALRALKAVVRLQAIVRGRQVRKQAAVMLWCMQALVRVQARVRAHPVRMSIEGQAVQNMLNERHSKADLLKHAEEGWCDGKGTLEDVKSKLQMRQEGAFKRERAIAYSLAQKQWRSNPSSNTRTNSSVYSFKNQEFDKNSWGWTRPPIGHITRSSSSPSSEFRFDESSASSSICTSTTPISGNTGLASDKTEESGNSRPNYMNLTESTKAKQKTSGHLSHRIQRQSMDEFQFLKKSGAFSNGDSKNSTGSDPSVNLSKPLCLPTRFDKNSTKQLRGMDHLYD

SEQ ID NO: 3379 - DNA, 1059 bp, Populus balsamifera subsp. trichocarpa
  misc_feature (1)..(1059): useful for making plants with increased salt and oxidative stress tolerance as described in USSN 11/858,117
  misc_feature (1)..(1059): Ceres ANNOT ID no.1530547
atgggtgcatcaggaaaatgggtgaaatcccttataggttttaaaaagtctgataaagatcaagaccatgtaaatggcaagagcaagaaatggaagctatggaggagctcatctggtgacttggggtcttcatggaaggattttaaagggaaacatagaacagcgtcagaggcatcgggttcttcaccattaactgatccatttactaccgcaatggctactgtggttagagctcctcctaagggttttagggttgtcaggcaagagtgggctgctatcaggattcaaactgctttccgtggattcttggctcttgttcgagttcaagctcgagtcagggctcatcctgtgcgaatgtccatagaagggcaggcagtgcagaatatgctaaatgagcgacatagcaaggctgatctcttgaaacatgctgaggaagggtggtgcgatggcaaggggacattggaagatgtgaagtcaaaactgcaaatgaggcaagaaggagccttcaagagagaaagagcaattgcatactcccttgctcagaaacaatggagatcaaaccccagctcaaatactcgaaccaatagctcagtatactcattcaagaatcaggagtttgataagaatagctggggatggactaggcctccaattgggcatattactcgctcatcttccagtccaagttctgaattccgctttgatgagagttcagcttcttcatcaatttgtacatctacaacaccaatatcaggaaacactggcttggcctctgataaaacagaggagagtggtaacagtaggccaaattacatgaacctgaccgagtcaaccaaggcaaagcaaaaaacatccggtcatttatctcataggatccaaaggcagtctatggatgagtttcagtttctcaaaaagtcaggagcattctcaaatggagattcgaaaaacagtactggttctgatccgtcagttaatttatctaagccactttgcttgccaacaagatttgataagaactcgacgaaacaactaagaggaatggatcatttgtatgattag

SEQ ID NO: 3380 - protein, 352 aa, Populus balsamifera subsp. trichocarpa
  misc_feature (1)..(352): useful for making plants with increased salt and oxidative stress tolerance as described in USSN 11/858,117
  misc_feature (1)..(352): Ceres ANNOT ID no.1530547
  misc_feature (1)..(352): Score of 607.6 for HMM of FIGURE 3 of USSN 11/858,117.
  misc_feature (89)..(109): Pfam Name: IQ Pfam Description: IQ calmodulin-binding motif
  misc_feature (1)..(352): Functional Homolog Of Ceres SEEDLINE ID no. ME19173
MGASGKWVKSLIGFKKSDKDQDHVNGKSKKWKLWRSSSGDLGSSWKDFKGKHRTASEASGSSPLTDPFTTAMATVVRAPPKGFRVVRQEWAAIRIQTAFRGFLALVRVQARVRAHPVRMSIEGQAVQNMLNERHSKADLLKHAEEGWCDGKGTLEDVKSKLQMRQEGAFKRERAIAYSLAQKQWRSNPSSNTRTNSSVYSFKNQEFDKNSWGWTRPPIGHITRSSSSPSSEFRFDESSASSSICTSTTPISGNTGLASDKTEESGNSRPNYMNLTESTKAKQKTSGHLSHRIQRQSMDEFQFLKKSGAFSNGDSKNSTGSDPSVNLSKPLCLPTRFDKNSTKQLRGMDHLYD

SEQ ID NO: 3381 - DNA, 1923 bp, Arabidopsis thaliana
  misc_feature (1)..(1923): useful for making plants with increased salt and oxidative stress tolerance as described in USSN 11/858,117
  misc_feature (1)..(1923): Ceres SEEDLINE ID no.ME24091
  misc_feature (546)..(546): y is t/u or c
  misc_feature (820)..(820): r is g or a
  misc_feature (1011)..(1011): s is g or c
  misc_feature (1391)..(1391): s is g or c
  misc_feature (1412)..(1412): s is g or c
acaaatactcttcttcacacagctttgaatccatctgtcttctcctctctctctcttctccatttgcaattacgataatgtgaaagcaataagaagaggaaaagttatcttcgcacctcagcaaagatccaatcgattcgattcttaagctttttcgtcttctccgataaggtcactacttagaagccgcgttgtggtttagttgactcctccaggttttatcttcaagctttttcgtctatcagatctggtgtcactgtcttctcataggattacatagagatggggaaaaaagctaaatggttttcaagtgttaagaaagcattcagcccagattcaaagaagtcgaagcaaaaattggctgagggacaaaatggtgttatctctaatcctcctgttgtggataatgttagacaatcttcttcttctcctcctcctgctcttgctcctcgtgaagtgagagtagctgaagtgattgttgaacggaacagggatctttcacctccttctacagcagatgctgtgaatgttacagctactgatgtycctgtagttccatcttcatctgctcctggtgttgttcgtcgcgctacacctactcgatttgctggaaagtcaaacgaagaagccgctgctatcttgatccagactatatttagaggttatttggcaaggagagcgttgcgggcaatgaggggtttggtcagacttaagttattgatggaaggatctgttgttaagcggcaagctgcaaatactctaaaatgtatgcagactctctctcgtgtacagtcgcagatccgagctaggagaatcaggrtgtcagaagagaatcaggctcgccagaaacaactccttcagaaacatgctaaagagctagctggcttgaagaacggggataactggaatgatagcattcaatcaaaggagaaagttgaagcgaatttgctaagcaagtacgaggcaacaatgagaagggaaagggcattggcttattcatactctcatcascaaaactggaagaacaactctaaatctggaaacccgatgttcatggatccaagcaacccgacatggggttggagctggttggagagatggatggctggtaggccactagagagttccgagaaagaacaaagcaacagcaacaatgacaatgctgcctcggtcaagggctctattaaccgcaacgaagctgcaaaatctctaacccgcaatggctcaactcaaccaaacacaccatcatccgcaagagggaccccaagaaacaaaaacagtttcttctcacctccaactccctcaaggctaaaccaatcctcgaggaaatccaatgacgacgactccaaaagcacaatctcggtcctgtccgagaggaaccgcagacacascattgctggttcatcagtcasagacgatgagagcctcgctggctcaccagctctcccgagctacatggttccaactaaatcagctcgagccaggctcaagccccaaagcccattaggtggtaccacacaggaaaacgaagggttcacagacaaggcatcagctaagaaacggctctcgtatccaacttcgcctgcattgcctaaaccacggcggttctcagctccccctaaggtggagagtggcggcgttaccgtgaccaacggagcaggcagctgaggtattttatttaatataattattttcccacttatgaatgtgtccgagattgttgtctcttatgtgttcccttcatttcgtaattcatttgtgcagtgtaagcgccagtcatttatttttttactataataaattttataaccttttaaaattcatgttcttttgtttctttgaatatttaagttatttttattaatgttggatgaattggaatatgatgatgttatttgtattgtaatgcagatcctttaaagc

SEQ ID NO: 3382 - protein, 461 aa, Arabidopsis thaliana
  misc_feature (1)..(461): useful for making plants with increased salt and oxidative stress tolerance as described in USSN 11/858,117
  misc_feature (1)..(461): Ceres SEEDLINE ID no.ME24091
  misc_feature (1)..(461): Score of 1104.8 for HMM of FIGURE 4 of USSN 11/858,117.
  misc_feature (115)..(135): Pfam Name: IQ Pfam Description: IQ calmodulin-binding motif
  misc_feature (88)..(88): Xaa is any aa, unknown or other
  misc_feature (180)..(180): Xaa is any aa, unknown or other
  misc_feature (243)..(243): Xaa is any aa, unknown or other
  misc_feature (370)..(370): Xaa is any aa, unknown or other
  misc_feature (377)..(377): Xaa is any aa, unknown or other
MGKKAKWFSSVKKAFSPDSKKSKQKLAEGQNGVISNPPVVDNVRQSSSSPPPALAPREVRVAEVIVERNRDLSPPSTADAVNVTATDXPVVPSSSAPGVVRRATPTRFAGKSNEEAAAILIQTIFRGYLARRALRAMRGLVRLKLLMEGSVVKRQAANTLKCMQTLSRVQSQIRARRIRXSEENQARQKQLLQKHAKELAGLKNGDNWNDSIQSKEKVEANLLSKYEATMRRERALAYSYSHXQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHXIAGSSVXDDESLAGSPALPSYMVPTKSARARLKPQSPLGGTTQENEGFTDKASAKKRLSYPTSPALPKPRRFSAPPKVESGGVTVTNGAGS

SEQ ID NO: 3383 - DNA, 1930 bp, Zea mays
  misc_feature (1)..(1930): useful for making plants with increased salt and oxidative stress tolerance as described in USSN 11/858,117
  misc_feature (1)..(1930): Ceres CLONE ID no.375578
aattcgagtgagcttattggagactgacatcctaatcgaaaacccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagtgcggtgaagaaagtcttcagctcctccgatccagatggaaaggaagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaagaacttgccgccaccaagattcagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactgaggcgagagagagcacttgcatatgcattttctcaccagtggaggaattctggtcgaactataacccctacttttacggaacctgggaaccccaactggggctggagctggatggagcgctggatgacagcaagaccatgggagagtcggttggcggcggcatcggacaaggaccctaaagaacgtgctgtgacaaagaatgcgagcaccagtgctgttcgagtacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttaaatgtactgatatgatagtatttgatttc

SEQ ID NO: 3384 - protein, 311 aa, Zea mays
  misc_feature (1)..(311): useful for making plants with increased salt and oxidative stress tolerance as described in USSN 11/858,117
  misc_feature (1)..(311): Ceres CLONE ID no.375578
  misc_feature (1)..(311): Score of 653.4 for HMM of FIGURE 4 of USSN 11/858,117.
  misc_feature (1)..(311): Functional Homolog Of Ceres SEEDLINE ID no. ME24091
MTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 3385 - DNA, 1930 bp, Zea mays
  misc_feature (1)..(1930): useful for making plants with increased salt and oxidative stress tolerance as described in USSN 11/858,117
  misc_feature (1)..(1930): Ceres CLONE ID no.375578
aattcgagtgagcttattggagactgacatcctaatcgaaaacccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagtgcggtgaagaaagtcttcagctcctccgatccagatggaaaggaagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaataacttgccgccaccaagattcagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactgaggcgagagagagcacttgcatatgcattttctcaccagtggaggaattctggtcgaactataacccctacttttacggaacctgggaaccccaactggggctggagctggatggagcgctggatgacagcaagaccatgggagagtcggttggcggcggcatcggacaaggaccctaaagaacgtgctgtgacaaagaatgcgagcaccagtgctgttcgagtacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttaaatgtactgatatgatagtatttgatttc

SEQ ID NO: 3386 - protein, 498 aa, Zea mays
  misc_feature (1)..(498): useful for making plants with increased salt and oxidative stress tolerance as described in USSN 11/858,117
  misc_feature (1)..(498): Ceres CLONE ID no.375578
  misc_feature (1)..(498): Score of 1275.4 for HMM of FIGURE 4 of USSN 11/858,117.
  misc_feature (137)..(157): Pfam Name: IQ Pfam Description: IQ calmodulin-binding motif
  misc_feature (1)..(498): Functional Homolog Of Ceres SEEDLINE ID no. ME24091
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSREELAATKIQTAFRGYLARRALRALRGLVRLKSLVDGNAVKRQTAHTLQCTQAMTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 3387 - protein, 217 aa, Arabidopsis thaliana
  misc_feature (1)..(217): useful for making plants with increased salt and oxidative stress tolerance as described in USSN 11/858,117
  misc_feature (1)..(217): Ceres SEEDLINE ID no.ME10681
  misc_feature (1)..(217): Score of 322.9 for HMM of FIGURE 4 of USSN 11/858,117.
  misc_feature (1)..(217): Functional Homolog Of Ceres SEEDLINE ID no. ME24091
MGKKGKWFGAVKKVFSPESKEKKEESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 3388 - protein, 311 aa, Arabidopsis thaliana; identical to SEQ ID NO: 3384
  misc_feature (1)..(311): useful for making plants with increased salt and oxidative stress tolerance as described in USSN 11/858,117
  misc_feature (1)..(311): Ceres SEEDLINE ID no.ME03140
  misc_feature (1)..(311): Score of 653.4 for HMM of FIGURE 4 of USSN 11/858,117.
  misc_feature (1)..(311): Functional Homolog Of Ceres SEEDLINE ID no. ME24091

SEQ ID NO: 3389 - protein, 421 aa, Arabidopsis thaliana
  misc_feature (1)..(421): useful for making plants with increased salt and oxidative stress tolerance as described in USSN 11/858,117
  misc_feature (1)..(421): Ceres SEEDLINE ID no.ME24076
  misc_feature (60)..(80): Pfam Name: IQ Pfam Description: IQ calmodulin-binding motif
  misc_feature (1)..(421): Score of 908.3 for HMM of FIGURE 4 of USSN 11/858,117.
  misc_feature (1)..(421): Functional Homolog Of Ceres SEEDLINE ID no. ME24091
LEVNLSVPPPPAPPPVLHQAEEVGVPEAEQEQSKHVAVEEAPAAAPAQASVLPPAVPTQELAAVKIQTAFRGYLARRALRALRGLVRLKSLVEGNSVKRQSASTLRCMQTLSRVQSQISSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 3390 - protein, 311 aa, Oryza sativa subsp. japonica; identical to SEQ ID NO: 3384
  misc_feature (1)..(311): useful for making plants with increased salt and oxidative stress tolerance as described in USSN 11/858,117
  misc_feature (1)..(311): Ceres SEEDLINE ID no.ME24217
  misc_feature (1)..(311): Score of 653.4 for HMM of FIGURE 4 of USSN 11/858,117.
  misc_feature (1)..(311): Functional Homolog Of Ceres SEEDLINE ID no. ME24091

SEQ ID NO: 3391 - protein, 500 aa, Oryza sativa subsp. japonica
  misc_feature (1)..(500): useful for making plants with increased salt and oxidative stress tolerance as described in USSN 11/858,117
  misc_feature (1)..(500): Public GI ID no.115440873
  misc_feature (1)..(500): Score of 1281.0 for HMM of FIGURE 4 of USSN 11/858,117.
  misc_feature (142)..(162): Pfam Name: IQ Pfam Description: IQ calmodulin-binding motif
  misc_feature (1)..(500): Functional Homolog Of Ceres SEEDLINE ID no. ME24091
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQVETSLMMKQEAALRRERALAYAFSHQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 3392 - DNA, 1695 bp, Triticum aestivum
  misc_feature (1)..(1695): useful for making plants with increased salt and oxidative stress tolerance as described in USSN 11/858,117
  misc_feature (1)..(1695): Ceres CLONE ID no.826796
ataggacttcacagacagactgactcaatcctaacccaatccctcccatgcttccatctactctagcagaaattgcagaggaggttggccgccgccggctccagcgcaggcgcagcctacccgcgggatctgacgccctccgcctcctacctcgaggcacgcgcctcaggctcagctcccccgcccgccctcccccgctaccccgacgacttccaagaggaggagcatgaaattgagcatgtcgccgccgcgccagcgccagcgccagccacggatgcgccgctacctgcccctcctgccgccgcaccaccacaggttcaggctgccattgcgccggcttcttcctcttgtgtcatgtccagggagctcgccgccaccaagatccagaccgccttccgaggtcacctggcaagaagggcgctgcgggcattgaaaggcctggtcagactcaagtcgctggtccaaggccactccgtcaagcgccaggccaccagcacgcttcgctgcatgcagactctgtcccgggtccagtccaagatacggacgaggaggatcaagatggccgaggagaaccaggcccttcagcgccagctcttgttgaaccaggaactagagactctcaggatgggagatcagtggaataccagcctgcagtccaaggagcaaatcgaggcgagcctcgtgagcaggcaagaggccgcggctagaagagaacgggctctcgcatacgcattctcccaccagtggaagagcacctcaaggtctgccaacccgatgttcgtggacccgagtaacccgcactggggctggagctggctggagcggtggatggcgtcgaggccgttcgacggccgcaacggggcgtccgagaaggagggcagcagcgtcgaccgcacgtcggtgcacagcaccagcctgagcatgaacctcggagaaggtgagacggtcacaaaggcggacaaccaggtggtggactctttgaagccgaatgatgataagccgccgccgctttcgactccgaagccgtccggccctgcccccaggcagtccccgtcgacgccctcgccggcgctggcgaggaagaagagcgcgacgcccaagagtggagactgcgacggcgacgacgcgaggagcgtggtcagcactgtccggtccgagcggccccggaggcacagcatcggcgcgtccagcgtgcgtgacgacgcgggctcttccccgtcggtgccgagctacatggcggccaccaagtcggcgtcggccagggccaagtcgcgtgtgcagagcccgacgctgaccgagggtgctgctcaagctgagacgctggagaaaggatggtcttctgtgggttcagcgaagaagcggctgtcctttccggctgggacgccaccgccggtgccggcggcggcggcgaggcggcactccgggcctcccaaggtgcggcaggcgggcgtggaaggtggtacggaggaacgggactcgtcccttgcgtgacatcatgggaagcagattatggtgtggagcagagcagagcggaatttgttgcatttgttgagtgaaaggaacgcagaatgtgtgttgtgtggatccattggatttgatttgatttgtatgatggcagtattcctatttgattattcattgaataatataagtatctgtaatgaagataaaaggaggggacacgaacattatttc

SEQ ID NO: 3393 - protein, 378 aa, Triticum aestivum
  misc_feature (1)..(378): useful for making plants with increased salt and oxidative stress tolerance as described in USSN 11/858,117
  misc_feature (1)..(378): Ceres CLONE ID no.826796
  misc_feature (1)..(378): Score of 903.8 for HMM of FIGURE 4 of USSN 11/858,117.
  misc_feature (4)..(24): Pfam Name: IQ Pfam Description: IQ calmodulin-binding motif
  misc_feature (1)..(378): Functional Homolog Of Ceres SEEDLINE ID no. ME24091
MSRELAATKIQTAFRGHLARRALRALKGLVRLKSLVQGHSVKRQATSTLRCMQTLSRVQSKIRTRRIKMAEENQALQRQLLLNQELETLRMGDQWNTSLQSKEQIEASLVSRQEAAARRERALAYAFSHQWKSTSRSANPMFVDPSNPHWGWSWLERWMASRPFDGRNGASEKEGSSVDRTSVHSTSLSMNLGEGETVTKADNQVVDSLKPNDDKPPPLSTPKPSGPAPRQSPSTPSPALARKKSATPKSGDCDGDDARSVVSTVRSERPRRHSIGASSVRDDAGSSPSVPSYMAATKSASARAKSRVQSPTLTEGAAQAETLEKGWSSVGSAKKRLSFPAGTPPPVPAAAARRHSGPPKVRQAGVEGGTEERDSSLA

SEQ ID NO: 3394 - DNA, 1470 bp, Populus balsamifera subsp. trichocarpa
  misc_feature (1)..(1470): useful for making plants with increased salt and oxidative stress tolerance as described in USSN 11/858,117
  misc_feature (1)..(1470): Ceres ANNOT ID no.1465047
atggggaaaagagggagttggttctctgctttgaagaaagccctcggttcctctaagaaatccaaatcaaagaagaaatggtcagaaaaagagaagaaccgggatctaggtgtttcttcacatgaagaaaccgttgcaccctctctttctcctcctcgtacaccacctcctcctacagcagaagatgtgaaattaactgaagctgagaacgagcagagcaagcatgcttattccgtggcgcttgccactgctgtggcagctgaggcagctgttgcagccgcccaggctgccgctgaggttgttcggcttactacagtggcacattactctggaaaatcgaaggaggaaatagctgcaatcaggattcaaacagcatttagaggatacctggcgaggagggcattacgtgctttgagagggctggtgagattgaagtcattgatacaagggcaatctgtcaaacggcaagcaactgccacattacgagccatgcagactcttgctcgtgtgcagtctcagattcgtgcaagaaggatcagaatgtccgaggaaaatgaggccctccaacggcagctccagcagaaacatgacaaagaacttgagaagttgagaacttctattggagaacaatgggatgatagcccacaatcaaaggaagaagttgaagccagcctactacaaaagcaagaagctgccatgagaagagaaagggcactggcttatgcatactcgcatcagcaaatgtggaagcaatcttcaaaatcagcaaatgctacattcatggatccaaacaatcctcgttggggatggagttggttagagaggtggatggcagcccgaccttgggagagccgaagcacaatagataacaatgatcgggcctctgttaagagtacaacaagccgtaccatgtctcttggagaaatcagcagagcttattctcgtcgtgatcttaaccatgacaataaagcttctcctggtgcgcaaaaatcaagtcggcctcccagtcggcaatcaccttctactcccccctctaaggcaccatctacatcttcagtaacagggaaagcaaagccaccaagccctagagggagtgcttggggaggagacgaggactccaggagcacattcagtgtccagtctgagcgctatcggagacatagcatagcagggtcatcaataagagatgatgagagtcttgcaagttcgccttcagttccaagttacatggcacccacacggtcacagtcagcaaaggcaaaatcccgcttgtcaagcccgttaggcatagataataatgggacaccagataaggcatcagtgggttatgtaaagaagcggctttccttctctgcttcaccagctggagcaaggagacactctggtcctcctagggtggatgccagtgctgttaaagacattcaaatgcacagagaagagaaaatgagcaatggagcaagcagcaagtag

SEQ ID NO: 3395 - protein, 326 aa, Populus balsamifera subsp. trichocarpa
  misc_feature (1)..(326): useful for making plants with increased salt and oxidative stress tolerance as described in USSN 11/858,117
  misc_feature (1)..(326): Ceres ANNOT ID no.1465047
  misc_feature (1)..(326): Score of 746.5 for HMM of FIGURE 4 of USSN 11/858,117.
  misc_feature (1)..(326): Functional Homolog Of Ceres SEEDLINE ID no. ME24091
MQTLARVQSQIRARRIRMSEENEALQRQLQQKHDKELEKLRTSIGEQWDDSPQSKEEVEASLLQKQEAAMRRERALAYAYSHQQMWKQSSKSANATFMDPNNPRWGWSWLERWMAARPWESRSTIDNNDRASVKSTTSRTMSLGEISRAYSRRDLNHDNKASPGAQKSSRPPSRQSPSTPPSKAPSTSSVTGKAKPPSPRGSAWGGDEDSRSTFSVQSERYRRHSIAGSSIRDDESLASSPSVPSYMAPTRSQSAKAKSRLSSPLGIDNNGTPDKASVGYVKKRLSFSASPAGARRHSGPPRVDASAVKDIQMHREEKMSNGASSK

SEQ ID NO: 3396 - DNA, 1901 bp, Gossypium hirsutum
  misc_feature (1)..(1901): useful for making plants with increased salt and oxidative stress tolerance as described in USSN 11/858,117
  misc_feature (1)..(1901): Ceres CLONE ID no.1919901
aacttttcttagttatcctctgcaaatgccaacctgttcttttattattattttccgccatttttgctctctttcaagcattttttttttgcctagatccacttctctctctttgatttttaattactgcatttttgttttaatacacaataagaacaactaagagatagaatgtgacttatcaatcttttaactgagatctgtgagaatttttctatgtaccaaggaattatttacagatgggaaaaaaaggtggctggctttctattgtgaagaaagctttgagccctgaatccaagaaatctcagcaccaaactccaaagccaaagaaaaaatggttcggaaaaagcaaaaatttgagccctgtgtctgtgcctgaagaaactgaagtgataactgaagatgcaaagctaaaagaagctgaaaacgaacaaagcaaacatgcctactctgtggctcttgccaccgctgtggcggccgaggcagcggtggcagctgctcaggcggctgctgaagttgtccgtctcacttctcagccgcgccatctggggaagtcaaaggaggaaatagctgctatcaggattcaaacagcatttcgtggatatttggctaggagggcactgcgagctttgagagggttggtaaggttgaaatcgttgatcagagggcaatccgtcaaacgccaagcaactacaacgttaagatgcatgcagactctagctcgtctgcagtctgagatttctgcaaggaggattagaatgtcagaagagaaccaggctcttcagcgccagcttcaacagaaatgccagaaagagctcgagaagttgagagctcccatgagagaagactggaacgatagtacacagtcgaaggagcagatcgaagcaagacaacaaaataagcaaggagctactatgaaaagggaaagagcattggcttatgcatactgtcaccagcgatcgtggaagaactgttctagatcagtgaatcaaacatttatggatccgagtaattcacactggggttggagttggttagagcgatggatggcagcccgaccatgggaagtccaaagcacaactgataacaatgaccgtggctcagtcaagagtatgggtgcttgttcgatatctataagtgaaatcagcagagcttattctcgaagagatcttaacaatgataacaaaccatctccaacacctcagaagtcaagtcgagttcctagccgccagtctccatcgactccaccttcaaaggcaccttcgatttcatcggtttctggtaaaacaagactgccaagtccgagaggaagtcaatggggagggtatgaagactcaaggagcatactcagtacccggtctgatcgttataggagacatagcattgcagggtcctcaatgagagacgatgagagccttacaagctcacctgcagttccaagttatatggcaccaacacagtccacaaaggccaggtcccacataccaagccccttaggaagtggcacaccagataggagagtggcagggtctgcaaagaaacggcttttgttcccagcatccccagccagtagtaggagacattcagagcctcctaaagtggacataagtgaggctagaaagaatcagcatgcaccaagcaatggaaggcaagtggcttggtgaagagtgcaacaaaagttagattgaataaacatggaagggttatttcaacttgaagttcttgtagtgtggttgtgattatctttttcttcctaggttttatgattattaattataaaagggttacttttttctgggtgagatttagtttattgtttgtggttgacaaacattcttaaaaatcttcaagtttagtttcaattcatgaaatttgtaattaaaaaaaaaaaaaaaaaaaaa

SEQ ID NO: 3397 - protein, 474 aa, Gossypium hirsutum
  misc_feature (1)..(474): useful for making plants with increased salt and oxidative stress tolerance as described in USSN 11/858,117
  misc_feature (1)..(474): Ceres CLONE ID no.1919901
  misc_feature (1)..(474): Score of 1214.2 for HMM of FIGURE 4 of USSN 11/858,117.
  misc_feature (109)..(129): Pfam Name: IQ Pfam Description: IQ calmodulin-binding motif
  misc_feature (1)..(474): Functional Homolog Of Ceres SEEDLINE ID no. ME24091
MGKKGGWLSIVKKALSPESKKSQHQTPKPKKKWFGKSKNLSPVSVPEETEVITEDAKLKEAENEQSKHAYSVALATAVAAEAAVAAAQAAAEVVRLTSQPRHLGKSKEEIAAIRIQTAFRGYLARRALRALRGLVRLKSLIRGQSVKRQATTTLRCMQTLARLQSEISARRIRMSEENQALQRQLQQKCQKELEKLRAPMREDWNDSTQSKEQIEARQQNKQGATMKRERALAYAYCHQRSWKNCSRSVNQTFMDPSNSHWGWSWLERWMAARPWEVQSTTDNNDRGSVKSMGACSISISEISRAYSRRDLNNDNKPSPTPQKSSRVPSRQSPSTPPSKAPSISSVSGKTRLPSPRGSQWGGYEDSRSILSTRSDRYRRHSIAGSSMRDDESLTSSPAVPSYMAPTQSTKARSHIPSPLGSGTPDRRVAGSAKKRLLFPASPASSRRHSEPPKVDISEARKNQHAPSNGRQVAW

SEQ ID NO: 3398 - DNA, 1362 bp, Glycine max
  misc_feature (1)..(1362): useful for making plants with increased salt and oxidative stress tolerance as described in USSN 11/858,117
  misc_feature (1)..(1362): Ceres CLONE ID no.520008
atgcattcactcatcaggtttttttaaaaaaaaaaaattctcatcaatttacacatgcgagaaaatgggtgaaaaatttaatacgaactgaaaaatctttcaaaaatatcgcatattataaacactaaaatgagaaatcaagcatccttattatactatatggatatactcttcactgtttctttatctcttgaatctgttatactttccaactgagacttaggcctgattcctgataagtgcacgagtcctttcctatcttgtcactatcttcagagccatatcctctgcactctcctttctcactgccacgatgatcttttgcataatccaatgatatgctaatgctttgttaagtaagttgcagcgtaaattcttcctcaattttgtcaatggaagtattttgttactgaaataaagtggcatgctatattatgtaacatattttgaatgaatagcattctgcctatgatatgattttcaatcataagtgtaagttccttgatgctgtcaacaaattcagtgtttgatatttgggggcaaaaaatatttggcagcaaaactggaagaactcgtctagatctgtaaatccaatgtttatggatccaactaatccgagctggggttggagctggttggaacgatggatggcagcccgaccttgggagagccgtagccatatggataaagagttgaatgaccactcctccataagaagctcaagccgcagcattaccggtggagaaatcagcaagtcatttgctcgtttccagctcaattcggaaaagcactctccaacagccagccagaatcctggctcccctagctttcagtccactccttccaagccagcttcatcatctgctaagaaaccaaagaaggtaagtccaagcccaaggggcagctgggttatggacgaggactccaaaagcttggtcagtgtacactctgaccggttccggaggcactccattgccggttcatcggtgagagatgacgagagccttgctagctctccagcagttccaagctacatggtgccaactcaatctgcaaaagccaagtccaggacacaaagtccattagcctcagaaaatgcaaaagcagagaaaggttcctttgggagtgcaaagaagcggctttctttcccagcttcacctgccaggccaaggcgccattcaggtccaccaaaggttgaaagcagcagcttaaatgcagagttagctgtggacaagggtgtggacagttgatcatacaagtaaaaggatggaaaagcattaaagtaggattgaaaatatatcactgaagaaataaaacaaaaagagtttatttaaaaaaaaaaaaaaaaaaaaaaaaaaaaaa

SEQ ID NO: 3399 - protein, 218 aa, Glycine max
  misc_feature (1)..(218): useful for making plants with increased salt and oxidative stress tolerance as described in USSN 11/858,117
  misc_feature (1)..(218): Ceres CLONE ID no.520008
  misc_feature (1)..(218): Score of 156.2 for HMM of FIGURE 4 of USSN 11/858,117.
  misc_feature (1)..(218): Functional Homolog Of Ceres SEEDLINE ID no. ME24091
MFMDPTNPSWGWSWLERWMAARPWESRSHMDKELNDHSSIRSSSRSITGGEISKSFARFQLNSEKHSPTASQNPGSPSFQSTPSKPASSSAKKPKKVSPSPRGSWVMDEDSKSLVSVHSDRFRRHSIAGSSVRDDESLASSPAVPSYMVPTQSAKAKSRTQSPLASENAKAEKGSFGSAKKRLSFPASPARPRRHSGPPKVESSSLNAELAVDKGVDS

SEQ ID NO: 3400 - protein, 445 aa, Arabidopsis thaliana
  misc_feature (1)..(445): useful for making plants with increased salt and oxidative stress tolerance as described in USSN 11/858,117
  misc_feature (1)..(445): Public GI ID no.7413581
  misc_feature (1)..(445): Score of 1020.8 for HMM of FIGURE 4 of USSN 11/858,117.
  misc_feature (114)..(134): Pfam Name: IQ Pfam Description: IQ calmodulin-binding motif
  misc_feature (1)..(445): Functional Homolog Of Ceres SEEDLINE ID no. ME24091
MGKKAKWFSSVKKAFSPDSKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWVPRKNKSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 3401 - DNA, 1806 bp, Zea mays
  misc_feature (1)..(1806): useful for making plants with increased salt and oxidative stress tolerance as described in USSN 11/858,117
  misc_feature (1)..(1806): Ceres CLONE ID no.228069
gagccgcggaggagcagcggcgcatcgcaacactaaccaaagtcctcctctccaggtgccgagccagggtgactgttccgaggagcgtggcgtggacccatggggaagaagggcaagtggttcggtgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctccggctcctcctccagttcctcgccagaccgacgaggtcagggtccccgaagccgagcaggagcagagcaagcatgtcaccctggaggaggcccctgctgctgctgctgccccagcacaggcgtcggtgctgccacctggtgcgccaaccgaagagctcgccgcaatcaagatccagaccgccttccgaggttacctggcaaggagggcactaagagcactacgaggccttgtacgattgaagtcattggttgagggtaattcagttaagcgtcaatctgcaagcactctgcgctgtatgcaaactctatcgcgggtgcagtcacaaatacgatctaggagagcaaagatgtccgaggagaaccaggccctccaacgccagctcctacttaaacaggaactggagaatttcagaatgggtgagaactgggacgacagcactcaatccaaggagcaaatcgaggcaagcctaataagcaggcaagaggcagcgataagaagagaaagagctcttgcatatgcattttcacatcagtggaagagcacatcaagatctgcgaacccaatgtttgtagacccaaataacttgcagtggggctggagctggttggagcgctggatggcagcaaaaccttgggagggacgcaatgggaccgacaaggagagcaacattgatcgcggctccgtcaagaatatgagcttgaaccttggagttggagagggtgagatcacaaaagctttcaaccgccgggactcaaagccagagaagccatcaccaccgactccaaaaccggcccgtccagcttccaggcaatccccttcgacgccctctgctagagtggccccaatacctgcgaggaggaaatccagcacgccaaagaatgggctttcacaggtggacgatgacgtgaggagcgtgctcagtgtgcagtctgagcgaccaaggaggcacagcatagccacgacgtcgaccatgcgggacgatgagagcctcgcgagctccccgtcgctcccgagctacatggttcccacagaatctgcgagggccaaatctcgcacagcaacggccaatggcgcagagacgcctgagaaaggaggctctgctggaccagtcaagaagaggttgtctttccaaggtggagctgcggctgcctcaccgatgcgacggcattctggccctcccaaggtggagagcgctgtgaaggacattgctgcgccaccacagcctgaggccttggtagccaatggtggtggaagcaagtgacttgtattgacaagttccaggatgggggagcgggttatggtcttatggagggacatgtttcatccgtgaacagaagttaagagtggtgccggatctacgaatggtttgaattgttttcccgttacaaccacattgtttgctgtataagattcactgtacctgccagttggttccatttgttgttttctgtaaaacaaacatcaatttgtcactagaatctgtgatgcttgtatgtaaacaggtcctctatttatgtgagccatatatttcattttc

SEQ ID NO: 3402 - protein, 476 aa, Zea mays
  misc_feature (1)..(476): useful for making plants with increased salt and oxidative stress tolerance as described in USSN 11/858,117
  misc_feature (1)..(476): Ceres CLONE ID no.228069
  misc_feature (1)..(476): Score of 953.8 for HMM of FIGURE 4 of USSN 11/858,117.
  misc_feature (108)..(128): Pfam Name: IQ Pfam Description: IQ calmodulin-binding motif
  misc_feature (1)..(476): Functional Homolog Of Ceres SEEDLINE ID no. ME24091
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQASVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 3403 - DNA, 1703 bp, Glycine max
  misc_feature (1)..(1703): useful for making plants with increased salt and oxidative stress tolerance as described in USSN 11/858,117
  misc_feature (1)..(1703): Ceres CLONE ID no.467508
aaaccatcctctcttagcatttggcaagatctgatttccctcttcacaaggagagaaatagaaaggcatatgatcttcttcaagttgcaatctttttagagagagagggttagaagaacaacatacttgagatctgtcactttgtttgagttcagatcttcaaagtttccttccttgttcttttggtgcaaaggatcaaattaaggaatgccaaatggggaggaaggggaattggttttccagtgtgatgaaagctctcagtcctgactcaaaggagaagaaagaacagaaatcaagtaaatctaagaagaaatggtttgggaagcaaaaattggagacttcagtctcatactcagaagctcataaagcaccaccaccaccgcgacctattcctccaccagaagcgattaaattaactgatattgaaaatgaaatcagtcatgatcacgactatgttgttgaagttgcaactgccatggatgccgaggaacctgttccttctgttcagatagaacctgttagggttgaagctgccccaattgctcattatgctggtaaaccaaaggatgaagtggcagctatcaaaattcaaacagcttttcgtggatacttggcaagaagagcattgcgggctttaagggggctggtcaggttgaaattattgatggaagggccagttgttaaacgccaagccacaagtaccctccactctatgcagacattatctcgcttgcagtctcagattcgttcaaggaggatcagaatgttagaggagaatcaggctctgcagagacagctcttacagaagcatgcaagagagcttgagagcttgcggatgggagaggaatgggatgacagcctacaatcaaaagaacaaatcgaagccaagttacttagcaagtatgaagctactacgagaagagaaagagcgctggcttatgcattcactcatcagcaaaattggaagaactcatctagatctgtaaatccaatgttcatggatccaaccaatccaagctggggttggagctggttggaacgatggatggcagcccgaccttgggagagccgtagccatatggataaagagttgaatgaccactcatccgtaagaagctcaagccgcagtattaccggtggagaaatcagcaagtcatttgctcgtttccagctcaatttggaaaagcactctccaacagcctgccagaatcctggctcacctagctttcagtccactccttccaagccagcttcaatatctgctaagaaaccaaagaaggtaagtccaagcccaaggggcagctgggttacagacgaggactccaaaagcttggtcagtgtacagtcagaccggttccggaggcactccattgccggttcattggtgagagatgatgagagccttgctagctctccagcagttccaagctacatggtgccaactcaatctgcaaaagccaagtccaggacacaaagtccattagccccagaaaatggaaaagcagagaaaggttcctttgggagtgcgaagaagcggctttctttcccagcttcacctgccaggccaaggcgccattcaggtccaccaaaggtagaaagcagcagcttaaatgcagagttagctgtggacaagggtgtggacagttgatcatacaagtaaaaggatggaaaaacattaaagtaggattgaaaatatatcactg

SEQ ID NO: 3404 - protein, 477 aa, Glycine max
  misc_feature (1)..(477): useful for making plants with increased salt and oxidative stress tolerance as described in USSN 11/858,117
  misc_feature (1)..(477): Ceres CLONE ID no.467508
  misc_feature (1)..(477): Score of 852.8 for HMM of FIGURE 4 of USSN 11/858,117.
  misc_feature (119)..(139): Pfam Name: IQ Pfam Description: IQ calmodulin-binding motif
  misc_feature (1)..(477): Functional Homolog Of Ceres SEEDLINE ID no. ME24091
MGRKGNWFSSVMKALSPDSKEKKEQKSSKSKKKWFGKQKLETSVSYSEAHKAPPPPRPIPPPEAIKLTDIENEISHDHDYVVEVATAMDAEEPVPSVQIEPVRVEAAPIAHYAGKPKDEVAAIKIQTAFRGYLARRALRALRGLVRLKLLMEGPVVKRQATSTLHSMQTLSRLQSQIRSRRIRMLEENQALQRQLLQKHARELESLRMGEEWDDSLQSKEQIEAKLLSKYEATTRRERALAYAFTHQQNWKNSSRSVNPMFMDPTNPSWGWSWLERWMAARPWESRSHMDKELNDHSSVRSSSRSITGGEISKSFARFQLNLEKHSPTACQNPGSPSFQSTPSKPASISAKKPKKVSPSPRGSWVTDEDSKSLVSVQSDRFRRHSIAGSLVRDDESLASSPAVPSYMVPTQSAKAKSRTQSPLAPENGKAEKGSFGSAKKRLSFPASPARPRRHSGPPKVESSSLNAELAVDKGVDS

SEQ ID NO: 3405 - DNA, 1495 bp, Gossypium hirsutum
  misc_feature (1)..(1495): useful for making plants with increased salt and oxidative stress tolerance as described in USSN 11/858,117
  misc_feature (1)..(1495): Ceres CLONE ID no.1829581
attattttcaatgcaatttaagagttttatttattttatgttataaattttttaacctctaaatatgatttgaaatgttaattccattggttgtttttggttttgaaggagaatttattgaggaatgggcaaaaaaggaagctggtttactgctgtgaagaaagttctaagccttgaacccaacaaagaagagaagattcaaaaatccaagaaaaatggggttaaattacctgagaagatcaaaggaagcaaacgtgacaactggttcgctccggccaccaccatggtgaccggcgcgttggttcgccttactttgtcgccacactacttgggaaaatcaatggaggaaatagctactgttaagattcaaactgtgtttcgaggatacctggcgaggaaggcattgcgagatttgagagggttagagaggttgaaatcattgatacaagggcaatccatgaaacgacaagccactattacgttacgatgcatgcggacacttgctcgagtgcagtcccaaactcgaacaaggcaactcagagtgtctgaacaaaaccgagcacttcaaaagcatcttcaaactaaatacgaaaaacagttgcaaaattccaaatcttacatgggagaagattggaatgtaagtactaagtctaaagagcaaatgcaagcaaaacaacaatatagacaagtagcagccatgcgaagggagagagctttagcttactcatttactcatcagcgatcctggaaggtcacttgtagatcgatgaatcacacatctatggatccatttaatcctaaatggagctggagttggttagagcgatggatgtcaactcgaccatgggagattcaaaatgcaccggataacaatgatcatggcccaagtaagagtgttggtgctgagataaccaaagctaagtctcaaagtgatgttaacaatgatcacaataaacaatcttcaacaccggcaaaaccgattcgacctccgaaccgtaggtcctcttcgactccaccgtctaaaacgcattctatttctagcaagaagggattggaaagccccagtccgacacgaattcagttgcctgattgttacaagaggcatagcatcggaggcttatcattggagagagacgatgaggtctttgcaaactcaccacctaataataaaataccggcacgttcgtcatcaaaggaccggtctcgaccaccgagcattaatagaaatccagttaatactaggagacattctggtcctccgaaagttgatattttttccaactaaggaagaaatgccaaacaatgacaaaggcaggtagtttatgaagcatagacactttagtcgcgagtgccggccacatgtttaatattgaaatggctccgacacaatcaaatgtgtgttggttatatgacgatatattttttcaaaaaatcaaatactatcagaaaaaaatataaagaaagattaattggataaaaaaaaaaaaaaaaaaaa

SEQ ID NO: 3406 - protein, 386 aa, Gossypium hirsutum
  misc_feature (1)..(386): useful for making plants with increased salt and oxidative stress tolerance as described in USSN 11/858,117
  misc_feature (1)..(386): Ceres CLONE ID no.1829581
  misc_feature (1)..(386): Score of 365.8 for HMM of FIGURE 4 of USSN 11/858,117.
  misc_feature (75)..(95): Pfam Name: IQ Pfam Description: IQ calmodulin-binding motif
  misc_feature (1)..(386): Functional Homolog Of Ceres SEEDLINE ID no. ME24091
MGKKGSWFTAVKKVLSLEPNKEEKIQKSKKNGVKLPEKIKGSKRDNWFAPATTMVTGALVRLTLSPHYLGKSMEEIATVKIQTVFRGYLARKALRDLRGLERLKSLIQGQSMKRQATITLRCMRTLARVQSQTRTRQLRVSEQNRALQKHLQTKYEKQLQNSKSYMGEDWNVSTKSKEQMQAKQQYRQVAAMRRERALAYSFTHQRSWKVTCRSMNHTSMDPFNPKWSWSWLERWMSTRPWEIQNAPDNNDHGPSKSVGAEITKAKSQSDVNNDHNKQSSTPAKPIRPPNRRSSSTPPSKTHSISSKKGLESPSPTRIQLPDCYKRHSIGGLSLERDDEVFANSPPNNKIPARSSSKDRSRPPSINRNPVNTRRHSGPPKVDIFSN

SEQ ID NO: 3407 - DNA, 1543 bp, Zea mays
  misc_feature (1)..(1543): useful for making plants with increased salt and oxidative stress tolerance as described in USSN 11/858,117
  misc_feature (1)..(1543): Ceres CLONE ID no.229668
cttggaagtcaatctttcggtgccaccgcctccagctcctcccccagttcttcaccaggccgaggaggttggggtccctgaagccgagcaggagcagagcaagcatgtcgccgtggaggaggcccctgctgccgccccagcgcaggcgtcggtgctgccacctgctgtgccaacccaagagctcgccgcagtcaagatccagaccgccttccgaggttacctggcaaggagggcactacgagcactgcgaggccttgttcgattgaagtcattggttgagggtaattcagtaaagcgtcaatctgcaagcactctgcgctgcatgcaaactctatcacgggtgcagtcacagatatcttccaggagagcaaagatgtccgaggagaaccaggctctccaacgccagctcctacttaaacaggaactggagaatttcagaatgggtgagaactgggatgacagcacccaatccaaggagcaaatcgaggcaagcctgataagcaggcaagaggcggcgataagaagagaaagagcgcttgcatatgcattttcacaccagtggaagagtacatcgagatctgtcaacccaatgtttgtagacccaaacaacctgcagtggggctggagctggctggagcgctggatggcagcaaaaccatgggaaggccgcaatggggctgacaaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatctgtcacgcccaagaacgggctttcacaggtggacgatgacgcgaggagcgtgctcagtgtgcagtctgagcggccaaggaggcacagtatagccacctcgactgtgcgggacgacgagagcctcacgagctccccgtcgctcccaagctacatggttcccacagaatctgcaagggccaaatctcgcctccagggttcagcaatggccaatggcgcagagacacctgagaaaggaggctcaactggaccagccaagaagaggttatccttccagggtggaactgcggctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacagatcctctatttatgtgagacatatatttcttttctttc

SEQ ID NO: 3408 - protein, 421 aa, Zea mays; identical to SEQ ID NO: 3389
  misc_feature (1)..(421): useful for making plants with increased salt and oxidative stress tolerance as described in USSN 11/858,117
  misc_feature (1)..(421): Ceres CLONE ID no.229668
  misc_feature (1)..(421): Score of 908.3 for HMM of FIGURE 4 of USSN 11/858,117.
  misc_feature (60)..(80): Pfam Name: IQ Pfam Description: IQ calmodulin-binding motif
  misc_feature (1)..(421): Functional Homolog Of Ceres SEEDLINE ID no. ME24091

SEQ ID NO: 3409 - protein, 500 aa, Oryza sativa subsp. indica
  misc_feature (1)..(500): useful for making plants with increased salt and oxidative stress tolerance as described in USSN 11/858,117
  misc_feature (1)..(500): Public GI ID no.125550655
  misc_feature (1)..(500): Score of 911.0 for HMM of FIGURE 4 of USSN 11/858,117.
  misc_feature (107)..(121): Pfam Name: IQ Pfam Description: IQ calmodulin-binding motif
  misc_feature (1)..(500): Functional Homolog Of Ceres SEEDLINE ID no. ME24091
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQAAIKIQTAFRGYLLSENSSWLFISSAAFIYHCVGANITKARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMVPPSPMRRHSGPPKVEVVKDIAEPPQPEALVINGGSK

SEQ ID NO: 3410 - DNA, 1923 bp, Arabidopsis thaliana; identical to SEQ ID NO: 3381
  misc_feature (1)..(1923): useful for making plants with increased salt and oxidative stress tolerance as described in USSN 11/858,117
  misc_feature (1)..(1923): Ceres CLONE ID no.106263
  misc_feature (546)..(546): y is t/u or c
  misc_feature (820)..(820): r is g or a
  misc_feature (1011)..(1011): s is g or c
  misc_feature (1391)..(1391): s is g or c
  misc_feature (1412)..(1412): s is g or c

SEQ ID NO: 3411 - protein, 461 aa, Arabidopsis thaliana; identical to SEQ ID NO: 3382
  misc_feature (1)..(461): useful for making plants with increased salt and oxidative stress tolerance as described in USSN 11/858,117
  misc_feature (1)..(461): Ceres CLONE ID no.106263
  misc_feature (1)..(461): Score of 1104.8 for HMM of FIGURE 4 of USSN 11/858,117.
  misc_feature (115)..(135): Pfam Name: IQ Pfam Description: IQ calmodulin-binding motif
  misc_feature (1)..(461): Functional Homolog Of Ceres SEEDLINE ID no. ME24091
  misc_feature (88)..(88): Xaa is any aa, unknown or other
  misc_feature (180)..(180): Xaa is any aa, unknown or other
  misc_feature (243)..(243): Xaa is any aa, unknown or other
  misc_feature (370)..(370): Xaa is any aa, unknown or other
  misc_feature (377)..(377): Xaa is any aa, unknown or other

SEQ ID NO: 3412 - protein, 430 aa, Arabidopsis thaliana
  misc_feature (1)..(430): useful for making plants with increased salt and oxidative stress tolerance as described in USSN 11/858,117
  misc_feature (1)..(430): Public GI ID no.15231175
  misc_feature (1)..(430): Score of 592.8 for HMM of FIGURE 4 of USSN 11/858,117.
  misc_feature (108)..(128): Pfam Name: IQ Pfam Description: IQ calmodulin-binding motif
  misc_feature (1)..(430): Functional Homolog Of Ceres SEEDLINE ID no. ME24091
MGKSWFSAVKKALSPEPKQKKEQKPHKSKKWFGKSKKLDVTNSGAAYSPRTVKDAKLKEIEEQQSRHAYSVAIATAAAAEAAVAAAQAAAEVVRLSALSRFPGKSMEEIAAIKIQTAFRGYMARRALRALRGLVRLKSLVQGKCVRRQATSTLQSMQTLARVQYQIRERRLRLSEDKQALTRQLQQKHNKDFDKTGENWNDSTLSREKVEANMLNKQVATMRREKALAYAFSHQNTWKNSTKMGSQTFMDPNNPHWGWSWLERWMAARPNENHSLTPDNAEKDSSARSVASRAMSEMIPRGKNLSPRGKTPNSRRGSSPRVRQVPSEDSNSIVSFQSEQPCNRRHSTCGSIPSTRDDESFTSSFSQSVPGYMAPTQAAKARARFSNLSPLSSEKTAKKRLSFSGSPKTVRRFSGPPKLESNVTKKDTNLA

SEQ ID NO: 3413 - protein, 461 aa, Arabidopsis thaliana
  misc_feature (1)..(461): useful for making plants with increased salt and oxidative stress tolerance as described in USSN 11/858,117
  misc_feature (1)..(461): Public GI ID no.145357576
  misc_feature (1)..(461): Score of 1118.9 for HMM of FIGURE 4 of USSN 11/858,117.
  misc_feature (115)..(135): Pfam Name: IQ Pfam Description: IQ calmodulin-binding motif
  misc_feature (1)..(461): Functional Homolog Of Ceres SEEDLINE ID no. ME24091
MGKKAKWFSSVKKAFSPDSKKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 3414 - protein, 474 aa, Oryza sativa subsp. indica
  misc_feature (1)..(474): useful for making plants with increased salt and oxidative stress tolerance as described in USSN 11/858,117
  misc_feature (1)..(474): Public GI ID no.125528277
  misc_feature (1)..(474): Score of 1169.9 for HMM of FIGURE 4 of USSN 11/858,117.
  misc_feature (142)..(162): Pfam Name: IQ Pfam Description: IQ calmodulin-binding motif
  misc_feature (1)..(474): Functional Homolog Of Ceres SEEDLINE ID no. ME24091
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 3415 - DNA, 666 bp, Zea mays
  misc_feature (1)..(666): useful for making plants with increased salt and oxidative stress resistance as described in USSN 12/922,143
  misc_feature (1)..(666): Ceres CLONE ID no.210210
  misc_feature (1)..(666): Inplanta Sequence
ggtacctagaacatcctaatcgaaaaatcattagtagattccacaacgtatatcttagatagtttaattttgataatgggtccaagatatatcaccctatgcatcttcctagtacttgtcttacatggagatacaactttggcagaaacttgcaggcagtttgttaaatgggatccattctgctttagtgcgatgtgcaaggcaagttgttttatagagggaaaatcctccgatggttcctatgtaaaggggcacagatgtgaatcaaatggatatcacgctgtgtgtgtttgttttctgtgtaaaaattaggtatctaatgacatgcggatctatcttcttttgttcctctctgtcatctaggagtgtttgtctaaataattatatggtaaaatagttaactagtatgtttactattagagttatgtagcactagttaactagtcgttatttcttcaatttcttatatctagaaacatgtttttagttgtcaagcacttcaataatatatgtttgttttcctttattataaatttaaagagagtcgttgttagctttttgtctatagtcttgtttactcaagagttatatatatttgtaatgtgtcgataaatagtataattctacaggtacaatcacaagttcgttgctaaaaaaaaaaaaaaa

SEQ ID NO: 3416 - protein, 78 aa, Zea mays
  misc_feature (1)..(78): useful for making plants with increased salt and oxidative stress resistance as described in USSN 12/922,143
  misc_feature (1)..(78): Ceres CLONE ID no.210210
  misc_feature (1)..(78): Bit score of 223.3 for HMM based on sequences of FIGURE 1 of USSN 12/922,143.
MGPRYITLCIFLVLVLHGDTTLAETCRQFVKWDPFCFSAMCKASCFIEGKSSDGSYVKGHRCESNGYHAVCVCFLCKN

SEQ ID NO: 3417 - DNA, 500 bp, Zea mays
  misc_feature (1)..(500): useful for making plants with increased salt and oxidative stress resistance as described in USSN 12/922,143
  misc_feature (1)..(500): Ceres CLONE ID no.218758
atcattactccactccacattcgacaaaatatatcttagacaagttaagtttaacgataatggattcaagatatgttaccctatgcattttcttagtacttgccttacatggagatactactttggcagaaacttgcaggcagtatgttgaagggcagccattttgctttaaagcaatgtgcaaggcaaattgttttatggagggaaaattctctgatggttcttatgtaaagggttacagatgtgaatcaggtggattccactcggtgtgtgtttgccttttgtgcaaaaattagttatctaaagacaagcggatatatcttcttatgttcctatccattatttaggattatagtccaaataattatacaatagcttagttaaatagttttttatttatagacaaatgtagcactagttaactagttgtgattttttaaatttctcagctataaatcaggaaatattttttaacacttcaataatatatctttgttcgc

SEQ ID NO: 3418 - protein, 78 aa, Zea mays
  misc_feature (1)..(78): useful for making plants with increased salt and oxidative stress resistance as described in USSN 12/922,143
  misc_feature (1)..(78): Ceres CLONE ID no.218758
  misc_feature (1)..(78): Bit score of 186.3 for HMM based on sequences of FIGURE 1 of USSN 12/922,143.
  misc_feature (1)..(78): Functional Homolog Of Ceres CLONE ID no. 210210
MDSRYVTLCIFLVLALHGDTTLAETCRQYVEGQPFCFKAMCKANCFMEGKFSDGSYVKGYRCESGGFHSVCVCLLCKN

SEQ ID NO: 3419 - DNA, 524 bp, Zea mays
  misc_feature (1)..(524): useful for making plants with increased salt and oxidative stress resistance as described in USSN 12/922,143
  misc_feature (1)..(524): Ceres CLONE ID no.447215
atcttacaacggtagctgcattgcatgcttgatcactcgcctcgctcgttgcatcttagataatttaattttgataatggattcaagatatatcaccctatgcatctttcttgtacttgtcttacatggagatacaactttggcagaaacctgcaagcagtttcctaaatggagtccactctgctttagcgcaatttgcaaggcaagttgttttatagagggaaagttctccgatggttactatgtaaaggggcatagatgttgttcaactggatatgaatacgtgtgtaattgtcttttgtgtaaaaattagttatctagtgacatgtgggactatctccttttgttcctatctgtcatctaggagtgctatctaaataattattcggtaaaatagttaactagtatgtttactgttagagttatgtagcactagttaactagtcattatttcgtcaatttcttatatctagaaacatggttttacttgccaagcatttcaataatatatgtttgttttccac

SEQ ID NO: 3420 - protein, 78 aa, Zea mays
  misc_feature (1)..(78): useful for making plants with increased salt and oxidative stress resistance as described in USSN 12/922,143
  misc_feature (1)..(78): Ceres CLONE ID no.447215
  misc_feature (1)..(78): Bit score of 170.1 for HMM based on sequences of FIGURE 1 of USSN 12/922,143.
  misc_feature (1)..(78): Functional Homolog Of Ceres CLONE ID no. 210210
MDSRYITLCIFLVLVLHGDTTLAETCKQFPKWSPLCFSAICKASCFIEGKFSDGYYVKGHRCCSTGYEYVCNCLLCKN

SEQ ID NO: 3421 - protein, 81 aa, Oryza sativa subsp. japonica
  misc_feature (1)..(81): useful for making plants with increased salt and oxidative stress resistance as described in USSN 12/922,143
  misc_feature (1)..(81): Public GI ID no.56202240
  misc_feature (1)..(81): Bit score of 214.6 for HMM based on sequences of FIGURE 1 of USSN 12/922,143.
  misc_feature (1)..(81): Functional Homolog Of Ceres CLONE ID no. 210210
MGERKAGICLVLVLLLSTLAQHAYAEQWCWYEVSVSPICAGFTCKFDCWFFAKVNKAKVQSHKCLGKGYKIKCLCQLCKNV

SEQ ID NO: 3422 - DNA, 237 bp, Sorghum bicolor
  misc_feature (1)..(237): useful for making plants with increased salt and oxidative stress resistance as described in USSN 12/922,143
  misc_feature (1)..(237): Ceres ANNOT ID no.6044037
atggaggcgaaatatgttgttctatgcttcctcgtagtgcttgtcttacatggagatcctacttttgctgaaacttgcaggcaatttgttaaagtgcacccattctgctttaaggcttactgcaaggcaaattgttatttggagggaaaattctccgatggttcctatgcaaaggaatatcattgcttaggagatccaattcactccctatgcatttgcactttgtgcaaaaattag

SEQ ID NO: 3423 - protein, 78 aa, Sorghum bicolor
  misc_feature (1)..(78): useful for making plants with increased salt and oxidative stress resistance as described in USSN 12/922,143
  misc_feature (1)..(78): Ceres ANNOT ID no.6044037
  misc_feature (1)..(78): Bit score of 214.9 for HMM based on sequences of FIGURE 1 of USSN 12/922,143.
  misc_feature (1)..(78): Functional Homolog Of Ceres CLONE ID no. 210210
MEAKYVVLCFLVVLVLHGDPTFAETCRQFVKVHPFCFKAYCKANCYLEGKFSDGSYAKEYHCLGDPIHSLCICTLCKN

SEQ ID NO: 3424 - DNA, 959 bp, Arabidopsis thaliana
  misc_feature (1)..(959): useful for making plants with increased salt and oxidative stress resistance as described in USSN 12/922,143
  misc_feature (1)..(959): Ceres CLONE ID no.22538
  misc_feature (1)..(959): Inplanta Sequence
gtggattgatgtgatatctccactgacgtaagggatgacgcacaatcccactatccttcgcaagacccttcctctatataaggaagttcatttcatttggagagaacacgggggactctggcctgcagggccatcaccactgcagtggtacctagaacatcctaatcgaaaactcttccaatttcgtttcgacatatttcgcgattcgtctaaggttttgttactgattgagaaaacatgggaggtgacaatgataatgacaaagacaaagggtttcatgggtatcctcccgctggatacccaccccctggggcttatccacccgctggatacccacaacaaggttaccctccaccacccggtgcttacccgcctgcaggttatcctccgggtgcctacccacctgcacctggtggttatcctccagcccctggttatggtggttatcctccagctcctggttatggaggttatcctcctgcacctggtcatggtggttaccctcctgctggctatcctgctcatcactcaggacacgcaggaggaattgggggtatgattgcaggtgctgcagctgcctatggagctcaccacgtagctcatagctctcacggtccttacggacatgctgcatatggtcacggttttggccatggtcatggctatggctatggtcatggtcatggtaagttcaagcatgggaagcacgggaagttcaagcatgggaagcatggaatgtttggaggaggcaagttcaagaagtggaagtgatctagttaataccttttgtgaatctgtctggactgaccaatgtttcaaataagccctaaacattatataagttgactttcgtcggttagattgctggttcgagttggaataattgaaacttaattagtatcaaatcttattgtatactttaaagctatcgttggctttataatgatagattctggttt

SEQ ID NO: 3425 - protein, 177 aa, Arabidopsis thaliana
  misc_feature (1)..(177): useful for making plants with increased salt and oxidative stress resistance as described in USSN 12/922,143
  misc_feature (1)..(177): Ceres CLONE ID no.22538
  misc_feature (1)..(177): Bit score of 264.4 for HMM based on sequences of FIGURE 2 of USSN 12/922,143.
  misc_feature (15)..(19): Pfam Name: XYPPX Pfam Description: XYPPX repeat
  misc_feature (60)..(64): Pfam Name: XYPPX Pfam Description: XYPPX repeat
  misc_feature (69)..(73): Pfam Name: XYPPX Pfam Description: XYPPX repeat
  misc_feature (78)..(82): Pfam Name: XYPPX Pfam Description: XYPPX repeat
  misc_feature (87)..(91): Pfam Name: XYPPX Pfam Description: XYPPX repeat
MGGDNDNDKDKGFHGYPPAGYPPPGAYPPAGYPQQGYPPPPGAYPPAGYPPGAYPPAPGGYPPAPGYGGYPPAPGYGGYPPAPGHGGYPPAGYPAHHSGHAGGIGGMIAGAAAAYGAHHVAHSSHGPYGHAAYGHGFGHGHGYGYGHGHGKFKHGKHGKFKHGKHGMFGGGKFKKWK

SEQ ID NO: 3426 - DNA, 901 bp, Gossypium hirsutum
  misc_feature (1)..(901): useful for making plants with increased salt and oxidative stress resistance as described in USSN 12/922,143
  misc_feature (1)..(901): Ceres CLONE ID no.1918442
atcttcatctttttcctataaatattgggtagaacaattatgataggtaactcatcctcaaacatcccccgcccctaaaaaatctcactcatataatttaaattcgaagaatctgctacaccaaaggtaaatcacaaaacccatttctcttccttacatcttttctttccttttcaacaattgcatcttttgctttcgatcccaaattctgggtttcctcttctgtccatcagtcaattcatactagttactcgaattcgttaattttaagtcgaagaaaaatgggaggtggtagggaaggcgaatcaagtgacaaagggctgttttctcatcttgctggctatgccgccggacattatcctccgcctggatcctaccctccacaaggatatcctcctcaaggatatcccccacaaggatacccaccggctggatatcctccaccagcgggatatcctccacatggcggatacccacctgcagggtatcctcctcatggaggataccctcatccacctcatggtggatatccaccagctggttatcctggacacggttcgcatggacctgggatgggaggattattagccggtgctggggctgcggctgctgctctttacggggctcaccatttgtcacatggagctcatcatcttgcacatgggggatactatggccatggtcacggaaaatttaaacatgggaaatttaagcacgggaaatttgggaagcggtggaagcatggcatgtttggtaaacataaggccaagttctttggcaggaagtggaagtaaatagtcccgtctcccatgtcccatacgaatcttatcatactagtatgctcttttaacagttactgacatggttgccctctaataaacatggatttgtttcgcttgtt

SEQ ID NO: 3427 - protein, 170 aa, Gossypium hirsutum
  misc_feature (1)..(170): useful for making plants with increased salt and oxidative stress resistance as described in USSN 12/922,143
  misc_feature (1)..(170): Ceres CLONE ID no.1918442
  misc_feature (1)..(170): Bit score of 257.6 for HMM based on sequences of FIGURE 2 of USSN 12/922,143.
  misc_feature (36)..(40): Pfam Name: XYPPX Pfam Description: XYPPX repeat
  misc_feature (41)..(45): Pfam Name: XYPPX Pfam Description: XYPPX repeat
  misc_feature (51)..(55): Pfam Name: XYPPX Pfam Description: XYPPX repeat
  misc_feature (63)..(67): Pfam Name: XYPPX Pfam Description: XYPPX repeat
  misc_feature (82)..(86): Pfam Name: XYPPX Pfam Description: XYPPX repeat
  misc_feature (1)..(170): Functional Homolog Of Ceres CLONE ID no. 22538
MGGGREGESSDKGLFSHLAGYAAGHYPPPGSYPPQGYPPQGYPPQGYPPAGYPPPAGYPPHGGYPPAGYPPHGGYPHPPHGGYPPAGYPGHGSHGPGMGGLLAGAGAAAAALYGAHHLSHGAHHLAHGGYYGHGHGKFKHGKFKHGKFGKRWKHGMFGKHKAKFFGRKWK

SEQ ID NO: 3428 - DNA, 579 bp, Populus balsamifera subsp. trichocarpa
  misc_feature (1)..(579): useful for making plants with increased salt and oxidative stress resistance as described in USSN 12/922,143
  misc_feature (1)..(579): Ceres ANNOT ID no.1469916
atgggaggtggcaaggacaagtctgacaaagagtctacagacaagggactgttttcaaatcttgctggctatgctggtggacattaccctccaagcgcaccataccctccacatggttatccacaacagggatacccaccagcaggttaccccccccctggcggctacccaccttcgggctaccctcccccaggaggatacccaccagcaggttaccctcctcctggcggttaccctccccctggcggttacccaccccctggcggctaccctcctcctggtgcttaccctccagctggttaccctggcccatctgcttcacattattcagggcatggacctggaatggggacaatgttagctggaggtgctgctgctgctgcagttgcttacggggcccaccagatgtcccatggaggttcccatggctatggtcacggaggttaccatggctatggtcatggaaagtttaagcatggctatggtcatggaaagtttaagcatggcaagtttggcaagcgctggaagcatggcggatttggaaagcacaagggcaaattcttcaagagatggaagtga

SEQ ID NO: 3429 - protein, 192 aa, Populus balsamifera subsp. trichocarpa
  misc_feature (1)..(192): useful for making plants with increased salt and oxidative stress resistance as described in USSN 12/922,143
  misc_feature (1)..(192): Ceres ANNOT ID no.1469916
  misc_feature (1)..(192): Bit score of 287.4 for HMM based on sequences of FIGURE 2 of USSN 12/922,143.
  misc_feature (44)..(48): Pfam Name: XYPPX Pfam Description: XYPPX repeat
  misc_feature (49)..(53): Pfam Name: XYPPX Pfam Description: XYPPX repeat
  misc_feature (60)..(64): Pfam Name: XYPPX Pfam Description: XYPPX repeat
  misc_feature (71)..(75): Pfam Name: XYPPX Pfam Description: XYPPX repeat
  misc_feature (89)..(93): Pfam Name: XYPPX Pfam Description: XYPPX repeat
  misc_feature (1)..(192): Functional Homolog Of Ceres CLONE ID no. 22538
MGGGKDKSDKESTDKGLFSNLAGYAGGHYPPSAPYPPHGYPQQGYPPAGYPPPGGYPPSGYPPPGGYPPAGYPPPGGYPPPGGYPPPGGYPPPGAYPPAGYPGPSASHYSGHGPGMGTMLAGGAAAAAVAYGAHQMSHGGSHGYGHGGYHGYGHGKFKHGYGHGKFKHGKFGKRWKHGGFGKHKGKFFKRWK

SEQ ID NO: 3430 - DNA, 923 bp, Brassica napus
  misc_feature (1)..(923): useful for making plants with increased salt and oxidative stress resistance as described in USSN 12/922,143
  misc_feature (1)..(923): Ceres CLONE ID no.872124
  misc_feature (559)..(559): w is a or t/u
  misc_feature (920)..(920): y is t/u or c
attatttacgaggaataaatgtccaattaggaatcatactcaaagtacgaggaccataagatcaaaatatattttattttggaaaccgtgccgcttaaggaaataaatctatggcttaagcaaacccccatcaatacatatctccaaatatcttctgttttgttttctgttccaatccagtttcgacattgtttcgcgattcgtctcgggttttgttttgttgattgagagaaaacatgggaggtgaggaagacaaagagaaagggttttttgggtacccacccgctggatacccgccgggtcctggggcttatccaccagctggatacccaccacaacaagcttaccctcccccaccacctggtgcctacccacctcaacctggttatcctccgggtgcatacccacctccacctggtgcctaccctcctgctcctggttatggtggttatcctcctgcgcctggtcatgctggttatcctcctgctggatatcctcctcatcactcaggacacgcagctggaatcgggggtatgattgcaggtgctgcagctgcctwcggagctcaccacatagctcatagctctcacggtccttacggacacgcagcatatggtcacggatttggacatggtcatggctatggctatggttatggtcatggtaagttcaagcacgggaagttcaagcatcacggaggcaagtttaaacatgggaggcatgggatgtttggaggaggtaagttcaagaagtggaagtgatctaaaaacctcttttaatcttatctctcgccggttcaagtttgacaattgaggctttaataatgattatgatatcacatgttgtactatgaagctattatatatggttttatgatattactgattctgtttttaatataatttcatatattatgcccytgt

SEQ ID NO: 3431 - protein, 174 aa, Brassica napus
  misc_feature (1)..(174): useful for making plants with increased salt and oxidative stress resistance as described in USSN 12/922,143
  misc_feature (1)..(174): Ceres CLONE ID no.872124
  misc_feature (1)..(174): Bit score of 267.3 for HMM based on sequences of FIGURE 2 of USSN 12/922,143.
  misc_feature (18)..(22): Pfam Name: XYPPX Pfam Description: XYPPX repeat
  misc_feature (30)..(34): Pfam Name: XYPPX Pfam Description: XYPPX repeat
  misc_feature (36)..(40): Pfam Name: XYPPX Pfam Description: XYPPX repeat
  misc_feature (50)..(54): Pfam Name: XYPPX Pfam Description: XYPPX repeat
  misc_feature (55)..(59): Pfam Name: XYPPX Pfam Description: XYPPX repeat
  misc_feature (1)..(174): Functional Homolog Of Ceres CLONE ID no. 22538
  misc_feature (108)..(108): Xaa is any aa, unknown or other
MGGEEDKEKGFFGYPPAGYPPGPGAYPPAGYPPQQAYPPPPPGAYPPQPGYPPGAYPPPPGAYPPAPGYGGYPPAPGHAGYPPAGYPPHHSGHAAGIGGMIAGAAAAXGAHHIAHSSHGPYGHAAYGHGFGHGHGYGYGYGHGKFKHGKFKHHGGKFKHGRHGMFGGGKFKKWK

SEQ ID NO: 3432 - DNA, 717 bp, Brassica napus
  misc_feature (1)..(717): useful for making plants with increased salt and oxidative stress resistance as described in USSN 12/922,143
  misc_feature (1)..(717): Ceres CLONE ID no.1076554
agtttcgacattgtttcgcgattcgtctcgggttttgttttgttgattgagagaaaacatgggaggtgaggaagacaaagagaaagggttttttgggtacccacccgctggatacccgccgggtcctggggcttatccaccagctggatacccaccacaacaagcttaccctcccccaccacctggtgcctacccacctcaacctggttatcctccgggtgcatacccacctccacctggtgcctaccctcctgctcctggttatggtggttatcctcctgcgcctggtcatgctggttatcctcctgctggatatcctcctcatcactcaggacacgcagctggaatcgggggtatgattgcaggtgctgcagctgcctacggagctcaccacatagctcatagctctcacggtccttacggacacgcagcatatggtcacggatttggacatggtcatggctatggctatggttatggtcatggtaagttcaagcacgggaagttcaagcatcacggaggcaagtttaaacatgggaggcatgggatgtttggaggaggtaagttcaagaagtggaagtgatctaaaaacctcttttaatcttatctctcgccggttcaagtttgacaattgaggctttaataatgattatgatatcacatgttgtactatgaagctattatatatggttttatgatattactgattctgttttt

SEQ ID NO: 3433 - protein, 174 aa, Brassica napus
  misc_feature (1)..(174): useful for making plants with increased salt and oxidative stress resistance as described in USSN 12/922,143
  misc_feature (1)..(174): Ceres CLONE ID no.1076554
  misc_feature (1)..(174): Bit score of 269.6 for HMM based on sequences of FIGURE 2 of USSN 12/922,143.
  misc_feature (18)..(22): Pfam Name: XYPPX Pfam Description: XYPPX repeat
  misc_feature (30)..(34): Pfam Name: XYPPX Pfam Description: XYPPX repeat
  misc_feature (36)..(40): Pfam Name: XYPPX Pfam Description: XYPPX repeat
  misc_feature (50)..(54): Pfam Name: XYPPX Pfam Description: XYPPX repeat
  misc_feature (55)..(59): Pfam Name: XYPPX Pfam Description: XYPPX repeat
  misc_feature (1)..(174): Functional Homolog Of Ceres CLONE ID no. 22538
MGGEEDKEKGFFGYPPAGYPPGPGAYPPAGYPPQQAYPPPPPGAYPPQPGYPPGAYPPPPGAYPPAPGYGGYPPAPGHAGYPPAGYPPHHSGHAAGIGGMIAGAAAAYGAHHIAHSSHGPYGHAAYGHGFGHGHGYGYGYGHGKFKHGKFKHHGGKFKHGRHGMFGGGKFKKWK

SEQ ID NO: 3434 - DNA, 755 bp, Zea mays
  misc_feature (1)..(755): useful for making plants with increased salt and oxidative stress resistance as described in USSN 12/922,143
  misc_feature (1)..(755): Ceres CLONE ID no.1362309
gttccaatccagtttcgacattgtttcgcgattcgtctcgggttttgttttgttgattgagagaaaacatgggaggtgaggaagacaaagagaaagggttttttgggtacccacccgctggatacccgccgggtcctggggcttatccaccagctggatacccaccacaacaagcttaccctcccccaccacctggtgcctacccacctcaacctggttatcctccgggtgcatacccacctccacctggtgcctaccctcctgctcctggttatggtggttatcctcctgcgcctggtcatgctggttatcctcctgctggatatcctcctcatcactcaggacacgcagctggaatcgggggtatgattgcaggtgctgcagctgcctacggagctcaccacatagctcatagctctcacggtccttacggacacgcagcatatggtcacggatttggacatggtcatggctatggctatggttatggtcatggtaagttcaagcacgggaagttcaagcatcacggaggcaagtttaaacatgggaggcatgggatgtttggaggaggtaagttcaagaagtggaagtgatctaaaaacctcttttaatcttatctctcgccggttcaagtttgacaattgaggctttaataatgattatgatatcacatgttgtactatgaagctattatatatggttttatgatattactgattctgtttttaatataatttcatatattatgcccttgt

SEQ ID NO: 3435 - protein, 174 aa, Zea mays; identical to SEQ ID NO: 3433
  misc_feature (1)..(174): useful for making plants with increased salt and oxidative stress resistance as described in USSN 12/922,143
  misc_feature (1)..(174): Ceres CLONE ID no.1362309
  misc_feature (1)..(174): Bit score of 269.6 for HMM based on sequences of FIGURE 2 of USSN 12/922,143.
  misc_feature (18)..(22): Pfam Name: XYPPX Pfam Description: XYPPX repeat
  misc_feature (30)..(34): Pfam Name: XYPPX Pfam Description: XYPPX repeat
  misc_feature (36)..(40): Pfam Name: XYPPX Pfam Description: XYPPX repeat
  misc_feature (50)..(54): Pfam Name: XYPPX Pfam Description: XYPPX repeat
  misc_feature (55)..(59): Pfam Name: XYPPX Pfam Description: XYPPX repeat
  misc_feature (1)..(174): Functional Homolog Of Ceres CLONE ID no. 22538

SEQ ID NO: 3436 - DNA, 988 bp, Panicum virgatum
  misc_feature (1)..(988): useful for making plants with increased salt and oxidative stress resistance as described in USSN 12/922,143
  misc_feature (1)..(988): Ceres CLONE ID no.1725271
agaccccgcgcagcgcaggcggcacgcgtttccttgccgaatcctgcgagtacctagcctctccgccgcgttgcgtcctcgggtatatagccggggaaggaggcgccgccaaaccatcacgcgtcgcccacagaaacatcgctgagatcgggtacttggtttgctgatcgccggagttctcgtcgtcgttcggtagcttggggtaacaatgggaggcggcaaggacaaacatgacgagggtgacaaggggctcttctcaaacataatgcatggtgctgccggtggccatgggtacccgcatcagggataccctcctcaaggctacccaccaccacctggggcgtacccgcctccccctggggcatatcctcctccaccaggggcttaccccccagcacccggggcatacccgccacagcatgggtaccctcaaccgggcgggtaccctcaaccaggtggttacccgccacatggtggctacccccctgctggttatcccggctcatctcaccagggtcatggaagcagccattctggcatggggatggggacggttctagctggaggcgccgccgccgctgcagctgcttatgtagcacacaagctctctcatgggcatagcggacacggtggacacggggtctttggaggctatggccacggtgggcacggctacggcggtcacggcaagttcaagcatggtcacggccaccacggcaagttcaagcacggccacggaaaattcaagcatggcaagcatgggcacggcatgttcggcggcaagttcaagaagtggaagtgatgtgcacccaatgggttgatcatactaagcccctatgcaggcttccagaaattctgttgtcgggaatgcctttgcgatttatttagcagggtgatcgttcatcctttctatatgttcgggtattctagcctgtgtgcgagtgacaagatggtttgctaataagtaactgaataaccttgtggattc

SEQ ID NO: 3437 - protein, 197 aa, Panicum virgatum
  misc_feature (1)..(197): useful for making plants with increased salt and oxidative stress resistance as described in USSN 12/922,143
  misc_feature (1)..(197): Ceres CLONE ID no.1725271
  misc_feature (1)..(197): Bit score of 308.0 for HMM based on sequences of FIGURE 2 of USSN 12/922,143.
  misc_feature (33)..(37): Pfam Name: XYPPX Pfam Description: XYPPX repeat
  misc_feature (38)..(42): Pfam Name: XYPPX Pfam Description: XYPPX repeat
  misc_feature (45)..(49): Pfam Name: XYPPX Pfam Description: XYPPX repeat
  misc_feature (52)..(56): Pfam Name: XYPPX Pfam Description: XYPPX repeat
  misc_feature (66)..(70): Pfam Name: XYPPX Pfam Description: XYPPX repeat
  misc_feature (1)..(197): Functional Homolog Of Ceres CLONE ID no. 22538
MGGGKDKHDEGDKGLFSNIMHGAAGGHGYPHQGYPPQGYPPPPGAYPPPPGAYPPPPGAYPPAPGAYPPQHGYPQPGGYPQPGGYPPHGGYPPAGYPGSSHQGHGSSHSGMGMGTVLAGGAAAAAAAYVAHKLSHGHSGHGGHGVFGGYGHGGHGYGGHGKFKHGHGHHGKFKHGHGKFKHGKHGHGMFGGKFKKWK

SEQ ID NO: 3438 - DNA, 756 bp, Panicum virgatum
  misc_feature (1)..(756): useful for making plants with increased salt and oxidative stress resistance as described in USSN 12/922,143
  misc_feature (1)..(756): Ceres CLONE ID no.1721485
ccgagatcggggacttggttggctgatcgccggagttctcgtcggcgggcggcaggttggggtaacaatgggaggcggcaaggacaagcatgacgagggtgacaaggggctcttctcaaacataatgcatggtgttgccggtggccatgggtacccgcatcagggataccctccgcaaggctacccaccaccacctggggcgtacccgcctccccctggggcatatcctcctccaccaggggcttaccccccagcacccggggcatacccgccacagcatgggtaccctcaaccgggtgggtaccctcaaccaggtggttacccgccacatggtggctacccccctgctggttatcccggctcatctcaccagggtcatggaagcagccattctggcatggggatggggacggttctagctggaggcgccgccgccgctgcagctgcttatggagcacacaagctctctcatgggcatagcggacacggtggacatggggtctttggaggctatggccacggtgggcacggctacggcggtcacggcaagttcaaacatggtcacggccaccacggcaagttcaagcacggccacggaaaattcaagcatggcaagcatgggcaccgcatgttcggcggcaagttcaagaagtggaagtgatgtgcacccaatggcttgatcatactaagcccctatgcacgcttccagaaattctgttgtccggaatgcctttgcgatgtatttagcagggggat

SEQ ID NO: 3439 - protein, 197 aa, Panicum virgatum
  misc_feature (1)..(197): useful for making plants with increased salt and oxidative stress resistance as described in USSN 12/922,143
  misc_feature (1)..(197): Ceres CLONE ID no.1721485
  misc_feature (1)..(197): Bit score of 304.9 for HMM based on sequences of FIGURE 2 of USSN 12/922,143.
  misc_feature (33)..(37): Pfam Name: XYPPX Pfam Description: XYPPX repeat
  misc_feature (38)..(42): Pfam Name: XYPPX Pfam Description: XYPPX repeat
  misc_feature (45)..(49): Pfam Name: XYPPX Pfam Description: XYPPX repeat
  misc_feature (52)..(56): Pfam Name: XYPPX Pfam Description: XYPPX repeat
  misc_feature (66)..(70): Pfam Name: XYPPX Pfam Description: XYPPX repeat
  misc_feature (1)..(197): Functional Homolog Of Ceres CLONE ID no. 22538
  misc_feature (123)..(123): Xaa is any aa, unknown or other
  misc_feature (138)..(138): Xaa is any aa, unknown or other
  misc_feature (139)..(139): Xaa is any aa, unknown or other
  misc_feature (140)..(140): Xaa is any aa, unknown or other
MGGGKDKHDEGDKGLFSNIMHGVAGGHGYPHQGYPPQGYPPPPGAYPPPPGAYPPPPGAYPPAPGAYPPQHGYPQPGGYPQPGGYPPHGGYPPAGYPGSSHQGHGSSHSGMGMGTVLAGGAAXAAAAYGAHKLSHGHXXXGGHGVFGGYGHGGHGYGGHGKFKHGHGHHGKFKHGHGKFKHGKHGHGMFGGKFKKWK

SEQ ID NO: 3440 - DNA, 883 bp, Panicum virgatum
  misc_feature (1)..(883): useful for making plants with increased salt and oxidative stress resistance as described in USSN 12/922,143
  misc_feature (1)..(883): Ceres CLONE ID no.1795080
gaaccatcacgcgtcgcccacagaaacatcgcctgagatcggctacttggtttgctgatcgccggagttctcgtcgtcgttcggtagcttgggggaacaatgggaggcggcaaggacaagcatgacgagggtgacaaggggctcttctcaaacataatgcatggtgttgccggtggccaagggtacccgcatcagggataccctccgcaaggctacccgccaccacctggggcgtacccgcctccccctggggcgtatccttctccactaggggcttatcccccggcacccggggcatacccaccacagcatgggtaccctcaaccgggtgggtaccctcaaccgggtgggtaccctcaaccaggtggttaccctccacatggtggttatccccctgctggttatcccggctcatctcaccagggtcatggtagcagccatggtggcatggggatggggacggttctagctggaggcgccgccgccgctgcagctgcgtatggagcacacaagctctctcatgggcatagcggacaaggtggacatggggtcattggaggctatggccacggttacagccatggctacggcggtcacggcaagttcaagcatggtcacggccaccacggcaagttcaagcacggccatggcaaattcaagcatggcaagcatgggcacggcatgttcggcggcaagttcaagaagtggaagtgatgtgcacccaatggtttgatcatactaaactcctaagcaggcttccataacttctgttatcgggaatgcctttgcgatgtatttagcagggtgattgttcatccttcctctatatgtgtgacaagatggtttgctaataagtaactgaataaccttgtcgattccctgc

SEQ ID NO: 3441 - protein, 204 aa, Panicum virgatum
  misc_feature (1)..(204): useful for making plants with increased salt and oxidative stress resistance as described in USSN 12/922,143
  misc_feature (1)..(204): Ceres CLONE ID no.1795080
  misc_feature (1)..(204): Bit score of 295.8 for HMM based on sequences of FIGURE 2 of USSN 12/922,143.
  misc_feature (33)..(37): Pfam Name: XYPPX Pfam Description: XYPPX repeat
  misc_feature (38)..(42): Pfam Name: XYPPX Pfam Description: XYPPX repeat
  misc_feature (45)..(49): Pfam Name: XYPPX Pfam Description: XYPPX repeat
  misc_feature (66)..(70): Pfam Name: XYPPX Pfam Description: XYPPX repeat
  misc_feature (96)..(100): Pfam Name: XYPPX Pfam Description: XYPPX repeat
  misc_feature (1)..(204): Functional Homolog Of Ceres CLONE ID no. 22538
MGGGKDKHDEGDKGLFSNIMHGVAGGQGYPHQGYPPQGYPPPPGAYPPPPGAYPSPLGAYPPAPGAYPPQHGYPQPGGYPQPGGYPQPGGYPPHGGYPPAGYPGSSHQGHGSSHGGMGMGTVLAGGAAAAAAAYGAHKLSHGHSGQGGHGVIGGYGHGYSHGYGGHGKFKHGHGHHGKFKHGHGKFKHGKHGHGMFGGKFKKWK

SEQ ID NO: 3442 - DNA, 884 bp, Panicum virgatum
  misc_feature (1)..(884): useful for making plants with increased salt and oxidative stress resistance as described in USSN 12/922,143
  misc_feature (1)..(884): Ceres CLONE ID no.1771569
ggaaccatcacgcgtcgcccacagaaacatcgcctgagatcggctacttggtttgctgatcgccggagttctcgtcgtcgttcggtagcttgggggaacaatgggaggcggcaaggacaagcatgacgagggtgacaaggggctcttctcaaacataatgcatggtgttgccggtggccaggggtacccgcatcagggataccctccgcaaggctacccgccaccacctggggcgtacccgcctccccctggggcgtatcctccaccaggggcttatcccctggcacccggggcatacccaccacagcatgggtaccctcaaccgggtgggtaccctcaaccaggtggttaccctccacatggtggttatccccctgctggttatcccggctcatctcaccagggtcatggtagcagccatggtggcatggggatggggacggttctagctggaggcaccgccgccgctgcagctgcgtatggagcacacaagctctctcatgggcatagcggacaaggtggacatggggtcattggaggctatggccacggttacggccagggctacggcggttacggccagggctacggcggtcacggcaagttcaagcatggtcacggccaccacggcaagttcaagcacggccatggcaaattcaagcatggcaagcatgggcacggcatgttcggcggcaagttcaagaagtggaagtgatgtgcacccaatggtttgatcatactaaactcctaagcaggcttccataacttctgttatcgggaatgcctttgcgatgtatttagcagggtgattgttcatccttcctctatatgtgtgacaagatggtttgctaataagtaactgaataaccttgtcgattccctgt

SEQ ID NO: 3443 - protein, 204 aa, Panicum virgatum
  misc_feature (1)..(204): useful for making plants with increased salt and oxidative stress resistance as described in USSN 12/922,143
  misc_feature (1)..(204): Ceres CLONE ID no.1771569
  misc_feature (1)..(204): Bit score of 291.2 for HMM based on sequences of FIGURE 2 of USSN 12/922,143.
  misc_feature (33)..(37): Pfam Name: XYPPX Pfam Description: XYPPX repeat
  misc_feature (38)..(42): Pfam Name: XYPPX Pfam Description: XYPPX repeat
  misc_feature (45)..(49): Pfam Name: XYPPX Pfam Description: XYPPX repeat
  misc_feature (52)..(56): Pfam Name: XYPPX Pfam Description: XYPPX repeat
  misc_feature (65)..(69): Pfam Name: XYPPX Pfam Description: XYPPX repeat
  misc_feature (1)..(204): Functional Homolog Of Ceres CLONE ID no. 22538
MGGGKDKHDEGDKGLFSNIMHGVAGGQGYPHQGYPPQGYPPPPGAYPPPPGAYPPPGAYPLAPGAYPPQHGYPQPGGYPQPGGYPPHGGYPPAGYPGSSHQGHGSSHGGMGMGTVLAGGTAAAAAAYGAHKLSHGHSGQGGHGVIGGYGHGYGQGYGGYGQGYGGHGKFKHGHGHHGKFKHGHGKFKHGKHGHGMFGGKFKKWK

SEQ ID NO: 3444 - protein, 197 aa, Oryza sativa subsp. japonica
  misc_feature (1)..(197): useful for making plants with increased salt and oxidative stress resistance as described in USSN 12/922,143
  misc_feature (1)..(197): Public GI ID no.115461767
  misc_feature (1)..(197): Bit score of 306.3 for HMM based on sequences of FIGURE 2 of USSN 12/922,143.
  misc_feature (39)..(43): Pfam Name: XYPPX Pfam Description: XYPPX repeat
  misc_feature (46)..(50): Pfam Name: XYPPX Pfam Description: XYPPX repeat
  misc_feature (53)..(57): Pfam Name: XYPPX Pfam Description: XYPPX repeat
  misc_feature (60)..(64): Pfam Name: XYPPX Pfam Description: XYPPX repeat
  misc_feature (79)..(83): Pfam Name: XYPPX Pfam Description: XYPPX repeat
  misc_feature (1)..(197): Functional Homolog Of Ceres CLONE ID no. 22538
MGGGKDKHDESDKGLFSNMMHGVAGGHGYPPHQGYPPQGYPPPPGAYPPPPGAYPPPPGAYPPPPGAYPPQHGYPQPGGYPPPGGYPQHGGYPPAGYPGSSGHQGGHGSSGGGHMGAMLAGGAAAAAAAYGAHKISSHGHGGHMGYGGHGGFGGYGHGYGGHHGGKFKHGKHGHHGKFKHGKHGHGMFGGGKFKKWK

SEQ ID NO: 3445 - DNA, 612 bp, Glycine max
  misc_feature (1)..(612): useful for making plants with increased salt and oxidative stress resistance as described in USSN 12/922,143
  misc_feature (1)..(612): Ceres CLONE ID no.547495
  misc_feature (1)..(612): Inplanta Sequence
aattcagagagagcgaaacggcagcacgcgcaaaaatggtgaagtttctgaaaccaaacaaagccgtcatcgtccttcagggacgctacgccggcaaaaaagccgtgatagtgcgaaccttcgatgaaggcacgcgcgagcgcccctacgggcactgcttggtggcagggataaagaagtaccctgcgaaggtgatcaagaaggattcggccaagaagacggccaagaagtcgcgtgtgaaggcgttcgtgaagctcgtgaactaccagcacctcatgcccacgcgctacacgctcgatgtcgatttgaaggacgcggttacccccgacgtgctccaagccaaggataagaaggttactgctctcaaggagaccaagaagcgcctcgaggagaggttcaagactgggaagaatcggtggttcttcaccaagctcaggttctgagcataatattatgcatttttgttttcaaaatgtttttggatctcgctttgtttttcgtaattgatactttataatgatgtgttgagattagattttggttatattggatgtttaatgtggtttctggagatgataggataaagttgttcaaaaaaaaaaaaaaaaaaaa

SEQ ID NO: 3446 - protein, 135 aa, Glycine max
  misc_feature (1)..(135): useful for making plants with increased salt and oxidative stress resistance as described in USSN 12/922,143
  misc_feature (1)..(135): Ceres CLONE ID no.547495
  misc_feature (1)..(135): Bit score of 332.5 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
MVKFLKPNKAVIVLQGRYAGKKAVIVRTFDEGTRERPYGHCLVAGIKKYPAKVIKKDSAKKTAKKSRVKAFVKLVNYQHLMPTRYTLDVDLKDAVTPDVLQAKDKKVTALKETKKRLEERFKTGKNRWFFTKLRF

SEQ ID NO: 3447 - protein, 134 aa, Pyrobotrys stellata
  misc_feature (1)..(134): useful for making plants with increased salt and oxidative stress resistance as described in USSN 12/922,143
  misc_feature (1)..(134): Public GI ID no.400991
  misc_feature (1)..(134): Bit score of 297.2 for HMM based on sequences of FIGURE 4 of USSN 12/922,143.
  misc_feature (52)..(134): Pfam Name: Ribosomal_L27e Pfam Description: Ribosomal L27e protein family
  misc_feature (7)..(40): Pfam Name: KOW Pfam Description: KOW motif
  misc_feature (1)..(134): Functional Homolog Of Ceres CLONE ID no. 547495
MVKFLKSGKVVVVLSGRFAGKKAVIVRNFDDGTSSRPYGHALVVGLQKEPRKVTKRQSQKKQAKKSTLKTFIKTVNYNHLMPTRYTLDVDFKGVAAEAQENPTKKVEARKECKKLLEEKFKTGKNRWFFTKLRF

SEQ ID NO: 3448 - DNA, 620 bp, Gossypium hirsutum
  misc_feature (1)..(620): useful for making plants with increased salt and oxidative stress resistance as described in USSN 12/922,143
  misc_feature (1)..(620): Ceres CLONE ID no.1808896
acttagggtttttgggagaagagaatcagagccgcagctgccgccatcgccatggtgaagtttcttaaaccgaacaaggcagttatcgtcctccagggtcgatacgccggccgcaaagccgtcattgtcagatctttcgacgatggcacacgtgaccgcgcctatggccattgtttggttgcagggataaagaagtatccgagcaaggttatccgcaaggactccgcgaagaaaaccgccaagaagtcacgcgtcaagtgcttcatcaagctcgtcaattaccagcacctgatgcccacgcgctacaccctcgacgtggacttgaaagacgtggttaccgtcgatgctctccagaccaaggacaagaaagtggccgcttgtaaggcaactaaggagaggtttgaagagaggttcaagactgggaaaaacaggtggttctttactaagctcaggttttaagtgttttattggaacatgttttatgcttaagtagttttatcgaacaattttgaatttaatgacggattttgaatctgtttggataagatatttctgggttattatttttgttattttatggaacgtgatttgctcatttctataagaagtttaagcttttg

SEQ ID NO: 3449 - protein, 135 aa, Gossypium hirsutum
  misc_feature (1)..(135): useful for making plants with increased salt and oxidative stress resistance as described in USSN 12/922,143
  misc_feature (1)..(135): Ceres CLONE ID no.1808896
  misc_feature (1)..(135): Bit score of 336.3 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVIVLQGRYAGRKAVIVRSFDDGTRDRAYGHCLVAGIKKYPSKVIRKDSAKKTAKKSRVKCFIKLVNYQHLMPTRYTLDVDLKDVVTVDALQTKDKKVAACKATKERFEERFKTGKNRWFFTKLRF

SEQ ID NO: 3450 - DNA, 638 bp, Gossypium hirsutum
  misc_feature (1)..(638): useful for making plants with increased salt and oxidative stress resistance as described in USSN 12/922,143
  misc_feature (1)..(638): Ceres CLONE ID no.1847455
gagttagggttttgcgccagggcgagaatcaaagccgccgtcgccatggtgaagtttctaaagcccaacaaagctgtcattgtcctccaaggccgatacgccggacgcaaagctgtgatcgtaaaatccttcgacgacggcacacgtgaccgtccctatggccactgtttggtcgcggggataaaaaagtacccgagcaaggtcatcctcaaggactccgccaagaaaaccgccaagaaatcgcgcgtcaagtgcttcgtcaagctcgtgaactaccagcacctgatgcccacacgatacaccctcgacgtcgacttgaaagacaccgtcacagtcgacgcgcttcagaccaaggacaagaaagtagccacttgtaagactatcaaacaaaggctggaagagaggttcaaaacaggaaaaaacaggtggttctttaccaagcttaggttttaagtcttcctttccttttaacattttccgtagaacctcttatatcatttgcacttctcttggtgctgtacttattcagccttagatcgatacggaaaaaaagcttgagaattcgagtccttcgttgtttggccatttttgtatcatcatcgatgctatattgagttgaactttgttgtttctgctgc

SEQ ID NO: 3451 - protein, 135 aa, Gossypium hirsutum
  misc_feature (1)..(135): useful for making plants with increased salt and oxidative stress resistance as described in USSN 12/922,143
  misc_feature (1)..(135): Ceres CLONE ID no.1847455
  misc_feature (1)..(135): Bit score of 329.8 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVIVLQGRYAGRKAVIVKSFDDGTRDRPYGHCLVAGIKKYPSKVILKDSAKKTAKKSRVKCFVKLVNYQHLMPTRYTLDVDLKDTVTVDALQTKDKKVATCKTIKQRLEERFKTGKNRWFFTKLRF

SEQ ID NO: 3452 - protein, 117 aa, Gossypium hirsutum
  misc_feature (1)..(117): useful for making plants with increased salt and oxidative stress resistance as described in USSN 12/922,143
  misc_feature (1)..(117): CERES CLONE ID no.100002370
  misc_feature (1)..(117): Bit score of 177.1 for HMM based on sequences of FIGURE 4 of USSN 12/922,143.
  misc_feature (53)..(87): Pfam Name: Ribosomal_L27e Pfam Description: Ribosomal L27e protein family
  misc_feature (7)..(40): Pfam Name: KOW Pfam Description: KOW motif
  misc_feature (1)..(117): Functional Homolog Of Ceres CLONE ID no. 547495
MVKFLKPNNAVIVLQCRYAGRKAVIVRSFDDGTRDRAYGHCVVAGIKKYPSNVIRKDSAKKTAKKSRVKCFIKLVNYQHLMPTRYTLRCGLETKWVTGQFSSKTNGKENLAGWLMET

SEQ ID NO: 3453 - DNA, 408 bp, Populus balsamifera subsp. trichocarpa
  misc_feature (1)..(408): useful for making plants with increased salt and oxidative stress resistance as described in USSN 12/922,143
  misc_feature (1)..(408): Ceres ANNOT ID no.1453365
atggtgaagtttctcaaacccaacaaggccgtcatagtcctccaaggccgatatgctggtcgcaaggcagtgatcgtcaagcactttgatgatggaaccagagaccgcccctatggtcattgcttggtcgcagggatcaagaagtacccaagcaaggttataaagaaagactcggccaagaaaacagcaaagaaatcgagggtcaagtgtttcgttaaggttgttaactatcagcacctgatgcctactaggtatactttggatgtggatttgaaggaccttgttactcctgattgcttggcaactaaggataagaaagtcgtggcttgtaaggaaacaaagacaaggttcgaggagaggttcaagactgggaagaaccgttggtttttcaccaagctgaggttttga

SEQ ID NO: 3454 - protein, 135 aa, Populus balsamifera subsp. trichocarpa
  misc_feature (1)..(135): useful for making plants with increased salt and oxidative stress resistance as described in USSN 12/922,143
  misc_feature (1)..(135): Ceres ANNOT ID no.1453365
  misc_feature (1)..(135): Bit score of 331.1 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVIVLQGRYAGRKAVIVKHFDDGTRDRPYGHCLVAGIKKYPSKVIKKDSAKKTAKKSRVKCFVKVVNYQHLMPTRYTLDVDLKDLVTPDCLATKDKKVVACKETKTRFEERFKTGKNRWFFTKLRF

SEQ ID NO: 3455 - DNA, 408 bp, Populus balsamifera subsp. trichocarpa
  misc_feature (1)..(408): useful for making plants with increased salt and oxidative stress resistance as described in USSN 12/922,143
  misc_feature (1)..(408): Ceres ANNOT ID no.1528012
atggtgaagtttctcaagcccaacaaggccgtcataatcctccaaggccgctatgcaggtcgcaaagcagtgatcgtgaagcacttcgatgacggaacaagagaccgtccatatgggcactgtttagtggcaggaatcaagaagtacccaagcaaggttataaagaaagattctaccaagaaaacagccaagaaatcgagggtcaagtgttttatcaagcttgttaactaccaacatctgatgccgacaaggtatacattggatgtagatttgaaggatgctgtcactgcagatagtttgactactaaggataagaaagttactgcttgcaaggatacaaaggcaaggttcgaggagcgttttaagactggaaagaaccgttggttttttaccaagctgaggttttga

SEQ ID NO: 3456 - protein, 135 aa, Populus balsamifera subsp. trichocarpa
  misc_feature (1)..(135): useful for making plants with increased salt and oxidative stress resistance as described in USSN 12/922,143
  misc_feature (1)..(135): Ceres ANNOT ID no.1528012
  misc_feature (1)..(135): Bit score of 335.2 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVIILQGRYAGRKAVIVKHFDDGTRDRPYGHCLVAGIKKYPSKVIKKDSTKKTAKKSRVKCFIKLVNYQHLMPTRYTLDVDLKDAVTADSLTTKDKKVTACKDTKARFEERFKTGKNRWFFTKLRF

SEQ ID NO: 3457 - DNA, 408 bp, Populus balsamifera subsp. trichocarpa
  misc_feature (1)..(408): useful for making plants with increased salt and oxidative stress resistance as described in USSN 12/922,143
  misc_feature (1)..(408): Ceres ANNOT ID no.1440596
atggtgaagttcttgaagacaaacaaggccgtcataatcctgcaaggaaaatatgcaggtcgcaaaggagtaatcgtcaggtccttcgacgatggtacacgtgatcgcccgtacggccactgtttggttgcagggattaagaagtacccaagcaaggttatcaagaaggactcagccaaaaagactgccaagaaatcccgggtcaagtgcttcatcaagctagtgaactaccagcacctgatgcccacacgttacacgctggatgtggacttgaaagatgttgtgaccgctgattgtttgtcaaccaaggataagaagattactgcttgcaaggagacaaaggctaggttcgaggagcggtttaagacaggcaagaacaggtggttttttacaaagctgaggttttga

SEQ ID NO: 3458 - protein, 135 aa, Populus balsamifera subsp. trichocarpa
  misc_feature (1)..(135): useful for making plants with increased salt and oxidative stress resistance as described in USSN 12/922,143
  misc_feature (1)..(135): Ceres ANNOT ID no.1440596
  misc_feature (1)..(135): Bit score of 331.7 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKTNKAVIILQGKYAGRKGVIVRSFDDGTRDRPYGHCLVAGIKKYPSKVIKKDSAKKTAKKSRVKCFIKLVNYQHLMPTRYTLDVDLKDVVTADCLSTKDKKITACKETKARFEERFKTGKNRWFFTKLRF

SEQ ID NO: 3459 - DNA, 426 bp, Populus balsamifera subsp. trichocarpa
  misc_feature (1)..(426): useful for making plants with increased salt and oxidative stress resistance as described in USSN 12/922,143
  misc_feature (1)..(426): Ceres ANNOT ID no.1474581
atggtgaagtttctcaagcccaacaaggccgtcataatcctccaaggccgctatgcaggtcgcaaagcagtgatcgtgaagcacttcgatgacggaacaagagaccgtccatatgggcactgtttagtggcaggaatcaagaagtacccaagcaaggttataaagaaagattctaccaagaaaacagccaagaaatcgagggtcaagtgttttatcaagcttgttaactaccaacatctgatgccgacaaggtatacattggatgtagatttgaaggatgctgtcactgcagatagtttgactactaaggataagaaagttactgcttgcaaggatacaaaggcaaggaatgtattcgtctcggcttccatgaaatggaaataccctagctgtaattttaaaggtgttgttttagggttgctctga

SEQ ID NO: 3460 - protein, 141 aa, Populus balsamifera subsp. trichocarpa
  misc_feature (1)..(141): useful for making plants with increased salt and oxidative stress resistance as described in USSN 12/922,143
  misc_feature (1)..(141): Ceres ANNOT ID no.1474581
  misc_feature (1)..(141): Bit score of 269.6 for HMM based on sequences of FIGURE 4 of USSN 12/922,143.
  misc_feature (52)..(116): Pfam Name: Ribosomal_L27e Pfam Description: Ribosomal L27e protein family
  misc_feature (7)..(40): Pfam Name: KOW Pfam Description: KOW motif
  misc_feature (1)..(141): Functional Homolog Of Ceres CLONE ID no. 547495
MVKFLKPNKAVIILQGRYAGRKAVIVKHFDDGTRDRPYGHCLVAGIKKYPSKVIKKDSTKKTAKKSRVKCFIKLVNYQHLMPTRYTLDVDLKDAVTADSLTTKDKKVTACKDTKARNVFVSASMKWKYPSCNFKGVVLGLL

SEQ ID NO: 3461 - DNA, 631 bp, Arabidopsis thaliana
  misc_feature (1)..(631): useful for making plants with increased salt and oxidative stress resistance as described in USSN 12/922,143
  misc_feature (1)..(631): Ceres CLONE ID no.15384
agggttcatagcagccagagagagagagacaagtgagagggatctaccaaacgaagcaacaatggtgaagttcttgaagcagaacaaggccgtgatccttcttcaaggacgttacgccggaaagaaagccgtcatcatcaaatccttcgacgacggtaaccgtgatcgtccttacggacactgcctcgtcgccggactgaagaagtacccgagcaaagtcatccgcaaagactcagctaagaagacagctaagaaatctagggttaagtgtttcatcaagcttgttaattaccagcatctgatgcctactcgttacacactcgacgtggatctcaaggaagtggcgactcttgatgctcttcagagtaaggataagaaggttgctgctcttaaggaagctaaggctaagcttgaggagaggttcaagactggtaagaacagatggttctttaccaagctcaggttctgaagaaattttctatttcgtgaggaattcattttgagctttttgttatcgtgttttttagtttctagggttcatttcccatggtgaaaaatgtggatcctgttttggattgtggaagatgttttgttgaagtttggattatggatttgatcttttattttgact

SEQ ID NO: 3462 - protein, 135 aa, Arabidopsis thaliana
  misc_feature (1)..(135): useful for making plants with increased salt and oxidative stress resistance as described in USSN 12/922,143
  misc_feature (1)..(135): Ceres CLONE ID no.15384
  misc_feature (1)..(135): Bit score of 332.3 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKQNKAVILLQGRYAGKKAVIIKSFDDGNRDRPYGHCLVAGLKKYPSKVIRKDSAKKTAKKSRVKCFIKLVNYQHLMPTRYTLDVDLKEVATLDALQSKDKKVAALKEAKAKLEERFKTGKNRWFFTKLRF

SEQ ID NO: 3463 - protein, 135 aa, Arabidopsis thaliana
  misc_feature (1)..(135): useful for making plants with increased salt and oxidative stress resistance as described in USSN 12/922,143
  misc_feature (1)..(135): Public GI ID no.15233318
  misc_feature (1)..(135): Bit score of 326.4 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(35): Pfam Name: KOW Pfam Description: KOW motif
  misc_feature (1)..(135): Functional Homolog Of Ceres CLONE ID no. 547495
MVKFLKQNKAVILLQGRYAGKKAVIIKSFDDGTSDRRYGHCLVAGLKKYPSKVIRKDSAKKTAKKSRVKCFIKLVNYQHLMPTRYTLDVDLKEVATLDALKSKDKKVTALKEAKAKLEERFKTGKNRWFFTKLRF

SEQ ID NO: 3464 - DNA, 577 bp, Arabidopsis thaliana
  misc_feature (1)..(577): useful for making plants with increased salt and oxidative stress resistance as described in USSN 12/922,143
  misc_feature (1)..(577): Ceres CLONE ID no.25631
gcggtggtgagaaacaatggtgaagtttctgaagcagaacaaagcggtgatcctccttcaaggccgttacgccggcaaaaaggcagtgatcatcaaatccttcgatgacggaaccagtgaccgtcgttacggacactgcctcgtcgccggactgaagaagtacccgagcaaagtcatccgcaaagactccgcgaagaagacggcgaagaaatcaagagtgaaatgtttcatcaagctcgtgaattaccagcatctgatgcctactcgttacacgctcgatgtagatctgaaggaagtagcgactcttgatgctcttaagagtaaggataagaaggtgattgctttaaaggaagctaaagctaagcttgaggaacgtttcaagactggtaagaacaggtggttctttactaagctcaggttctgaagaagaacctttgagatttttatctatctatctactttttgtttagttctagaatgaatttggatcattgtttaagaccttttggtttggaattgattctggattttgtctcttacttataatcttttgctatattgatgcctcattttatac

SEQ ID NO: 3465 - protein, 135 aa, Arabidopsis thaliana
  misc_feature (1)..(135): useful for making plants with increased salt and oxidative stress resistance as described in USSN 12/922,143
  misc_feature (1)..(135): Ceres CLONE ID no.25631
  misc_feature (1)..(135): Bit score of 324.1 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(35): Pfam Name: KOW Pfam Description: KOW motif
  misc_feature (1)..(135): Functional Homolog Of Ceres CLONE ID no. 547495
MVKFLKQNKAVILLQGRYAGKKAVIIKSFDDGTSDRRYGHCLVAGLKKYPSKVIRKDSAKKTAKKSRVKCFIKLVNYQHLMPTRYTLDVDLKEVATLDALKSKDKKVIALKEAKAKLEERFKTGKNRWFFTKLRF

SEQ ID NO: 3466 - DNA, 582 bp, Arabidopsis thaliana
  misc_feature (1)..(582): useful for making plants with increased salt and oxidative stress resistance as described in USSN 12/922,143
  misc_feature (1)..(582): Ceres CLONE ID no.1348650
aggaagcgccgagagaaagacagagaagagagtgacaatggtgaaatgtatgaagccaggaaaagccgtgatccttttacaaggacgatacgccggtaaaaaggcggtgatcgtgaaatccttcgatgacggtaccgttgagaagaagtacggtcactgtctcgtcgccggattgaagaagtacccaagcaaagtcattcgcaaggattcggcaaagaagacggctaagaaatcgcgcgtgaaatgcttcttcaaggtcatcaattaccagcacgtgatgcctacgcgctacactcttgatttggatctgaagaacgttgtctccgccgacgcgatctcgtccaaggataagaaagtgacggctcttaaggaagcgaaggcgaagtttgaagagaggtttaagactggcaagaacagatggttcttcaccaagcttaggttttgaattctacagtttttaattttagttttaaagtttcaatttttatctaccatgaattgtttttgcttctggtttagctcaaggttatgttttgttctaaatttcagtaatatatattcaattttgatggttaaagtttt

SEQ ID NO: 3467 - protein, 135 aa, Arabidopsis thaliana
  misc_feature (1)..(135): useful for making plants with increased salt and oxidative stress resistance as described in USSN 12/922,143
  misc_feature (1)..(135): Ceres CLONE ID no.1348650
  misc_feature (1)..(135): Bit score of 305.1 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(35): Pfam Name: KOW Pfam Description: KOW motif
  misc_feature (1)..(135): Functional Homolog Of Ceres CLONE ID no. 547495
MVKCMKPGKAVILLQGRYAGKKAVIVKSFDDGTVEKKYGHCLVAGLKKYPSKVIRKDSAKKTAKKSRVKCFFKVINYQHVMPTRYTLDLDLKNVVSADAISSKDKKVTALKEAKAKFEERFKTGKNRWFFTKLRF

SEQ ID NO: 3468 - protein, 135 aa, Arabidopsis thaliana
  misc_feature (1)..(135): useful for making plants with increased salt and oxidative stress resistance as described in USSN 12/922,143
  misc_feature (1)..(135): Public GI ID no.15225207
  misc_feature (1)..(135): Bit score of 302.1 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(35): Pfam Name: KOW Pfam Description: KOW motif
  misc_feature (1)..(135): Functional Homolog Of Ceres CLONE ID no. 547495
MVKCMKPGKAVILLQGRYTGKKAVIVKSFDDGTVEKKYGHCLVAGLKKYPSKVIRKDSAKKTAKKSRVKCFFKVINYQHVMPTRYTLDLDLKNVVSADAISSKDKKVTALKEAKAKFEERFKTGKNRWFFTKLRF

SEQ ID NO: 3469 - DNA, 535 bp, Arabidopsis thaliana
  misc_feature (1)..(535): useful for making plants with increased salt and oxidative stress resistance as described in USSN 12/922,143
  misc_feature (1)..(535): Ceres CLONE ID no.26797
agggttcatagcagccagagagagagagacaagtgagagggatctaccaaacgaagcaacaatggtgaagttcttgaagcagaacaaggccgtgatccttcttcaaggacgttacgccggaaaaaaagccgtcatcatcaaatccttcgacgacggtaaccgtgatcgtccttacggacactgcctcgtcgccggactgaagaagtacccgagcaaagtcatccgcaaagactcagctaagaagacagctaagaaatctagggttaagtgtttcatcaagcttgttaattaccagcatctgatgcctactcgttacacactcgacgtggatctcaagcaagtggcgactcttgatgctcttcagagtaaggataagaaggttgctgctcttaaggaagctaaggctaagcttgaggagaggttcaagactgtttctagggttcatttcccatggtgaaaaatgtggatcctgttttggattgtggaagatgttttgttgaagtttggattatggatttgatcttttattttgatc

SEQ ID NO: 3470 - protein, 131 aa, Arabidopsis thaliana
  misc_feature (1)..(131): useful for making plants with increased salt and oxidative stress resistance as described in USSN 12/922,143
  misc_feature (1)..(131): Ceres CLONE ID no.26797
  misc_feature (1)..(131): Bit score of 279.3 for HMM based on sequences of FIGURE 4 of USSN 12/922,143.
  misc_feature (52)..(123): Pfam Name: Ribosomal_L27e Pfam Description: Ribosomal L27e protein family
  misc_feature (7)..(40): Pfam Name: KOW Pfam Description: KOW motif
  misc_feature (1)..(131): Functional Homolog Of Ceres CLONE ID no. 547495
MVKFLKQNKAVILLQGRYAGKKAVIIKSFDDGNRDRPYGHCLVAGLKKYPSKVIRKDSAKKTAKKSRVKCFIKLVNYQHLMPTRYTLDVDLKQVATLDALQSKDKKVAALKEAKAKLEERFKTVSRVHFPW

SEQ ID NO: 3471 - DNA, 773 bp, Glycine max
  misc_feature (1)..(773): useful for making plants with increased salt and oxidative stress resistance as described in USSN 12/922,143
  misc_feature (1)..(773): Ceres CLONE ID no.475808
agcggagcaatagcaacagagccagcgagagcaaaaccctagttcatccatcaccagtcgaggaagaagatggtgaagttccttaagcccaacaaggctgtcatcgtcctgcagggccgctacgccgggcgcaaggcggtgatcgtgaggaccttcgacgagggaaccagggagcgcccctacggccactgcctcgtcgccggaatcaagaagtaccccagcaaggtcatcaagaaggactccgccaagaagacggccaagaaatctagggttaaggcgttcgtgaagctcgtgaactaccagcacctcatgcccacgcgttacacgttcgacgtggatctcaaggatgctgttacccctgatgttctcggcaccaaggacaagaaggtcactgctctcaaggagaccaagaagcggttggaggagaggttcaagaccggcaagaataggtggttctttaccaaactcagattctgatctcgcaatcgtgaggttttattattagggcttttggaatgttgccttttttttaatattgtattcttgttttgcaaatcttatcaaaactattattctgctcttaagatttgtcgtcatcgtcttcttcttttgttaattaatgcatttgccttcttttaatttacgggggaaatgaatgcgagcatgttttgatactgaggaattcgcacaaatgggtctattcagataggaaattttctggttcgtttgacatgcactgtttgaatctaggttttaattgcgattttagccct

SEQ ID NO: 3472 - protein, 135 aa, Glycine max
  misc_feature (1)..(135): useful for making plants with increased salt and oxidative stress resistance as described in USSN 12/922,143
  misc_feature (1)..(135): Ceres CLONE ID no.475808
  misc_feature (1)..(135): Bit score of 328.9 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVIVLQGRYAGRKAVIVRTFDEGTRERPYGHCLVAGIKKYPSKVIKKDSAKKTAKKSRVKAFVKLVNYQHLMPTRYTFDVDLKDAVTPDVLGTKDKKVTALKETKKRLEERFKTGKNRWFFTKLRF

SEQ ID NO: 3473 - DNA, 629 bp, Glycine max
  misc_feature (1)..(629): useful for making plants with increased salt and oxidative stress resistance as described in USSN 12/922,143
  misc_feature (1)..(629): Ceres CLONE ID no.1121669
acttagcggcgataaagagaagaaaaaatggtgaagttcttgaagcagaacaaggccgtgatccttcttcaaggccggtacgccggaaagaaagccgtgatcatccgctccttcgacgacggaaaccgtgagcgtccttacggacactgcctcgtggccggactcaagaagtacccgagcaaggtcatccgcaaggactcggccaagaagacggcgaagaaatctcgggttaaatgtttcatcaaggtcgttaactaccagcatctgatgcctacccgttacaccctcgacgtggatctcaaggaagtcgctaccctcgaggctctttcttcaaaggacaagaaagtcgctgctctcaaggaggctaaggcgaagcttgaggaacgttttaagactggcaagaacaggtggttctttaccaagctcaggttctgaggacatttcgtatggagttttacagctttactttagtttccagggttcatttgttggacgacgtggatccccttttaatttgtgaaagactttttgttggaatttcgattctgaattttctatgttatgattatctaatgcagttttatttacgtcctcgtttcatttgaatgatatgcttatgttttatatct

SEQ ID NO: 3474 - protein, 135 aa, Glycine max
  misc_feature (1)..(135): useful for making plants with increased salt and oxidative stress resistance as described in USSN 12/922,143
  misc_feature (1)..(135): Ceres CLONE ID no.1121669
  misc_feature (1)..(135): Bit score of 329.9 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALSSKDKKVAALKEAKAKLEERFKTGKNRWFFTKLRF

SEQ ID NO: 3475 - DNA, 658 bp, Glycine max
  misc_feature (1)..(658): useful for making plants with increased salt and oxidative stress resistance as described in USSN 12/922,143
  misc_feature (1)..(658): Ceres CLONE ID no.1075841
acttagcttttttttcagcggcgatacgaagacgaaggagagggatctatctacacaagtgaagcaacaatggtgaagttcttgaagcagaacaaggcagtgatcctcctccaaggccgatacgccgggaagaaggcggtgatcatccgatccttcgacgacggaaaccgtgagcgtccttacggacactgcctcgtcgccggactcaagaagtacccgagcaaggtcatccgcaaggactcggcgaagaagacggccaagaaatctagggttaagtgtttcatcaaggtcgtcaactaccagcatttgatgcctacgcgttacaccctcgacgtggatctcaaggaagtcgcgaccctcgaggctctggcttcaaaggacaagaaggtcgctgctctcaaggaggcgaaggctaagctcgaggaacgtttcaagaccgggaagaacagatggttctttaccaaactcaggttctgaaggaatcactgtcggaagaaacattttgagagtttttgttgttgcattttcttatccaatatttaaaacagcgtattattgttagtttctatggttcgtatggagaacaatgtggatcctgttttggattgtgaaagacttctgttggaaatttctgttctggagtttgattctctattgc

SEQ ID NO: 3476 - protein, 135 aa, Glycine max
  misc_feature (1)..(135): useful for making plants with increased salt and oxidative stress resistance as described in USSN 12/922,143
  misc_feature (1)..(135): Ceres CLONE ID no.1075841
  misc_feature (1)..(135): Bit score of 329.2 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALASKDKKVAALKEAKAKLEERFKTGKNRWFFTKLRF

SEQ ID NO: 3477 - protein, 135 aa, Medicago truncatula
  misc_feature (1)..(135): useful for making plants with increased salt and oxidative stress resistance as described in USSN 12/922,143
  misc_feature (1)..(135): Public GI ID no.92885255
  misc_feature (1)..(135): Bit score of 328.7 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVIVLQGRYAGKKAVIVKNFDDGTRERAYGHCLVAGIKKYPAKVIKKDSAKKTAKKSRVKAFVKLVNYQHLMPTRYTLDVDLKEVVTTDVLQSKDKKVTALKEAKKRFEERFKTGKNRWFFTKLRF

SEQ ID NO: 3478 - protein, 135 aa, Pisum sativum
  misc_feature (1)..(135): useful for making plants with increased salt and oxidative stress resistance as described in USSN 12/922,143
  misc_feature (1)..(135): Public GI ID no.498902
  misc_feature (1)..(135): Bit score of 329.5 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVILLQGRYAGKKAVIVKTFDDGTREKPYGHCLVAGIKKYPSKVIKKDSAKKTAKKSRVKAFVKLVNYQHLMPTRYTLDVDLKDAVVPDVLQSKDKKVTALKETKKSLEERFKTGKNRWFFTKLRF

SEQ ID NO: 3479 - protein, 135 aa, Pisum sativum
  misc_feature (1)..(135): useful for making plants with increased salt and oxidative stress resistance as described in USSN 12/922,143
  misc_feature (1)..(135): Public GI ID no.498906
  misc_feature (1)..(135): Bit score of 330.0 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVILLQGRYAGKKAVIVKTFDDGTRDKPYGHCLVAGIKKYPSKVIKKDSAKKTAKKSRVKAFVKLVNYQHLMPTRYTLDVDLKDAVVPDVLQSKDKKVTALKETKKSLEERFKTGKNRWFFTKLRF

SEQ ID NO: 3480 - protein, 135 aa, Pisum sativum
  misc_feature (1)..(135): useful for making plants with increased salt and oxidative stress resistance as described in USSN 12/922,143
  misc_feature (1)..(135): Public GI ID no.464630
  misc_feature (1)..(135): Bit score of 326.3 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVILLQGRYAGKKAVIVKTFDDGTREKPYGHCLVAGIKKFPSKVIKKDSAKKTAKKSRVKAFVKLVNYQHLMPTRYTLDVDLKDAVVPDVLQSKDKKVTALKETKKSLEERFKTGKNRWFFTKLRF

SEQ ID NO: 3481 - protein, 135 aa, Pisum sativum
  misc_feature (1)..(135): useful for making plants with increased salt and oxidative stress resistance as described in USSN 12/922,143
  misc_feature (1)..(135): Public GI ID no.498904
  misc_feature (1)..(135): Bit score of 321.8 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVILLQGRYAGKKAVIVKTFDDGTREKPYGHCLVAGIKKYSSKVIKKDSAKKTAKKSRVKAFVKLVNYQHLMPTRYTLDVDLKDAVVPDVLQSKDKKVTALKETKKSVEERFKTGKNRWFFTKLRF

SEQ ID NO: 3482 - protein, 135 aa, Panax ginseng
  misc_feature (1)..(135): useful for making plants with increased salt and oxidative stress resistance as described in USSN 12/922,143
  misc_feature (1)..(135): Public GI ID no.8131701
  misc_feature (1)..(135): Bit score of 331.3 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKVLKPNKAVIVLNGRYAGRKSVIIKSFDEGTRDRPYGHCLVAGISKYPKKVIRKDSAKKTAKKSRVKAFIKLVNCNHIMPTRYTLDVDLKDVVTVDCLQSRDKKVTAAKETKARLEERFKTGKNRWFFTKLRF

SEQ ID NO: 3483 - protein, 138 aa, Solanum tuberosum
  misc_feature (1)..(138): useful for making plants with increased salt and oxidative stress resistance as described in USSN 12/922,143
  misc_feature (1)..(138): Public GI ID no.730547
  misc_feature (1)..(138): Bit score of 307.0 for HMM based on sequences of FIGURE 4 of USSN 12/922,143.
  misc_feature (52)..(138): Pfam Name: Ribosomal_L27e Pfam Description: Ribosomal L27e protein family
  misc_feature (7)..(40): Pfam Name: KOW Pfam Description: KOW motif
  misc_feature (1)..(138): Functional Homolog Of Ceres CLONE ID no. 547495
MEKFLKPNKAVILLQGKYAGRKAVIVRAFDEGTRDRPYGHCLVAGISRYPKKVIRKDSAKKAGKKSRVKAFIKLVNYNHIMPTRYTLDEDLKDVVKDVVNADVLQARDKKVTARRTKARLAERFKTGKNRWFFTKLRF

SEQ ID NO: 3484 - DNA, 683 bp, Triticum aestivum
  misc_feature (1)..(683): useful for making plants with increased salt and oxidative stress resistance as described in USSN 12/922,143
  misc_feature (1)..(683): Ceres CLONE ID no.567641
tttttttctccctcccacagcccacagacccctcccctcccctcccctcccccaacccaccggcggcggcgcagcgcagcttgaggaaggaagcgaagatggtgaagttcctgaagcccggcaaggcggtgatcctgctgcagggcaggtacgcggggaagaaggcggtgatcgtgcgcgtgttcgaggagggcacccgcgaccgcccgtacgggcactgcctcgtcgccgggctggccaagtacccgaagaaggtgatccgcaaggactcggccaagaagacggccaagaagtcccgcgtcaaggtgttcctcaagctcgtcaacttcacccatctcatgcccacccgctataccctcgacgtcgacctcaaggaggtggcctccggcgcgcccgactccctcacctccaaggacaagaaggtgggcgccgccaaggccgccaaggccaagctcgaggagaggttcaagaccggcaagaacaggtggttcttcaccaagctccgcttctaggccggccggccgcgccagggcggtctctgccgttattactacccgaaccctttacatttttagttgcttgttatcggtgactgttgctgcgcttaaggtgtcctgttttggtattgcccatgaagaagactctgtgtttagcttggatcttatgagatatgatgatgtttc

SEQ ID NO: 3485 - protein, 137 aa, Triticum aestivum
  misc_feature (1)..(137): useful for making plants with increased salt and oxidative stress resistance as described in USSN 12/922,143
  misc_feature (1)..(137): Ceres CLONE ID no.567641
  misc_feature (1)..(137): Bit score of 316.5 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVGAAKAAKAKLEERFKTGKNRWFFTKLRF

SEQ ID NO: 3486 - DNA, 640 bp, Triticum aestivum
  misc_feature (1)..(640): useful for making plants with increased salt and oxidative stress resistance as described in USSN 12/922,143
  misc_feature (1)..(640): Ceres CLONE ID no.1329143
aaatttcccagaccacccaaacccacacaacccactcggcggcggcgacggcggcggcggcggagcacgcgaagatggtgaagttcctgaagccgggcaaggcggtgatccttctccagggtcggttcgccggccggaaggcggtcattgtgcgcgttttcgaggagggcacgcgcgaccgcccctacggccactgcctcgtcgccggcctagccaagtaccccaagaaggtgatccgtaaggactcggccaagaagacggcgaagaagtcgcgcgtgaagtgcttcctgaagctggtcaacttcacccacatcatgcccacccgctacaccctggatgtcgacttcaaggacgtggcctccggcgggcccgacgccctcgccacccgcgacaagaaggtcgcctcctgcaaggccgccaaggcacgtctcgaggagaggttcaagaccggcaagaacaggtggttcttcaccaagctccgcttctaggagcagagcgtctttacaatactagtattccttgttcttgcaatcaatagcacactgagctatctctatcactgtttttgtattgtccatgaggattttgtggttagtatggatctcggagagagtttaattaaggcatgatgatgatgatg

SEQ ID NO: 3487 - protein, 137 aa, Triticum aestivum
  misc_feature (1)..(137): useful for making plants with increased salt and oxidative stress resistance as described in USSN 12/922,143
  misc_feature (1)..(137): Ceres CLONE ID no.1329143
  misc_feature (1)..(137): Bit score of 321.1 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKPGKAVILLQGRFAGRKAVIVRVFEEGTRDRPYGHCLVAGLAKYPKKVIRKDSAKKTAKKSRVKCFLKLVNFTHIMPTRYTLDVDFKDVASGGPDALATRDKKVASCKAAKARLEERFKTGKNRWFFTKLRF

SEQ ID NO: 3488 - DNA, 688 bp, Triticum aestivum
  misc_feature (1)..(688): useful for making plants with increased salt and oxidative stress resistance as described in USSN 12/922,143
  misc_feature (1)..(688): Ceres CLONE ID no.554893
atttcccagaccacccaatcccacacatcccactcggcggcggcggcggcggcggagcacgcgaagatggtgaagttcctgaagaccggcaaggcggtgatccttctccagggccggttcgccggccggaaggcggtcattgtgcgcgttttcgaggagggcacacgcgaccgcccctacggccactgcctcgtcgccggcctagccaagtaccccaagaaggtgatccgcaaggactcggccaagaagacggcgaagaagtcgcgcgtgaagtgcttcctgaagctggtcaacttcacccacatcatgcccacccgctacaccctggacgtcgacttcaaggacgtcgcctccggcgggcccgacgccctcgccacccgcgacaagaaggtcgcctcctgcaaggccgccaaggcacgtctcgaggagaggttcaagaccggcaagaacaggtggttcttcaccaagctccgcttctaggagcagagcgtctttacaatacttattagtagttccttgttcttgcaatcaatagcacactgagctatctctatcactgtttttgtattgtccatgaggattttgtggttagtatggatctcggagagagtttaattaaggcatgatgatgatgatgttccatgtgttaaatcatgctaaatgatgcacatggttgcaattttgttat

SEQ ID NO: 3489 - protein, 137 aa, Triticum aestivum
  misc_feature (1)..(137): useful for making plants with increased salt and oxidative stress resistance as described in USSN 12/922,143
  misc_feature (1)..(137): Ceres CLONE ID no.554893
  misc_feature (1)..(137): Bit score of 318.5 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKTGKAVILLQGRFAGRKAVIVRVFEEGTRDRPYGHCLVAGLAKYPKKVIRKDSAKKTAKKSRVKCFLKLVNFTHIMPTRYTLDVDFKDVASGGPDALATRDKKVASCKAAKARLEERFKTGKNRWFFTKLRF

SEQ ID NO: 3490 - DNA, 450 bp, Triticum aestivum
  misc_feature (1)..(450): useful for making plants with increased salt and oxidative stress resistance as described in USSN 12/922,143
  misc_feature (1)..(450): Ceres CLONE ID no.555540
tttttttcccccgcacacaacccacaacccctccccaacccaccaccggcggcggcgcagcgcgaggaagaggaagcgaagatggtgaagttcctgaagccgggcaaggcggtgatcctgctgcagggcaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcacctccaaggacaagaaggtgggcgccgccaaggccgccaaggccaagctcgaggagcggttc

SEQ ID NO: 3491 - protein, 137 aa, Triticum aestivum
  misc_feature (1)..(137): useful for making plants with increased salt and oxidative stress resistance as described in USSN 12/922,143
  misc_feature (1)..(137): Ceres CLONE ID no.555540
  misc_feature (1)..(137): Bit score of 307.6 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
  misc_feature (127)..(127): Xaa is any aa, unknown or other
  misc_feature (133)..(133): Xaa is any aa, unknown or other
  misc_feature (134)..(134): Xaa is any aa, unknown or other
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVGAAKAAKAKLEERFKTGXNRWFFXXLRF

SEQ ID NO: 3492 - DNA, 723 bp, Zea mays
  misc_feature (1)..(723): useful for making plants with increased salt and oxidative stress resistance as described in USSN 12/922,143
  misc_feature (1)..(723): Ceres CLONE ID no.1450693
ggcgataaacaagacgaaggagagggatctacacaagtgaagcaacaatggtgaagttcttgaagcagaacaaggcagtgatcctcctccaaggccgatacgccgggaagaaggcggtgatcatccgttccttcgacgacggaaaccgcgagcgtccttacgggcactgcctcgttgccgggctcaagaagtaccccagcaaggtcatccgcaaggactcagcgaagaagacggcgaagaaatctagggttaagtgtttcatcaaggtcgtcaactaccagcatctgatgcctacgcgttacaccctcgatgtggatctcaaggaagtcgcgaccctcgaggctctgtcttcaaaggacaagaaggtcgctgctctcaaggaggctaaggctaagctcgaggagcgtttcaagaccgggaagaacagatggttctttaccaaactcaggttctgaaggaatcactgtcggaagaaacattctgagcttattttgttgtttcattttcttatccaatatttaaaacagcgtattattgttagtttctatggttcatatggagaacaatgtggatccttttttgggttgtgaaagacttttgttggaaatttctgttctggagtttgattctctatggcattttgattacctctttgcttccattgaatgattttgctttggattttgtgataatttgagtattagtaatgactaccttacgctt

SEQ ID NO: 3493 - protein, 135 aa, Zea mays; identical to SEQ ID NO: 3474
  misc_feature (1)..(135): useful for making plants with increased salt and oxidative stress resistance as described in USSN 12/922,143
  misc_feature (1)..(135): Ceres CLONE ID no.1450693
  misc_feature (1)..(135): Bit score of 329.9 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495

SEQ ID NO: 3494 - DNA, 1136 bp, Zea mays
  misc_feature (1)..(1136): useful for making plants with increased salt and oxidative stress resistance as described in USSN 12/922,143
  misc_feature (1)..(1136): Ceres CLONE ID no.292350
atcgagagcctaggaagtgagacgagcctgcagattccggtgaggtcaggcgccctgcgcctgctgttgagggagagcgagggacacccaccgccaccgtgtgcatctgtgtcgtgaggagagagtgcggtggttcgccgaacagcgaaggatccgtgcgcccccccatatctggccttcatcgccgatttggagtctgcgggtggtcgagggcgctcggccgaacgtgtggagctccgttgtagagagaagttgagggatggatcgcaggactgctatgtgctcgtcgcggtggtgaacggaagtcttctcggcgtccaatttggtggtggcaggggcggtgctgggcgagccctcgccggacatcgcactccatggcagaatctgtgccaccatgtgccgtgaatcatgctgctgcgcaccgtgggcagccatgcctgtgcttcgtgtcatggagaagaacaggtggttcaagaggagccgcatatcgaggagttcgattcgatctaggtggcgtctcctcttgacacacctcccaaaccctacactcccggcggcggcggcggcggcgcagcagcggcagcagcatccgaagatggtgaagttcctcaagcccggcaaggccgttatcctcctccagggccgcttcgccggcaggaaggcagttatcgtgcgcgtgttcgaggagggcacccgcgaccgcccctatggccactgcctcgtcgcaggcctcgccaagtacccaaagaaggtgatccgcaaggactccgccaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttcaagaccggcaagaacaggtggttctttaccaagctccgcttctagatgctcggcctcccgaatagtcctgctttagctgtcgatttgttgtatcggacacactccatctctgttttcgtattaccatgaatatttcgtgtttagtcctggggctctcagagataaatttgcc

SEQ ID NO: 3495 - protein, 137 aa, Zea mays
  misc_feature (1)..(137): useful for making plants with increased salt and oxidative stress resistance as described in USSN 12/922,143
  misc_feature (1)..(137): Ceres CLONE ID no.292350
  misc_feature (1)..(137): Bit score of 323.9 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVATGGPDALSTHDKKVAACKTAKARLEERFKTGKNRWFFTKLRF

SEQ ID NO: 3496 - DNA, 982 bp, Zea mays
  misc_feature (1)..(982): useful for making plants with increased salt and oxidative stress resistance as described in USSN 12/922,143
  misc_feature (1)..(982): Ceres CLONE ID no.1283569
gatttgacccatctcccaacccctacactcccggcggcggcgcaggagcagcagcaccagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctcgccaagtaccccaagaaggtggtccgcagggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaaggtcgccgcatgcaaggccgccaaggcgcgcctcgaggagaggttcaagaccggcaagaacaggtggttctttaccaagctccgcttctagatggtcggcgtcccgaatggtgaccgtcggtttcttgtatgggacacactccaagccatgtctcttttcgtattgccatgaagacttcttcgtgtttagtcctggggctctcaggtatattgtgcgtgtgtacttcgaatgtttggtcttggagtcctactgaattgatgaatgttcaatttatgtcttcaggattaacagcgaatattgtttacaatcttatttatcccattggttagtttgttaaacttttaatattgagttgattgtgaactgtcatagtagcctatgaaagtactgtcattgctgatacttatcttgcttcactctatttgcccactcaagtagtcatttgtcctctcaaataggcattcaaggacattgttacatgagtgtcctgctttccattatcgtttagtaagaatttctctcctggcccttgtaataatactgttgttttacactgtagacatcactgcagagtttagtagaacatatg

SEQ ID NO: 3497 - protein, 137 aa, Zea mays
  misc_feature (1)..(137): useful for making plants with increased salt and oxidative stress resistance as described in USSN 12/922,143
  misc_feature (1)..(137): Ceres CLONE ID no.1283569
  misc_feature (1)..(137): Bit score of 324.0 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKPGKAVILLQGRFAGRKAVIVRVFEEGTRDRPYGHCLVAGLAKYPKKVVRRDSAKKTAKKSRVKCFIKLVNFTHLMPTRYTLDVDFKDVATGGPDALSTRDKKVAACKAAKARLEERFKTGKNRWFFTKLRF

SEQ ID NO: 3498 - DNA, 651 bp, Zea mays
  misc_feature (1)..(651): useful for making plants with increased salt and oxidative stress resistance as described in USSN 12/922,143
  misc_feature (1)..(651): Ceres CLONE ID no.273754
gtttccctcttccccccactacccaaacccaacaggcggcgcagcagcatcgccaccaccgtccaaagatggtgaagttcctcaagcccggcaaggccgttatcctcctccagggccggttcgccggccggaaggccgtgatcgtgcgcgttttcgaggagggcacccgtgatcgtccctacgggcactgcctcgtcgcgggcctcgccaagtaccccaagaaggtgatccgcaaggactccgccaagaagacggccaagaagtcccgcgtcaagtgcttcatcaagctcgtcaacttcacgcacctcatgcccacccgctacaccctcgacgtcgacttcaaggacgtcgcatcgggcgggcccgacgcgctctccacccgggacaagaaggtcgaagcctgcaaggccgccaaggcgcgcctcgaggagaggttcaagaccggcaagaacaggtggttctttaccaaactccgcttctagacgtcgggcgtccctcatagtgtctgatttagttgtcaatttcttgtacctgaaaccctttaaggtatctctgttttgctatttccatgaaggcttcgtgcttggtatggatcttggagaggattttgttaaaaacatgtcgatgatgttaaattatgccaaagcacgc

SEQ ID NO: 3499 - protein, 137 aa, Zea mays
  misc_feature (1)..(137): useful for making plants with increased salt and oxidative stress resistance as described in USSN 12/922,143
  misc_feature (1)..(137): Ceres CLONE ID no.273754
  misc_feature (1)..(137): Bit score of 325.8 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVEACKAAKARLEERFKTGKNRWFFTKLRF

SEQ ID NO: 3500 - DNA, 489 bp, Zea mays
  misc_feature (1)..(489): useful for making plants with increased salt and oxidative stress resistance as described in USSN 12/922,143
  misc_feature (1)..(489): Ceres CLONE ID no.376108
accctattaatcctcgtccctctcgcgcacagcgctccaatttcctccacctcccgaaccctaccggcggcgcagcagcatcacaaccaccacccgaagatggtgaagtttctgaagcccggcaaggccgtaatcctcctccagggcagattcgccggccggaaggcggtgatcgtgcgcgtgttcgaggagggcacccgcgaccgtccctatgggcactgcctcgtcgccggcctggccaagtaccccaagaaggtgatccgcaaggactccgccaagaagacggccaagaagtcccgcgtcaagtgcttcatcaagctcgtcaatttcactcacctcatgcccacccgctacaccctcgacgtcgacttcaaggacgtcgcctcgggcgggcccgacgcgctctccacccgggacaagaaggtcgaggcctgcaaggccgccaaggcgcgcctcgaggagaggttcaagaccggcaagaacaggtgg

SEQ ID NO: 3501 - protein, 158 aa, Zea mays
  misc_feature (1)..(158): useful for making plants with increased salt and oxidative stress resistance as described in USSN 12/922,143
  misc_feature (1)..(158): Ceres CLONE ID no.376108
  misc_feature (1)..(158): Bit score of 302.8 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(158): Functional Homolog Of Ceres CLONE ID no. 547495
  misc_feature (90)..(90): Xaa is any aa, unknown or other
  misc_feature (97)..(97): Xaa is any aa, unknown or other
  misc_feature (125)..(125): Xaa is any aa, unknown or other
  misc_feature (130)..(130): Xaa is any aa, unknown or other
MVKFLKPGKAVILLQGRFAGRKAVIVRVFEEGTRDRPYGHCLVAGLAKYPKKVIRKDSAKKTAKKSRVKCFIKLVNFTHLMPTRYTLDVXFKDVASXGPDALSTRDKKVEACKAAKARLEERFKXGKNRXFFPKFRFWGPGPPQRDCFSCQFVVWETI

SEQ ID NO: 3502 - DNA, 591 bp, Musa acuminata
  misc_feature (1)..(591): useful for making plants with increased salt and oxidative stress resistance as described in USSN 12/922,143
  misc_feature (1)..(591): Ceres CLONE ID no.1731902
aaaagaggagaagatggtgaagtttctgaagccgaacaaggcggtgatcatccttcaagggcgattcgctgggaggaaggcagtgatcgtgcgggccttcgacgacggcactcgggagcggccttacgggcactgcctggtggccggcgtcgccaagtacccgaagaaggtcatccgcaaggactcggcgaagaagacggccaagaagtcgcgggtgaaggcgttcctgaagctggtcaattatagccatatcatgcccacccgctacaccctcgacgtcgatctcaaggacgtcgtcaccgccgattcccttcagtcccgcgacaagaaggtcaccgcctgcaaggataccaaggcccgcctcgaggaacgcttcaagactggtaagaaccggtggttcttcaccaagctaaggttctaatctcttctagcccacttttcttagatctatctaccagtaatatttctactgcttccatcatcgtctgtcgagatctatagcgttctatggggtttttagtctcattttggttcatcggaggacgaaactgattttatcatggatcgaatgacattttacaactgttgctt

SEQ ID NO: 3503 - protein, 135 aa, Musa acuminata
  misc_feature (1)..(135): useful for making plants with increased salt and oxidative stress resistance as described in USSN 12/922,143
  misc_feature (1)..(135): Ceres CLONE ID no.1731902
  misc_feature (1)..(135): Bit score of 335.5 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKPNKAVIILQGRFAGRKAVIVRAFDDGTRERPYGHCLVAGVAKYPKKVIRKDSAKKTAKKSRVKAFLKLVNYSHIMPTRYTLDVDLKDVVTADSLQSRDKKVTACKDTKARLEERFKTGKNRWFFTKLRF

SEQ ID NO: 3504 - DNA, 688 bp, Panicum virgatum
  misc_feature (1)..(688): useful for making plants with increased salt and oxidative stress resistance as described in USSN 12/922,143
  misc_feature (1)..(688): Ceres CLONE ID no.1760193
gtccctccctcgcccaccatttttgtccacctcctgagccctccccaccctccaaccccggcggcggcagcggcggcggcgcagcagcagcagcagcagtagctgaagatggtgaagttcctgaagcccggcaaggccgtgatcctccttcagggccggttcgccggccggaaggcggtgatcgtgcgcgtgttcgaggagggcacacgcgaccgcccctacgggcactgcctcgtcgccggcctcgccaagtatcccaagaaggtgatccgcaaggactccgccaagaagacggccaagaagtcccgtgtcaagtgcttcatcaagctcgttaacttcacccacctcatgcccacccgctacacccttgacgtcgacttcaaggacgtcgcctcgggcgggcccgacgcgctctccacccgggacaagaaggtcgccgcctgcaaggccgcgaaggcccgcctcgaggagaggttcaagacaggcaagaacaggtggttctttaccaagctccgcttctagatgccaggcgtccagcatagtacctgctttagttgtcaatttcatgtatcggacacccttatctctgttttggtattgccgtgaagacttcgtgcttactgttatggatcttggagacgatgtcatgtggatgatgtgtcgaatgatgccaatcatagatcctgtc

SEQ ID NO: 3505 - protein, 137 aa, Panicum virgatum
  misc_feature (1)..(137): useful for making plants with increased salt and oxidative stress resistance as described in USSN 12/922,143
  misc_feature (1)..(137): Ceres CLONE ID no.1760193
  misc_feature (1)..(137): Bit score of 325.1 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVAACKAAKARLEERFKTGKNRWFFTKLRF

SEQ ID NO: 3506 - DNA, 656 bp, Panicum virgatum
  misc_feature (1)..(656): useful for making plants with increased salt and oxidative stress resistance as described in USSN 12/922,143
  misc_feature (1)..(656): Ceres CLONE ID no.1762010
atttttttctccacctcccgtgccctccccccaccttcccacctctgcggcgcagcagcagcagctgaagatggtgaagttcctgaagcccggcaaggccgtgatcgtccttcagggtcggttcgccggccggaaggcggtgatcgtgcgcgtgttcgaggagggcacccgcgaccgcccctacgggcactgcctcgtcgccggcctcgccaagtaccccaagaaggtgatccgcaaggactctgccaagaagacggccaagaagtcccgggtcaagtgcttcatcaagctcgtaaacttcacccacatcatgcccacccgctacacccttgacgtcgactttaaggacgtcgcctcgggcgggcccgacgcgctctccacccgggacaagaaggtcgccgcctgcaaggccgcgaagtaccgcctcgaggagaggttcaagacaggcaagaacaggtggttctttaccaagctccgcttctagatgccgggcgtccagcatagtacctgctttagttgtcaatttcatgtgtcagacacccttatctctgttttggtattgccattaagacttcgtgcttatggatcttggagagtatgacatgtcgatgatgtgttaaatgatgtcaatcatagatcttgtccaaattttgttc

SEQ ID NO: 3507 - protein, 137 aa, Panicum virgatum
  misc_feature (1)..(137): useful for making plants with increased salt and oxidative stress resistance as described in USSN 12/922,143
  misc_feature (1)..(137): Ceres CLONE ID no.1762010
  misc_feature (1)..(137): Bit score of 322.6 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKPGKAVIVLQGRFAGRKAVIVRVFEEGTRDRPYGHCLVAGLAKYPKKVIRKDSAKKTAKKSRVKCFIKLVNFTHIMPTRYTLDVDFKDVASGGPDALSTRDKKVAACKAAKYRLEERFKTGKNRWFFTKLRF

SEQ ID NO: 3508 - DNA, 686 bp, Panicum virgatum
  misc_feature (1)..(686): useful for making plants with increased salt and oxidative stress resistance as described in USSN 12/922,143
  misc_feature (1)..(686): Ceres CLONE ID no.1759699
gccatttcctcaaccgaagccctacccacccatccaccccggcagcggcggcggcgtagcagcagcagaagcacccgaagatggtgaagttcctgaagcccggcaaggccgtgatcctcctccagggccggttcgccggccgcaaggcggtgatcgtgcgcgtgttcgaagagggtacccgcgaccgcccctacggccactgcctcgtcgccggcctggccaagtaccccaagaaggtgatccgcaaggactccaccaagaagaccgccaagaagtcccgcgtcaagtgcttcatcaagctcgtcaacttcacccacatcatgcccacccgctacacgctggacgtcgacttcaaggacgtcgcctcgggcgggcccgacgcgctctctacccgggacaataaggtcgccgcttgcaaggccgccaaggcgcgcctcgaggagaggttcaagaccggcaagaacaggtggttctttaccaagctccgcttctagatgcttggcgtcccgcatagtgcctgctttaggtgtcagtttcttgtatcggacactctttaagctatctctgctttggtattgccatgaagacttcgtgcttagtattacggatctaggagataattttattaagacatgttgttgatgtgctaaatgttgtcaatcatagatctggctgaaattttgttc

SEQ ID NO: 3509 - protein, 137 aa, Panicum virgatum
  misc_feature (1)..(137): useful for making plants with increased salt and oxidative stress resistance as described in USSN 12/922,143
  misc_feature (1)..(137): Ceres CLONE ID no.1759699
  misc_feature (1)..(137): Bit score of 321.5 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKPGKAVILLQGRFAGRKAVIVRVFEEGTRDRPYGHCLVAGLAKYPKKVIRKDSTKKTAKKSRVKCFIKLVNFTHIMPTRYTLDVDFKDVASGGPDALSTRDNKVAACKAAKARLEERFKTGKNRWFFTKLRF

SEQ ID NO: 3510 - DNA, 614 bp, Panicum virgatum
  misc_feature (1)..(614): useful for making plants with increased salt and oxidative stress resistance as described in USSN 12/922,143
  misc_feature (1)..(614): Ceres CLONE ID no.2028803
ctcttttcgtctcggtagcaggacgaggacctatcatcatggtgaagttcctcaagcccgggaaagtggtcgtggtcttgtctggtcggttcgccggcaagaaggctgtcatcgtgaggaaccacgatgatgggacaaccggccgcccatatgggtgcgctctgcttgtcggcctgcgcaaggagccccgcaaggtgaccaagaggcagacagccaagaggcaggcgaagaagtctaccctcaagacattcatcaagactgtgaactacaaccacttgatgccaactcgctataccctggacgtggatttcagcaagtccatcacagccgaggttgtggagaacagcacaaagaaggtcgaggccagcaaggaggccaagaagctgctggaggagaagttcaagactggcaagaacaggtggttcttcaccaagttgcgcttctaagctgttctctttgcgtcaacatctcagtacaacatccaccccttctttcaccattatctggggcaccatcacaggtcacctcaagctgggcataatgccttgttcaagggcacgcactgggatcccatgatgttgtagtgtcctgcttatggtgtaaagattcttacc

SEQ ID NO: 3511 - protein, 135 aa, Panicum virgatum
  misc_feature (1)..(135): useful for making plants with increased salt and oxidative stress resistance as described in USSN 12/922,143
  misc_feature (1)..(135): Ceres CLONE ID no.2028803
  misc_feature (1)..(135): Bit score of 273.7 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(32): Pfam Name: KOW Pfam Description: KOW motif
  misc_feature (1)..(135): Functional Homolog Of Ceres CLONE ID no. 547495
MVKFLKPGKVVVVLSGRFAGKKAVIVRNHDDGTTGRPYGCALLVGLRKEPRKVTKRQTAKRQAKKSTLKTFIKTVNYNHLMPTRYTLDVDFSKSITAEVVENSTKKVEASKEAKKLLEEKFKTGKNRWFFTKLRF

SEQ ID NO: 3512 - protein, 137 aa, Oryza sativa subsp. japonica
  misc_feature (1)..(137): useful for making plants with increased salt and oxidative stress resistance as described in USSN 12/922,143
  misc_feature (1)..(137): Public GI ID no.115445581
  misc_feature (1)..(137): Bit score of 324.4 for HMM based on sequences of FIGURE 4 of USSN 12/922,143.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of Ceres CLONE ID no. 547495
MVKFLKPGKAVILLQGRYAGRKAVIVRVFEEGTRDRPYGHCLVAGLAKYPKKVIRKDSAKKTAKKSRVKCFLKLVNFTHIMPTRYTLDVDFKDVASGGPDALATRDKKVAACKAAKARLEERFKTGKNRWFFTKLRF

SEQ ID NO: 3513 - protein, 136 aa, Oryza sativa subsp. japonica
  misc_feature (1)..(136): useful for making plants with increased salt and oxidative stress resistance as described in USSN 12/922,143
  misc_feature (1)..(136): Public GI ID no.115483480
  misc_feature (1)..(136): Bit score of 320.1 for HMM based on sequences of FIGURE 4 of USSN 12/922,143.
  misc_feature (52)..(136): Pfam Name: Ribosomal_L27e Pfam Description: Ribosomal L27e protein family
  misc_feature (7)..(40): Pfam Name: KOW Pfam Description: KOW motif
  misc_feature (1)..(136): Functional Homolog Of Ceres CLONE ID no. 547495
MVKFLKPGKAVILLQGRFAGRKAVIVRVFEEGTRDRPYGHCLVAGLAKYPKKVIRKDSAKKTAKKSRVKCFLKLVNFTHLMPTRYTLDVDLKEVAAGPDALATRDKKVAACKSAKARLEDRFKTGKNRWFFTKLRF

SEQ ID NO: 3514 - protein, 135 aa, Chara globularis
  misc_feature (1)..(135): useful for making plants with increased salt and oxidative stress resistance as described in USSN 12/922,143
  misc_feature (1)..(135): Public GI ID no.50843988
  misc_feature (1)..(135): Bit score of 301.3 for HMM based on sequences of FIGURE 4 of USSN 12/922,143.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of Ceres CLONE ID no. 547495
MVKFLKQNKVVVLLNGRYAGHKAVIVKNFDGGTGGRPYGHALVAGIAKYPRKVTKRLSEKKLAKRARLKPFIKVINYNHIMPTRYALDVDLKTTVIPEKLETQAKKVETRKEVKKILEERFKTGKNRWFFSKLRF

SEQ ID NO: 3515 - DNA, 469 bp, Glycine max
  misc_feature (1)..(469): useful for making plants with increased salt and oxidative stress resistance as described in USSN 12/922,143
  misc_feature (1)..(469): Ceres CLONE ID no.560692
  misc_feature (1)..(469): Inplanta Sequence
gaggaggaaaaaagaccagcggttgacgatgaaacagaagtgtcttgttgttctggtctttgttgttctcttggcttgtgcgtttggttgggatgagggtatacccggcggatggaaccccatcaagaacattaacgatcctcacgtgacggagatcgcgaatttcgccgtgacggaatacgataagcaatccggtgagaagctaaagttggtgaaggttatcaaaggcgaccttcaggtagtagcaggcctcaactaccgcctcagcctcaccgccagcgactccaacaattaccaagcaattgtctatgagaaggcgtgggcccgggagcattacagaaaccttacctcctttacccctcttcatgcttaacctcttttgtcttatcttctctactgtattattttaaccaataaaaaggttaagtgaatgagaatggcctctttatctcaaaaaaaaaaaaaaaaa

SEQ ID NO: 3516 - protein, 114 aa, Glycine max
  misc_feature (1)..(114): useful for making plants with increased salt and oxidative stress resistance as described in USSN 12/922,143
  misc_feature (1)..(114): Ceres CLONE ID no.560692
  misc_feature (1)..(114): Bit score of 259.8 for HMM based on sequences of FIGURE 3 of USSN 12/922,143.
  misc_feature (27)..(87): Pfam Name: Cystatin Pfam Description: Cystatin domain
MKQKCLVVLVFVVLLACAFGWDEGIPGGWNPIKNINDPHVTEIANFAVTEYDKQSGEKLKLVKVIKGDLQVVAGLNYRLSLTASDSNNYQAIVYEKAWAREHYRNLTSFTPLHA

SEQ ID NO: 3517 - protein, 116 aa, Actinidia deliciosa
  misc_feature (1)..(116): useful for making plants with increased salt and oxidative stress resistance as described in USSN 12/922,143
  misc_feature (1)..(116): Public GI ID no.40807635
  misc_feature (1)..(116): Bit score of 251.6 for HMM based on sequences of FIGURE 3 of USSN 12/922,143.
  misc_feature (30)..(89): Pfam Name: Cystatin Pfam Description: Cystatin domain
  misc_feature (1)..(116): Functional Homolog Of Ceres CLONE ID no. 560692
MVPKPLSLLLFLLLALSAAVVGGRKLVAAGGWRPIESLNSAEVQDVAQFAVSEHNKQANDELQYQSVVRGYTQVVAGTNYRLVIAAKDGAVVGNYEAVVWDKPWMHFRNLTSFRKV

SEQ ID NO: 3518 - protein, 115 aa, Actinidia deliciosa
  misc_feature (1)..(115): useful for making plants with increased salt and oxidative stress resistance as described in USSN 12/922,143
  misc_feature (1)..(115): Public GI ID no.40807637
  misc_feature (1)..(115): Bit score of 233.7 for HMM based on sequences of FIGURE 3 of USSN 12/922,143.
  misc_feature (29)..(88): Pfam Name: Cystatin Pfam Description: Cystatin domain
  misc_feature (1)..(115): Functional Homolog Of Ceres CLONE ID no. 560692
MVPKTFSMLLLLIALSAAVVGGRKQVVLGGWRPIKDLNSAEVQDVAQFAVSEHNKQANDKLQYQRVVRGYSQVVAGTNYRLVIAAKDGAVLGKYEAFVWDKPWMQFRNLTSFRKV

SEQ ID NO: 3519 - DNA, 534 bp, Gossypium hirsutum
  misc_feature (1)..(534): useful for making plants with increased salt and oxidative stress resistance as described in USSN 12/922,143
  misc_feature (1)..(534): Ceres CLONE ID no.1798511
agaggctacagctctacagcacaacaaaaaaggcaactagacttgagaaagaaaaacagtctcaaaatgcagcagaagtcaggcttcctgatcctcttgctctccctcattttccttcctctcatcttctccgacgccagaaaggaggctcccctcggaggatggagtccgatcaaagacaccaaggacccacacgtgataaagatcgcggaattcgccgtcgaggagtataacaagcagtcaaatgggagtttaaagttggttaaggtggtgaaaggcgagacccaggtggtggccgggacaaactaccggttgattttgcaggcgaaggaagggaccttcgataacacgtataaggctgtggtgtgggagaagttgtggctgaatttcaggaatctcacctcctttaacctcgtcaagggttagatttgattataatgtaatttatgttcatatatgttatccttgtccttttctattacttaacagagtggagaataaaatcttaataatacataattatgtgagtttgag

SEQ ID NO: 3520 - protein, 119 aa, Gossypium hirsutum
  misc_feature (1)..(119): useful for making plants with increased salt and oxidative stress resistance as described in USSN 12/922,143
  misc_feature (1)..(119): Ceres CLONE ID no.1798511
  misc_feature (1)..(119): Bit score of 275.6 for HMM based on sequences of FIGURE 3 of USSN 12/922,143.
  misc_feature (31)..(118): Pfam Name: Cystatin Pfam Description: Cystatin domain
  misc_feature (1)..(119): Functional Homolog Of Ceres CLONE ID no. 560692
MQQKSGFLILLLSLIFLPLIFSDARKEAPLGGWSPIKDTKDPHVIKIAEFAVEEYNKQSNGSLKLVKVVKGETQVVAGTNYRLILQAKEGTFDNTYKAVVWEKLWLNFRNLTSFNLVKG

SEQ ID NO: 3521 - DNA, 1047 bp, Gossypium hirsutum
  misc_feature (1)..(1047): useful for making plants with increased salt and oxidative stress resistance as described in USSN 12/922,143
  misc_feature (1)..(1047): Ceres CLONE ID no.1793376
agaggctaccgctctaccgcacaacaaaaaaggcaactagacttgagaaagaaaaaccgtctccaaatgcagcagaagtccggcttcctgatcctcttgctctccctccttttccttcctctcctcttctccgacgccagaaaggaggctcccctcggaggatggagtcccatcaaagacaccaaggacccccacgtgataaagatcgcggaattcgccgtcgaggagtataacaagcagtcaaatgggagtttaaagttggttaaggtggtgaaaggcgagacccaggtggtggccgggacaaactaccggttgattttgcaggcgaaggaagggaccttcgataacacgtataaggctgtggtgtgggagaagttgtggctgaatttcaggaatctcacctcctttaacctcgtcaagggttagatttgattataatgtaatttatgttcatatatgttatccttgtccttttctattacttaacagagtggagaaactgcaccaactcttcgcccttctgtaaaattccctcaaaagagaagaagaagaaaataccaataactatcagctaacgatgagttattacaatcagcaacagcctcccgttggcgttcctcctcctcaaggttatccaccggaaggttatcctccaaaggatgcttatccaccaccagggtatcccccacaaggatatcctcaaggttatcctcaacagggataccctccgcagggatatcctcctcaatatgctcagcctcctcctcctcagcaaaagcagagttcgggtttcgtagaaggctgtttggctgctctttgctgttgctgtcttctggatgcttgtttttgactaccttttctccaatggcagcttagaaaaatattgaattgataggagagttgaattcaattaccattttcaaacttcaatttcaaatgttcttctttcccttcatcgctttttttctgcttaataattgaacccttcattggatttgaactcttgtttacatacactgtaatattaggatctttttcctttgttct

SEQ ID NO: 3522 - protein, 119 aa, Gossypium hirsutum
  misc_feature (1)..(119): useful for making plants with increased salt and oxidative stress resistance as described in USSN 12/922,143
  misc_feature (1)..(119): Ceres CLONE ID no.1793376
  misc_feature (1)..(119): Bit score of 275.7 for HMM based on sequences of FIGURE 3 of USSN 12/922,143.
  misc_feature (31)..(118): Pfam Name: Cystatin Pfam Description: Cystatin domain
  misc_feature (1)..(119): Functional Homolog Of Ceres CLONE ID no. 560692
MQQKSGFLILLLSLLFLPLLFSDARKEAPLGGWSPIKDTKDPHVIKIAEFAVEEYNKQSNGSLKLVKVVKGETQVVAGTNYRLILQAKEGTFDNTYKAVVWEKLWLNFRNLTSFNLVKG

SEQ ID NO: 3523 - DNA, 342 bp, Populus balsamifera subsp. trichocarpa
  misc_feature (1)..(342): useful for making plants with increased salt and oxidative stress resistance as described in USSN 12/922,143
  misc_feature (1)..(342): Ceres ANNOT ID no.1453285
atgaaacgacaaatactaaccctctccctcctcttcatcgctgtaaccgtcgtggtggttgacgcggcgctcctcggcggatggagtccgataaaggacttgaaagacaagcacgtggtagagatcgcggagttcgccgttgcagagcataacaaggaagccaaatcaaatttgatgcttgagagtatcgttaaaggcgaatcgcaggtggtatcgggtacgaattatcggctcgttttggcagtgaaaggaagggctaatgccacgtaccaggctgttgtgtatgagaaaccttgggagaatttgaagagtctgacgtcgtttcaaccttttaaaggttga

SEQ ID NO: 3524 - protein, 113 aa, Populus balsamifera subsp. trichocarpa
  misc_feature (1)..(113): useful for making plants with increased salt and oxidative stress resistance as described in USSN 12/922,143
  misc_feature (1)..(113): Ceres ANNOT ID no.1453285
  misc_feature (1)..(113): Bit score of 245.7 for HMM based on sequences of FIGURE 3 of USSN 12/922,143.
  misc_feature (26)..(112): Pfam Name: Cystatin Pfam Description: Cystatin domain
  misc_feature (1)..(113): Functional Homolog Of Ceres CLONE ID no. 560692
MKRQILTLSLLFIAVTVVVVDAALLGGWSPIKDLKDKHVVEIAEFAVAEHNKEAKSNLMLESIVKGESQVVSGTNYRLVLAVKGRANATYQAVVYEKPWENLKSLTSFQPFKG

SEQ ID NO: 3525 - DNA, 548 bp, Arabidopsis thaliana
  misc_feature (1)..(548): useful for making plants with increased salt and oxidative stress resistance as described in USSN 12/922,143
  misc_feature (1)..(548): Ceres CLONE ID no.31680
aattttgaggaaacaacagttacaaagcaaaatgactagtaaggtcgtcttccttcttctcctctctctcgtcgtcctcctcctccctctctacgcctctgcggctgcccgtgtcggtggctggagtcccatcagcaacgttacggaccctcaagtcgtagagatcggtgaattcgcggtctccgagtacaacaaacggagcgaatcgggactcaagttcgagacggttgttagcggcgagactcaggtcgtatctggtacaaattaccgtcttaaggtggcggctaatgacggcgacggagtgagcaagaactacttggcaatcgtatgggacaagccgtggatgaaattcagaaatctcacttccttcgagcctgccaataatggtcgcttcctttaagcttttaacatgtaacccgctctttattaatattgcagaaacattaaaaacaaaggagttaaaataaacataagacaattattgtgtctattttatgtatttctatagttttcaaaatatgcaaatctgaagaaatgatgattgaacc

SEQ ID NO: 3526 - protein, 122 aa, Arabidopsis thaliana
  misc_feature (1)..(122): useful for making plants with increased salt and oxidative stress resistance as described in USSN 12/922,143
  misc_feature (1)..(122): Ceres CLONE ID no.31680
  misc_feature (1)..(122): Bit score of 267.1 for HMM based on sequences of FIGURE 3 of USSN 12/922,143.
  misc_feature (29)..(117): Pfam Name: Cystatin Pfam Description: Cystatin domain
  misc_feature (1)..(122): Functional Homolog Of Ceres CLONE ID no. 560692
MTSKVVFLLLLSLVVLLLPLYASAAARVGGWSPISNVTDPQVVEIGEFAVSEYNKRSESGLKFETVVSGETQVVSGTNYRLKVAANDGDGVSKNYLAIVWDKPWMKFRNLTSFEPANNGRFL

SEQ ID NO: 3527 - DNA, 444 bp, Brassica napus
  misc_feature (1)..(444): useful for making plants with increased salt and oxidative stress resistance as described in USSN 12/922,143
  misc_feature (1)..(444): Ceres CLONE ID no.1117567
ataactgaggaggaaaaaagaccagcggttgacgatgaaacagaagtgtcttgttgttctggtctttgttgttctcttggcttgtgcggttggttgggatgagggtatacccggcggatggaaccccatcaagaacattaacgatcctcacgtgacggagatcgcgaatttcgccgtgacggaatacgataagcaatccggtgagaagctaaagttggtgaaggttatcaaaggcgaccttcaggtagtagcaggcctcaactaccgcctcagcctcaccgccagcgactccaacaattaccaagcaattgtctatgagaaggcgtgggcccgggagcattacagaaaccttacctcctttacccctcttcatgcttaacctcttttgtcttatcttctctactgtattattttaaccaataaaaaggtaagtgaatgagaatg

SEQ ID NO: 3528 - protein, 114 aa, Brassica napus
  misc_feature (1)..(114): useful for making plants with increased salt and oxidative stress resistance as described in USSN 12/922,143
  misc_feature (1)..(114): Ceres CLONE ID no.1117567
  misc_feature (1)..(114): Bit score of 260.5 for HMM based on sequences of FIGURE 3 of USSN 12/922,143.
  misc_feature (27)..(87): Pfam Name: Cystatin Pfam Description: Cystatin domain
  misc_feature (1)..(114): Functional Homolog Of Ceres CLONE ID no. 560692
MKQKCLVVLVFVVLLACAVGWDEGIPGGWNPIKNINDPHVTEIANFAVTEYDKQSGEKLKLVKVIKGDLQVVAGLNYRLSLTASDSNNYQAIVYEKAWAREHYRNLTSFTPLHA

SEQ ID NO: 3529 - protein, 115 aa, Brassica oleracea
  misc_feature (1)..(115): useful for making plants with increased salt and oxidative stress resistance as described in USSN 12/922,143
  misc_feature (1)..(115): Public GI ID no.89257437
  misc_feature (1)..(115): Bit score of 240.9 for HMM based on sequences of FIGURE 3 of USSN 12/922,143.
  misc_feature (24)..(115): Pfam Name: Cystatin Pfam Description: Cystatin domain
  misc_feature (1)..(115): Functional Homolog Of Ceres CLONE ID no. 560692
MNSRAIFLLLLLLSFHASAMLPAGRWSPISNVKDPHVVEVGKFAVSEYDMESKSELKFVVVVSGESKVVAGTNYRLIVAVNDGVAGPGASKNYEAIVWEKQWLKSMNLTSFKPVV

SEQ ID NO: 3530 - protein, 114 aa, Medicago truncatula
  misc_feature (1)..(114): useful for making plants with increased salt and oxidative stress resistance as described in USSN 12/922,143
  misc_feature (1)..(114): Public GI ID no.92874200
  misc_feature (1)..(114): Bit score of 243.0 for HMM based on sequences of FIGURE 3 of USSN 12/922,143.
  misc_feature (26)..(101): Pfam Name: Cystatin Pfam Description: Cystatin domain
  misc_feature (1)..(114): Functional Homolog Of Ceres CLONE ID no. 560692
MRLQSVVFLLLGFLATMSVRNQAIAGGWEPIKNINDPHVIDIANYAVTEHDKQAGLNLKLEKVISGETKVVDGIIYCLNITASDGSASNKYNLAVLEKLEQHFRNLTSFVPLQN

SEQ ID NO: 3531 - protein, 113 aa, Medicago truncatula
  misc_feature (1)..(113): useful for making plants with increased salt and oxidative stress resistance as described in USSN 12/922,143
  misc_feature (1)..(113): Public GI ID no.92895016
  misc_feature (1)..(113): Bit score of 134.9 for HMM based on sequences of FIGURE 3 of USSN 12/922,143.
  misc_feature (25)..(78): Pfam Name: Cystatin Pfam Description: Cystatin domain
  misc_feature (1)..(113): Functional Homolog Of Ceres CLONE ID no. 560692
MRFQYLVIFLLVLLASAARNQAIPGGYSPIKNLNDHHLIEIANFAVTEYGKQQGIKQIKLEKITKGETQVVDGTNYRLLLSAIIESMSYPYQAIVYENRLKNFKKLISFVPIN

SEQ ID NO: 3532 - protein, 118 aa, Medicago truncatula
  misc_feature (1)..(118): useful for making plants with increased salt and oxidative stress resistance as described in USSN 12/922,143
  misc_feature (1)..(118): Public GI ID no.92887012
  misc_feature (1)..(118): Bit score of 120.5 for HMM based on sequences of FIGURE 3 of USSN 12/922,143.
  misc_feature (26)..(88): Pfam Name: Cystatin Pfam Description: Cystatin domain
  misc_feature (1)..(118): Functional Homolog Of Ceres CLONE ID no. 560692
MRLESMVLVLVVLLAFTATKQAIPIGNLSPINNINDPKVIDVANFAVKEYNNRRRKPEEKLRLWKVIKGESQIVADGVNYRLTLSATKVYTSNTYEAIVLEWSLQHLRNLTSFKLIQA

SEQ ID NO: 3533 - protein, 111 aa, Medicago truncatula
  misc_feature (1)..(111): useful for making plants with increased salt and oxidative stress resistance as described in USSN 12/922,143
  misc_feature (1)..(111): Public GI ID no.87241056
  misc_feature (1)..(111): Bit score of 68.8 for HMM based on sequences of FIGURE 3 of USSN 12/922,143.
  misc_feature (22)..(109): Pfam Name: Cystatin Pfam Description: Cystatin domain
  misc_feature (1)..(111): Functional Homolog Of Ceres CLONE ID no. 560692
MRFQSLILILIVLFALATTNQATFVDINDSEVIKVATFAVTEYNKQHTKAKLKFEKVINGISNLGNNVTIINYRLTLSANNGSASNNYPAIVLDKSSEIFSLIAFALISHA

SEQ ID NO: 3534 - protein, 117 aa, Oryza sativa subsp. japonica
  misc_feature (1)..(117): useful for making plants with increased salt and oxidative stress resistance as described in USSN 12/922,143
  misc_feature (1)..(117): Public GI ID no.122230834
  misc_feature (1)..(117): Bit score of 233.7 for HMM based on sequences of FIGURE 3 of USSN 12/922,143.
  misc_feature (28)..(84): Pfam Name: Cystatin Pfam Description: Cystatin domain
  misc_feature (1)..(117): Functional Homolog Of Ceres CLONE ID no. 560692
MTMRTSSLLLAAVAVVAIVAGATAATVGSWEPVDINDPHVQELGRWAVAEEDRGVAAGGLTFERVTDGEKQVVAGVNYRLTLEASSSGAKDGRYEAVVYEQDPRSNARKLVSFEPIH

SEQ ID NO: 3535 - DNA, 494 bp, Triticum aestivum
  misc_feature (1)..(494): useful for making plants with increased salt and oxidative stress resistance as described in USSN 12/922,143
  misc_feature (1)..(494): Ceres CLONE ID no.888852
tagaacatcctaatcgaaaaataactgaggaggaaaaaagaccagcggttgacgatgaaacagaagtgtcttgttgttctggtctttgttgttctcttggcttgtgcggttggttgggatgagggtatacccggcggatggaaccccatcaagaacattaacgatcctcacgtgacggagatcgcgaatttcgccgtgacggaatacgataagcaatccggtgagaagctaaagttggtgaaggttatcaaaggcgaccttcaggtagtagcaggcctcaactaccgcctcagcctcaccgccagcgactccaacaattaccaagcaattgtctatgagaaggcgtgggcccgggagcattacagaaaccttacctcctttacccctcttcatgcttaacctcttttgtcttatcttctctactgtattattttaaccaataaaaaggttaagtgaatgagaatggcctctttatcttaatttatttttattac

SEQ ID NO: 3536 - protein, 114 aa, Triticum aestivum; identical to SEQ ID NO: 3528
  misc_feature (1)..(114): useful for making plants with increased salt and oxidative stress resistance as described in USSN 12/922,143
  misc_feature (1)..(114): Ceres CLONE ID no.888852
  misc_feature (1)..(114): Bit score of 260.5 for HMM based on sequences of FIGURE 3 of USSN 12/922,143.
  misc_feature (27)..(87): Pfam Name: Cystatin Pfam Description: Cystatin domain
  misc_feature (1)..(114): Functional Homolog Of Ceres CLONE ID no. 560692

SEQ ID NO: 3537 - DNA, 636 bp, Zea mays
  misc_feature (1)..(636): useful for making plants with increased salt and oxidative stress resistance as described in USSN 12/922,143
  misc_feature (1)..(636): Ceres CLONE ID no.1389074
atccagcatttgtttgacaatgagacatcagtgcctccttctggtctccctggtgttggtctcctacgctgcccggtcggaatcagcgctgggcggctggagccccatcaaggacgtaaacgacagccacgtggcggagatcgccaactacgcgctgagcgagtacgacaagcgttctggggccaagctcacccttgtcaaggtcgtcaagggcgagactcaggtcgtttccggcaccaactaccgtctcgtcctcaaagccaaggatggatccgccacggccagttacgaagccatcgtctgggagaagccttggctccatttcatgaatctcacttccttcaaaccccttcattaatcttagacccatacttttcttcactttctctcttatcatatttcatgtgttagctattctgtttttctcaataaggttcctgtcatgtgctaatgaatctcaaattgtatgttggattatggattcctctattctctcgctctcgggtttttctggaaattttgtttgtggtttctgcttttcaggttttcatatttatttctgtgggcgattcgactttgtaatttcaatgtctaagtgtgtatttagttacccatatcaatttgaaatagtaattt

SEQ ID NO: 3538 - protein, 112 aa, Zea mays
  misc_feature (1)..(112): useful for making plants with increased salt and oxidative stress resistance as described in USSN 12/922,143
  misc_feature (1)..(112): Ceres CLONE ID no.1389074
  misc_feature (1)..(112): Bit score of 262.6 for HMM based on sequences of FIGURE 3 of USSN 12/922,143.
  misc_feature (25)..(112): Pfam Name: Cystatin Pfam Description: Cystatin domain
  misc_feature (1)..(112): Functional Homolog Of Ceres CLONE ID no. 560692
MRHQCLLLVSLVLVSYAARSESALGGWSPIKDVNDSHVAEIANYALSEYDKRSGAKLTLVKVVKGETQVVSGTNYRLVLKAKDGSATASYEAIVWEKPWLHFMNLTSFKPLH

SEQ ID NO: 3539 - protein, 118 aa, Citrus x paradisi
  misc_feature (1)..(118): useful for making plants with increased salt and oxidative stress resistance as described in USSN 12/922,143
  misc_feature (1)..(118): Public GI ID no.11596186
  misc_feature (1)..(118): Bit score of 271.5 for HMM based on sequences of FIGURE 3 of USSN 12/922,143.
  misc_feature (30)..(117): Pfam Name: Cystatin Pfam Description: Cystatin domain
  misc_feature (1)..(118): Functional Homolog Of Ceres CLONE ID no. 560692
MNQRFCCLIVLFLSVVPLLAAGDRKGALVGGWKPIEDPKEKHVMEIGQFAVTEYNKQSKSALKFESVEKGETQVVSGTNYRLILVVKDGPSTKKFEAVVWEKPWEHFKSLTSFKPMVK

SEQ ID NO: 3540 - DNA, 771 bp, Panicum virgatum
  misc_feature (1)..(771): useful for making plants with increased salt and oxidative stress resistance as described in USSN 12/922,143
  misc_feature (1)..(771): Ceres CLONE ID no.1771297
agatctccacaccacccgtcgcaagacaatcccccctctaccttctcgacccaatcccaagctcccacccatccggccatgtcgagacccctcctcctctttgccgccctcgccgtcgccgtcgccgcccccgccgtcgccgcccccgcccgcgtggggatgccgggcgggtggagcgcgatcccggacgtgagcgacccgcacatccaggagctgggcgggtgggcactggggcaggcgaagcggacgcggctggccggcgaggggctgcagttccgccgcgtggtgcgcggggagcagcaggtggtgtccgggatgaactaccgcctctacgtcgacgccgcggacgccgcggggcggagcgcgccctacgtcgccgtcgtgtacgagcaggtctggaccagcacccgcgagctcacctccttcagcaaggcgccccgcgccaactgaatcgtccgtccatgccatgatccaccccggtgaccccggatcggcggccgacgacgccggcgtcagcgccctctctttctctcctccatgttaattagtaattacatctagcgaacattactgctgctagtatatgctgccagtgaatgagtactgcgttttactactagttgctgttgtggggttaatctgtgacccagctatgtggatgaacatgcgcgtaatcgatcgaggctgtgtgctagaagtagaactatactgctggacttgtactataatgatgtaatcaagagtttgtgtgcctgtgttggctcttgtgtc

SEQ ID NO: 3541 - protein, 123 aa, Panicum virgatum
  misc_feature (1)..(123): useful for making plants with increased salt and oxidative stress resistance as described in USSN 12/922,143
  misc_feature (1)..(123): Ceres CLONE ID no.1771297
  misc_feature (1)..(123): Bit score of 249.9 for HMM based on sequences of FIGURE 3 of USSN 12/922,143.
  misc_feature (30)..(91): Pfam Name: Cystatin Pfam Description: Cystatin domain
  misc_feature (1)..(123): Functional Homolog Of Ceres CLONE ID no. 560692
MSRPLLLFAALAVAVAAPAVAAPARVGMPGGWSAIPDVSDPHIQELGGWALGQAKRTRLAGEGLQFRRVVRGEQQVVSGMNYRLYVDAADAAGRSAPYVAVVYEQVWTSTRELTSFSKAPRAN

SEQ ID NO: 3542 - protein, 118 aa, Oryza sativa subsp. indica
  misc_feature (1)..(118): useful for making plants with increased salt and oxidative stress resistance as described in USSN 12/922,143
  misc_feature (1)..(118): Public GI ID no.125542858
  misc_feature (1)..(118): Bit score of 169.5 for HMM based on sequences of FIGURE 3 of USSN 12/922,143.
  misc_feature (27)..(84): Pfam Name: Cystatin Pfam Description: Cystatin domain
  misc_feature (1)..(118): Functional Homolog Of Ceres CLONE ID no. 560692
MAMTTRTLLLAAVCDAAVCAAAALPRGWSPIKNIDDPHIQELGRWAITENNRVSPSDELTFHRVTGGEQQVVSGMNYRLEIEAASGGGDVTGSYGAVVFEQEWSNTRKLISFDKNHNF

SEQ ID NO: 3543 - protein, 128 aa, Hordeum vulgare subsp. vulgare
  misc_feature (1)..(128): useful for making plants with increased salt and oxidative stress resistance as described in USSN 12/922,143
  misc_feature (1)..(128): Public GI ID no.109238661
  misc_feature (1)..(128): Bit score of 271.3 for HMM based on sequences of FIGURE 3 of USSN 12/922,143.
  misc_feature (41)..(98): Pfam Name: Cystatin Pfam Description: Cystatin domain
  misc_feature (1)..(128): Functional Homolog Of Ceres CLONE ID no. 560692
MRTSSFLVIIVGVFLYAISSPATGCGERIGNQLWSTTIDNGWEPIRNINDKHIQELGSWAVLEFIKHVNCVLKFNKVVSGRQQLVSGMNYELIINASDFGGKDGKYKAEVYEQKWTSKRELLSFTKVN

SEQ ID NO: 3544 - protein, 115 aa, Actinidia eriantha
  misc_feature (1)..(115): useful for making plants with increased salt and oxidative stress resistance as described in USSN 12/922,143
  misc_feature (1)..(115): Public GI ID no.40807639
  misc_feature (1)..(115): Bit score of 249.1 for HMM based on sequences of FIGURE 3 of USSN 12/922,143.
  misc_feature (29)..(88): Pfam Name: Cystatin Pfam Description: Cystatin domain
  misc_feature (1)..(115): Functional Homolog Of Ceres CLONE ID no. 560692
MVPKPLSLLFLLLALSAAVVGGRKLVAPGGWRPIENLNSAEVQDVAQFAVSEHNKQANDELQYQSVVRGYTQVVSGTNYRLVIAAKDGAVVGNYEAVVWDKPWMHFRNLTSFRKV

SEQ ID NO: 3545 - DNA, 381 bp, Sorghum bicolor
  misc_feature (1)..(381): useful for making plants with increased salt and oxidative stress resistance as described in USSN 12/922,143
  misc_feature (1)..(381): Ceres ANNOT ID no.6067852
atgaggaccctcatttccatgctcgtcgtcgccgccgccgcggtggtcggcctgtgctctgtggctcccgctgcatcagcgcgcggggagccgccggtgccgcaggccgtcggcgggtggaagccgattaatgtgaacgacccccacatccaagagctcggccgctgggcggtttcggagcacggcaagcaggccagcgaccggctggtcttcggcaaggtggtgagcggcgaggagcagatcgtcgccgggacgaaatacaagctggtcattcaggcgaccagggccggcgccggcgggaacagcgcgacgtacggggcggtggtgtacgagaaggtcgacaagacacggcagctactgtcgtttagtccggcgaactga

SEQ ID NO: 3546 - protein, 126 aa, Sorghum bicolor
  misc_feature (1)..(126): useful for making plants with increased salt and oxidative stress resistance as described in USSN 12/922,143
  misc_feature (1)..(126): Ceres ANNOT ID no.6067852
  misc_feature (1)..(126): Bit score of 204.2 for HMM based on sequences of FIGURE 3 of USSN 12/922,143.
  misc_feature (38)..(96): Pfam Name: Cystatin Pfam Description: Cystatin domain
  misc_feature (1)..(126): Functional Homolog Of Ceres CLONE ID no. 560692
MRTLISMLVVAAAAVVGLCSVAPAASARGEPPVPQAVGGWKPINVNDPHIQELGRWAVSEHGKQASDRLVFGKVVSGEEQIVAGTKYKLVIQATRAGAGGNSATYGAVVYEKVDKTRQLLSFSPAN

SEQ ID NO: 3547 - DNA, 375 bp, Sorghum bicolor
  misc_feature (1)..(375): useful for making plants with increased salt and oxidative stress resistance as described in USSN 12/922,143
  misc_feature (1)..(375): Ceres ANNOT ID no.6067853
atgagggccctcatttccatgctcatcgtcgccgccgcagttgtggggctgtgctctgtcgctcccgctgcatcagcgcgcgaggcgcccctgccggagaacgtcggcaggtggacgccgatcacggacgtgaacgaccccgaaatccaagagatcggccgatgggcggtttcggagcacgacgcggcggccagcgatagtctggtcttcagcaaggtggtgcgcggcgaggagcaggtcgtcgccgggacgaactacaagctggtcattgaagcgaccaagggcgccggcgggaagatcgcgacgtacggggcggtggtgtacgagaaggttgacaatacgcggcagctactatcgtttgcgccggagaactga

SEQ ID NO: 3548 - protein, 124 aa, Sorghum bicolor
  misc_feature (1)..(124): useful for making plants with increased salt and oxidative stress resistance as described in USSN 12/922,143
  misc_feature (1)..(124): Ceres ANNOT ID no.6067853
  misc_feature (1)..(124): Bit score of 251.4 for HMM based on sequences of FIGURE 3 of USSN 12/922,143.
  misc_feature (36)..(95): Pfam Name: Cystatin Pfam Description: Cystatin domain
  misc_feature (1)..(124): Functional Homolog Of Ceres CLONE ID no. 560692
MRALISMLIVAAAVVGLCSVAPAASAREAPLPENVGRWTPITDVNDPEIQEIGRWAVSEHDAAASDSLVFSKVVRGEEQVVAGTNYKLVIEATKGAGGKIATYGAVVYEKVDNTRQLLSFAPEN

SEQ ID NO: 3549 - DNA, 348 bp, Sorghum bicolor
  misc_feature (1)..(348): useful for making plants with increased salt and oxidative stress resistance as described in USSN 12/922,143
  misc_feature (1)..(348): Ceres ANNOT ID no.6075444
atggcaagcagggcaaggggtggacgcgcacctcccactccctcccccacacaggcagagataggacggctccaaggtggattctatcagccgatagtgaacatcaacgatccgcacgttcaggaggtcggcaggtgggcggtgtcggagcatgtcaagaaggcgaacgacgggctaaaattcagtagagtggtgagcggtcaatatcaagtggtcgagggcttcaactatcgtctcatcatcgatgcaactgatagccatggcaaggttgccaagtatgaggccgtggtgtgggagaaggaatgggagaactttcttcagctcacgtcctttaaaccggctaactga

SEQ ID NO: 3550 - protein, 115 aa, Sorghum bicolor
  misc_feature (1)..(115): useful for making plants with increased salt and oxidative stress resistance as described in USSN 12/922,143
  misc_feature (1)..(115): Ceres ANNOT ID no.6075444
  misc_feature (1)..(115): Bit score of 144.1 for HMM based on sequences of FIGURE 3 of USSN 12/922,143.
  misc_feature (26)..(115): Pfam Name: Cystatin Pfam Description: Cystatin domain
  misc_feature (1)..(115): Functional Homolog Of Ceres CLONE ID no. 560692
MASRARGGRAPPTPSPTQAEIGRLQGGFYQPIVNINDPHVQEVGRWAVSEHVKKANDGLKFSRVVSGQYQVVEGFNYRLIIDATDSHGKVAKYEAVVWEKEWENFLQLTSFKPAN

SEQ ID NO: 3551 - DNA, 2211 bp, Arabidopsis thaliana
  misc_feature (1)..(2211): useful for making plants with increased salt and oxidative stress resistance as described in USSN 12/922,143
  misc_feature (1)..(2211): Ceres LOCUS ID no.At3g45100
  misc_feature (1)..(2211): Genomic Sequence
  misc_feature (1)..(2211): Inplanta Sequence
atggcggaaccaccaaagcttagggttttaatggtctctgatttcttcttcccaaactttggtggtgtcgagaatcacatctattacctctctcaatgcttgttaaagctcggtcacaaggtcagattcttctaagttctaaatcaacaaaagttcaaatctttttgcatttttagccataaagaaatcaaattctcaaaacccgtttatgctagttcaatacgatgtgatcagattcaaagttttaaattcaaagtttcaagctttatcatcaatagctgtaatcagattaaaagtttcaggctttatcatcaatagctgtaataaactaatgtagcatagtgtgataggagcttgaggccaaagtttcattctttatctgctttggggcattggtttgagatactgttggttttgttgcaggtggttgttatgacacatgcttatgggaaccggtctggagttagatacatgactggtggactcaaagtctattatgtaccttggagaccttttgttatgcagactacatttccgacggtttatggaacacttcccattgtgaggactatacttagacgcgagaaaatcacggtagttcatggacatcaagctttctctacgctttgtcatgaagctttaatgcatgccaggacaatgggctataaagttgtgttcacagatcattccttgtacggttttgctgatgttggtagcatccatatgaacaaggttttacagtttagtttagcagatattgatcaggcgatttgtgtttcacacacgagcaaggagaatacggttctaaggtctggattgtccccagcaaaggtttttatgataccgaatgctgttgatactgctatgttcaagcccgcttctgttcgacccagtactgatattattactatagttgtcataagtagattggtttatcgaaaaggtgcggatttgctcgtggaagtcattccagaagtatgccgtttatacccaaatgtgagttacaaaaccccagctcacattagtagcagaatcattctgccatttctcattagtatccgcatttactttctttttatttggtttttgaaaggttcgttttgtagttggaggggatggaccaaaacatgtgcgactcgaggaaatgagagagaagcattctctacaagatagagtcgaaatgctaggtgcagttccgcattctcgtgtgcgctctgttttggttaccggtcatattttcttaaacaggtgtgctgattcttacactttttgtgtttaaaattcacaaaactcaacattactttttatcagttaacgctactatagtcttgatcctctgacagttctttaacagaagccttctgcatagctatattagaggcggctagttgcggattattaactgtcagcactcgtgttggaggtgtcccagaggcgtgtaacattttctataattccttcgttgccctttcgctacatcctcatcgtttctttcttcgagattgataaaatcaggttttcttcacggtttacaggtcttaccagatgacatggttgtacttgctgaaccagatccggatgatatggtacgagctattgagaaggcaatatcaatacttccaactattaaccccgaggagatgcacaatcgagtgagttctgcttcaaatccaagcctaacgtatcagtctacttataagagttaagattctcttctaagcctttgatttcctttttttgcttgttgctaccagatgaagaagctctacagttggcaagatgttgctaaaagaaccgagattgtgtatgaccgtgccttgaagtgttcaaataggagtcttctagaacgtctaatgcggtacattatatccttactcatatagattaataatgtaaaccccacccccttcattttctataccgatgaatatctgatcttttgtaggttcctctcgtgtggagcttgggcagggaagctattttgtatggttatgatcctcgattacttgctttggcggttacttcagttactgcaggtgatctatcattgattcatcttctctaatccttgttttttacaaaatgtaatatctctaaatataatggaatttgcctcagcctgatgaagatatcgaggaggcacccgatatctgtctttgccatcaccgaggggttgaggtatctgagggtctaaggaagaagataaagtga

SEQ ID NO: 3552 - protein, 447 aa, Arabidopsis thaliana
  misc_feature (1)..(447): useful for making plants with increased salt and oxidative stress resistance as described in USSN 12/922,143
  misc_feature (1)..(447): Ceres LOCUS ID no.At3g45100
  misc_feature (1)..(447): Bit score of 1228.3 for HMM based on sequences of FIGURE 5 of USSN 12/922,143.
  misc_feature (187)..(356): Pfam Name: Glycos_transf_1 Pfam Description: Glycosyl transferases group 1
  misc_feature (46)..(135): Pfam Name: PIGA Pfam Description: PIGA (GPI anchor biosynthesis)
MAEPPKLRVLMVSDFFFPNFGGVENHIYYLSQCLLKLGHKVVVMTHAYGNRSGVRYMTGGLKVYYVPWRPFVMQTTFPTVYGTLPIVRTILRREKITVVHGHQAFSTLCHEALMHARTMGYKVVFTDHSLYGFADVGSIHMNKVLQFSLADIDQAICVSHTSKENTVLRSGLSPAKVFMIPNAVDTAMFKPASVRPSTDIITIVVISRLVYRKGADLLVEVIPEVCRLYPNVRFVVGGDGPKHVRLEEMREKHSLQDRVEMLGAVPHSRVRSVLVTGHIFLNSSLTEAFCIAILEAASCGLLTVSTRVGGVPEVLPDDMVVLAEPDPDDMVRAIEKAISILPTINPEEMHNRMKKLYSWQDVAKRTEIVYDRALKCSNRSLLERLMRFLSCGAWAGKLFCMVMILDYLLWRLLQLLQPDEDIEEAPDICLCHHRGVEVSEGLRKKIK

SEQ ID NO: 3553 - DNA, 1329 bp, Populus balsamifera subsp. trichocarpa
  misc_feature (1)..(1329): useful for making plants with increased salt and oxidative stress resistance as described in USSN 12/922,143
  misc_feature (1)..(1329): Ceres ANNOT ID no.1529516
atggctgatcagaagcacagaatcctgatggtttcagattttttctttcccaattttggtggtgtcgagagccatatttattatctatctcaatgcctgctaaagcttggtcacaaggtggttgttatgactcatgcttatggtaatcgctctggggtgagatacatgactggtggccttaaagtttactatgtaccatggagaccatttcttatgcagaacaccttgccaactgtttacgggacacttccaattgtaaggactatccttgttcgagaaaaaatatcattggtgcatggacatcaagccttctcaactctttgtcatgaagcgttgatgcatgcacgcaccatgggttacaaagttgtatttactgatcattcactctatggttttgctgatatcggaagcattcacatgaacaaggtgttgcaattcactttagcagacgtgagccaggccatttgtgtttctcatacaagcaaggaaaacacagtgttacggtcaggtctaccaccagaaaaggttttcatgataccaaatgctgttgacactgctatgttcaagccagccccagagcgacttggcaatgatgaaattattattgttgtgataagtagattggtttatcgaaagggcgcagacttgcttgttgaagtcattccagaaatttgccgtttgtatcctaatgtcaggttcattgttggaggagatggacctaaacgggtaaggctggaagagatgagggaaagacactctcttcaagatcgagttgaaatgctgggttctgtaccacatgctcatgtacgctctgtcttgatttctggccatatatttctaaacagttctttgacagaggcgttctgcatagccatattagaggctgctagttgtgggttattaacagtcagcacgcgcgtaggaggtgtacctgaggttctaccagaggacatgattgtacttgcagaacctgatcctagtgatatggtaagagcaaccggaaaggcgatatctctacttccgaatattgacccacaacagatgcataatcgcatgaagaaactctatgattggcatgatgttgcaaaacgaacagagattgtttatgaccgtgctttgaaatgtcccgaccaaaatttgttagaacgactctcacggtacctctcttgtggtagttgggcaggcaagattttctgcttcgttatgataattgatttcttgctatggcgtctgctgcaactatggcagccaacagaggagattgaggaggtgcctgaatttactttaccccgtcaccaagatgaggaaataatctcaaatttcaactag

SEQ ID NO: 3554 - protein, 442 aa, Populus balsamifera subsp. trichocarpa
  misc_feature (1)..(442): useful for making plants with increased salt and oxidative stress resistance as described in USSN 12/922,143
  misc_feature (1)..(442): Ceres ANNOT ID no.1529516
  misc_feature (1)..(442): Bit score of 1242.8 for HMM based on sequences of FIGURE 5 of USSN 12/922,143.
  misc_feature (186)..(314): Pfam Name: Glycos_transf_1 Pfam Description: Glycosyl transferases group 1
  misc_feature (45)..(134): Pfam Name: PIGA Pfam Description: PIGA (GPI anchor biosynthesis)
  misc_feature (1)..(442): Functional Homolog Of Ceres LOCUS ID no. At3g45100
MADQKHRILMVSDFFFPNFGGVESHIYYLSQCLLKLGHKVVVMTHAYGNRSGVRYMTGGLKVYYVPWRPFLMQNTLPTVYGTLPIVRTILVREKISLVHGHQAFSTLCHEALMHARTMGYKVVFTDHSLYGFADIGSIHMNKVLQFTLADVSQAICVSHTSKENTVLRSGLPPEKVFMIPNAVDTAMFKPAPERLGNDEIIIVVISRLVYRKGADLLVEVIPEICRLYPNVRFIVGGDGPKRVRLEEMRERHSLQDRVEMLGSVPHAHVRSVLISGHIFLNSSLTEAFCIAILEAASCGLLTVSTRVGGVPEVLPEDMIVLAEPDPSDMVRATGKAISLLPNIDPQQMHNRMKKLYDWHDVAKRTEIVYDRALKCPDQNLLERLSRYLSCGSWAGKIFCFVMIIDFLLWRLLQLWQPTEEIEEVPEFTLPRHQDEEIISNFN

SEQ ID NO: 3555 - DNA, 1272 bp, Populus balsamifera subsp. trichocarpa
  misc_feature (1)..(1272): useful for making plants with increased salt and oxidative stress resistance as described in USSN 12/922,143
  misc_feature (1)..(1272): Ceres ANNOT ID no.1476065
atggctgatcagaagcacagaatcctgatggtttcagattttttctttcccaattttggtggtgtcgagagccatatttattatctatctcaatgcctgctaaagcttggtcacaaggtggttgttatgactcatgcttatggtaatcgctctggggtgagatacatgactggtggccttaaagtttactatgtaccatggagaccatttcttatgcagaacaccttgccaactgtttacgggacacttccaattgtaaggactatccttgttcgagaaaaaatatcattggtgcatggacatcaagccttctcaactctttgtcatgaagcgttgatgcatgcacgcaccatgggttacaaagttgtatttactgatcattcactctatggttttgctgatatcggaagcattcacatgaacaaggtgttgcaattcactttagcagacgtgagccaggccatttgtgtttctcatacaagcaaggaaaacacagtgttacggtcaggtctaccaccagaaaaggttttcatgataccaaatgctgttgacactgctatgttcaagccagccccagagcgacttggcaatgatgaaattattattgttgtgataagtagattggtttatcgaaagggcgcagacttgcttgttgaagtcattccagaaatttgccgtttgtatcctaatgtcaggttcattgttggaggagatggacctaaacgggtaaggctggaagagatgagggaaagacactctcttcaagatcgagttgaaatgctgggttctgtaccacatgctcatctcgacaatttcctttggcatggatgtattaaccctgaagtggaaatacaaatagtaacagagcatttggtggaggttctaccagaggacatgattgtacttgcagaacctgatcctagtgatatggtaagagcaaccggaaaggcgatatctctacttccgaatattgacccacaacagatgcataatcgcatgaagaaactctatgattggcatgatgttgcaaaacgaacagagattgtttatgaccgtgctttgaaatgtcccgaccaaaatttgttagaacgactctcacggtacctctcttgtggtagttgggcaggcaagattttctgcttcgttatgataattgatttcttgctatggcgtctgctgcaactatggcagccaacagaggagattgaggaggtgcctgaatttactttaccccgtcaccaagatgaggaaataatctcaaatttcaactag

SEQ ID NO: 3556 - protein, 423 aa, Populus balsamifera subsp. trichocarpa
  misc_feature (1)..(423): useful for making plants with increased salt and oxidative stress resistance as described in USSN 12/922,143
  misc_feature (1)..(423): Ceres ANNOT ID no.1476065
  misc_feature (1)..(423): Bit score of 1149.7 for HMM based on sequences of FIGURE 5 of USSN 12/922,143.
  misc_feature (186)..(273): Pfam Name: Glycos_transf_1 Pfam Description: Glycosyl transferases group 1
  misc_feature (45)..(134): Pfam Name: PIGA Pfam Description: PIGA (GPI anchor biosynthesis)
  misc_feature (1)..(423): Functional Homolog Of Ceres LOCUS ID no. At3g45100
MADQKHRILMVSDFFFPNFGGVESHIYYLSQCLLKLGHKVVVMTHAYGNRSGVRYMTGGLKVYYVPWRPFLMQNTLPTVYGTLPIVRTILVREKISLVHGHQAFSTLCHEALMHARTMGYKVVFTDHSLYGFADIGSIHMNKVLQFTLADVSQAICVSHTSKENTVLRSGLPPEKVFMIPNAVDTAMFKPAPERLGNDEIIIVVISRLVYRKGADLLVEVIPEICRLYPNVRFIVGGDGPKRVRLEEMRERHSLQDRVEMLGSVPHAHLDNFLWHGCINPEVEIQIVTEHLVEVLPEDMIVLAEPDPSDMVRATGKAISLLPNIDPQQMHNRMKKLYDWHDVAKRTEIVYDRALKCPDQNLLERLSRYLSCGSWAGKIFCFVMIIDFLLWRLLQLWQPTEEIEEVPEFTLPRHQDEEIISNFN

SEQ ID NO: 3557 - protein, 450 aa, Arabidopsis thaliana
  misc_feature (1)..(450): useful for making plants with increased salt and oxidative stress resistance as described in USSN 12/922,143
  misc_feature (1)..(450): Public GI ID no.6911848
  misc_feature (1)..(450): Bit score of 1210.0 for HMM based on sequences of FIGURE 5 of USSN 12/922,143.
  misc_feature (187)..(342): Pfam Name: Glycos_transf_1 Pfam Description: Glycosyl transferases group 1
  misc_feature (46)..(135): Pfam Name: PIGA Pfam Description: PIGA (GPI anchor biosynthesis)
  misc_feature (1)..(450): Functional Homolog Of Ceres LOCUS ID no. At3g45100
MAEPPKLRVLMVSDFFFPNFGGVENHIYYLSQCLLKLGHKVVVMTHAYGNRSGVRYMTGGLKVYYVPWRPFVMQTTFPTVYGTLPIVRTILRREKITVVHGHQAFSTLCHEALMHARTMGYKVVFTDHSLYGFADVGSIHMNKVLQFSLADIDQAICVSHTSKENTVLRSGLSPAKVFMIPNAVDTAMFKPASVRPSTDIITIVVISRLVYRKGADLLVEVIPEVCRLYPNVRFVVGGDGPKHVRLEEMREKHSLQDRVEMLGAVPHSRVRSVLVTGHIFLNSSLTEAFCIAILEAASCGLLTVSTRVGGFLHGLQVLPDDMVVLAEPDPDDMVRAIEKAISILPTINPEEMHNRMKKLYSWQDVAKRTEIVYDRALKCSNRSLLERLMRFLSCGAWAGKLFCMVMILDYLLWRLLQLLQPDEDIEEAPDICLCHHRGVEVSEGLRKKIK

SEQ ID NO: 3558 - DNA, 1753 bp, Zea mays
  misc_feature (1)..(1753): useful for making plants with increased salt and oxidative stress resistance as described in USSN 12/922,143
  misc_feature (1)..(1753): Ceres CLONE ID no.243208
ctcgaatcgtcaatgagcaccggcgccgcgcccctcctccactctacccgcacagcgcccctcgcccccacaccccaacccaaccatccgctccttgtcgccttccgacgctgagtttgctggtgtcgatttgcgccggcggatgctcgatctggtagctgcatgtgccgacctactcgtcgaatccgttatctaacgtaatggatgggcaaggcacaaagcacaggattttgatggtgtccgactttttctttccaaactttggtggggtggaaagccatatctactacctgtcacaatgtctacttaagcttggccataaggttgttgtcatgacacatgcatatggaaacagatctggagtacgatatgtcacaaatggtttaaaggtctattatgtaccatggaggccattcctgatgcagaatacacttcctacactatccttgacgtttccaattgtaaggacaattattattcgagagaagatttctgtcgtgcatggacatcaagctttttcaacactgtgtcatgaagcattaatgcatgctaggacaatggggtacaaagttgtcttcacagatcactcactttatggttttgctgatgctggaagcattcacatgaataaggttctgcagtttactcttgcagatattgatcaggcaatatgtgtctcacatacaagcaaagagaacactgtcttgaggttagtataccgaaaaggcgccgaccttcttgttgaagtcattccagaagtgtgtcggctatttccaaaggttcactttattgttggtggtgatggtccaaaacgtgtgcgccttgaagaaatgagggagaagttctcccttcaggatagagttgagatgttaggagctgtacctcatgctcaggtgcgatcggttctgatatctggacatatatttttgaacagttcactcacagaggcattttgcatagccattctagaagcagctagctgtggactgttgacagtgagcactagagtcggtggtgtccctgaggttcttccagatgacatgatagtacttgcagaaccagctcctggagatatggtaagagctgtcaagaaagccatcgacatgctacctggaatagacccccagattatgcatcttcggatgaaagaactttatagttgggacgatgttgccaaaagaactgagattgtttatgatcgtgcaatggaatctccaacaacaaatttactagatcgccttccccggtatcttacttgtggatcttgggctggaaaactgttttgcctagttatgatcatcaattacctactatggcgccttttagaatttctacagcctgctgtaggtattgaagaagtcccagatataggcccactacatgctcatttaggttcaaggaatgatgaggctcaagagaagtgaaacttaaacctttgtcagttttgaaactgttggggacttgaggtggcagtcatggtatcttctgcttgtcagcattcgttctgatccacatgccagtgtatgcctttatgatatggcccccgcacagcattttctcttgaagcttcctgtctccgtagtcgcagctgaaagagagtggaacgccttgatttgtaggatttcttgtcatgctggttaaagatatggtccgagtctctgtcattgccagcttctttttcttcttctgcgtaatgcgtagtgagtggatggcctgcgttttaggcacgtcatcaaaaccaattatctgctgg

SEQ ID NO: 3559 - protein, 407 aa, Zea mays
  misc_feature (1)..(407): useful for making plants with increased salt and oxidative stress resistance as described in USSN 12/922,143
  misc_feature (1)..(407): Ceres CLONE ID no.243208
  misc_feature (1)..(407): Bit score of 1095.1 for HMM based on sequences of FIGURE 5 of USSN 12/922,143.
  misc_feature (170)..(300): Pfam Name: Glycos_transf_1 Pfam Description: Glycosyl transferases group 1
  misc_feature (47)..(136): Pfam Name: PIGA Pfam Description: PIGA (GPI anchor biosynthesis)
  misc_feature (1)..(407): Functional Homolog Of Ceres LOCUS ID no. At3g45100
MDGQGTKHRILMVSDFFFPNFGGVESHIYYLSQCLLKLGHKVVVMTHAYGNRSGVRYVTNGLKVYYVPWRPFLMQNTLPTLSLTFPIVRTIIIREKISVVHGHQAFSTLCHEALMHARTMGYKVVFTDHSLYGFADAGSIHMNKVLQFTLADIDQAICVSHTSKENTVLRLVYRKGADLLVEVIPEVCRLFPKVHFIVGGDGPKRVRLEEMREKFSLQDRVEMLGAVPHAQVRSVLISGHIFLNSSLTEAFCIAILEAASCGLLTVSTRVGGVPEVLPDDMIVLAEPAPGDMVRAVKKAIDMLPGIDPQIMHLRMKELYSWDDVAKRTEIVYDRAMESPTTNLLDRLPRYLTCGSWAGKLFCLVMIINYLLWRLLEFLQPAVGIEEVPDIGPLHAHLGSRNDEAQEK

SEQ ID NO: 3560 - protein, 438 aa, Oryza sativa subsp. japonica
  misc_feature (1)..(438): useful for making plants with increased salt and oxidative stress resistance as described in USSN 12/922,143
  misc_feature (1)..(438): Public GI ID no.22296298
  misc_feature (1)..(438): Bit score of 1118.5 for HMM based on sequences of FIGURE 5 of USSN 12/922,143.
  misc_feature (210)..(360): Pfam Name: Glycos_transf_1 Pfam Description: Glycosyl transferases group 1
  misc_feature (68)..(157): Pfam Name: PIGA Pfam Description: PIGA (GPI anchor biosynthesis)
  misc_feature (1)..(438): Functional Homolog Of Ceres LOCUS ID no. At3g45100
MENVTGEGISDQIERFQTQLQMDGRGRKHRILMVSDFFFPNFGGVESHIYYLSQCLLKLGHKVIVMTHAYGNRSGVRYVTGGLKVYYVPWKPFLMQNTLPTLFLTFPIVRTILIREKISVVHGHQAFSTLCHEALMHARTMGYKVVFTDHSLYGFADAGSIHMNKVLQFTLADIDQAICVSHTSKENTVLRSGISPEKVFMVPNAVDTAMFTPSPDRLSCDEIVIVVISRLVYRKGADLLVEVIPEVCRLFPKVRFIVGGDGPKRVRIEEMREKFSLQDRVEMLGAVPHAQVRSVLISGHIFLNSSLTEAFCIAILEAASCGLLTVSTRVGGVPEVLPDDMVVLAEPAPEDMVRAVRKAIDMLPGIDPQVMHLRMKKLYSWDDVAKRTEIVYDRAMQSPQTDLLERLPRSGGNLTSSFPLSPLKVLKRSQISGQYMLV

SEQ ID NO: 3561 - DNA, 1677 bp, Arabidopsis thaliana
  misc_feature (1)..(1677): useful for making plants with increased salt and oxidative stress resistance as described in USSN 12/922,143
  misc_feature (1)..(1677): Ceres LOCUS ID no.At4g00150
  misc_feature (1)..(1677): Genomic Sequence
  misc_feature (1)..(1677): Inplanta Sequence
atgcccttaccctttgaagagtttcaagggaaggggatttcttgtttctcttctttctcgtcttccttcccccaaccaccgtcgtctccgcttttgagccaccgcaaagcaagaggcggcgaagaagaagaggaagaagttcccgcggcggagcctacctctgttctggactccctcataagcccaacctcttcctccacggtgtcttcctctcacggcggaaacagcgccgtcggaggcggcggcgacgccaccaccgatgagcaatgcggagccattgggttgggtgattgggaggagcaagttcctcatgaccacgaacagagcattctcggactcatcatgggagattccacagatccctctcttgaactcaacagcattctccagacatctcccaccttccacgactctgactactcatcacccggtttcggagtcgtcgacaccggcttcggtttagaccaccactctgttccgccgtcacatgtttccggtcttctgatcaaccaaagtcaaacccactacacacagaatcctgcggctatcttctacggccaccaccaccatacacctccgccggcaaagcggcccaaccctggtcccgtggggataacagagcagctggttaaggcagcagaggtcatagagagcgacacgtgtctagctcaggggatattggcgcggctcaatcaacagctctcttctcccgtcgggaagccattagaaagagcagctttttacttcaaagaagctctcaataatctccttcacaacgtctcccaaaccctaaacccttattccctcatcttcaagatcgctgcttacaaatccttctcagagatctctcccgttcttcagttcgccaactttacctccaaccaagccctcttagagtccttccatggcttccaccgtctccacatcatcgacttcgatatcggctacggtggccaatgggcttccctcatgcaagagcttgttctccgcgacaacgccgctcctctctccctcaagatcaccgttttcgcttctccggcgaaccacgaccagctcgaacttggcttcactcaagacaacctcaagcacttcgcctctgagatcaacatctcccttgacatccaagttttgagcttagacctcctcggctccatctcgtggcctaactcgtcggagaaagaagctgtcgccgttaacatctccgccgcgtccttctcgcacctccctttggtcctccgtttcgtgaagcatctatctccgacgatcatcgtctgctccgacagaggatgcgagaggacggatctgcccttctctcaacagctcgcccactcgctgcactcacacaccgctctcttcgaatccctcgacgccgtcaacgccaacctcgacgcaatgcagaagatcgagaggtttcttatacagccggagatagagaagctggtgttggatcgtagccgtccgatagaacggccgatgatgacgtggcaagcgatgtttctacagatgggtttctcaccggtgacgcacagtaacttcacggagtctcaagccgagtgtttagtccaacggacgccagtgagaggctttcacgtcgagaagaaacataactcacttctcctatgttggcaaaggacagaactcgtcggagtttcagcatggagatgtcgctcctcctga

SEQ ID NO: 3562 - protein, 558 aa, Arabidopsis thaliana
  misc_feature (1)..(558): useful for making plants with increased salt and oxidative stress resistance as described in USSN 12/922,143
  misc_feature (1)..(558): Ceres LOCUS ID no.At4g00150
  misc_feature (1)..(558): Bit score of 1169.8 for HMM based on sequences of FIGURE 6 of USSN 12/922,143.
  misc_feature (179)..(467): Pfam Name: GRAS Pfam Description: GRAS family transcription factor
MPLPFEEFQGKGISCFSSFSSSFPQPPSSPLLSHRKARGGEEEEEEVPAAEPTSVLDSLISPTSSSTVSSSHGGNSAVGGGGDATTDEQCGAIGLGDWEEQVPHDHEQSILGLIMGDSTDPSLELNSILQTSPTFHDSDYSSPGFGVVDTGFGLDHHSVPPSHVSGLLINQSQTHYTQNPAAIFYGHHHHTPPPAKRPNPGPVGITEQLVKAAEVIESDTCLAQGILARLNQQLSSPVGKPLERAAFYFKEALNNLLHNVSQTLNPYSLIFKIAAYKSFSEISPVLQFANFTSNQALLESFHGFHRLHIIDFDIGYGGQWASLMQELVLRDNAAPLSLKITVFASPANHDQLELGFTQDNLKHFASEINISLDIQVLSLDLLGSISWPNSSEKEAVAVNISAASFSHLPLVLRFVKHLSPTIIVCSDRGCERTDLPFSQQLAHSLHSHTALFESLDAVNANLDAMQKIERFLIQPEIEKLVLDRSRPIERPMMTWQAMFLQMGFSPVTHSNFTESQAECLVQRTPVRGFHVEKKHNSLLLCWQRTELVGVSAWRCRSS

SEQ ID NO: 3563 - DNA, 1926 bp, Populus balsamifera subsp. trichocarpa
  misc_feature (1)..(1926): useful for making plants with increased salt and oxidative stress resistance as described in USSN 12/922,143
  misc_feature (1)..(1926): Ceres ANNOT ID no.1539565
atgcccctaccctctgaggactttcaagggaagggggtgttagatttctcttcgtctactacttcctctccaaattcactgtatcaacaccaccagaagtggcagaacaacaacagcaaagaaagttgtggtttttttttgggcagtgctgagcccacatctgtgcttgatacaataagcagacaaagcccaccaacatcgtcctcaacactgtcttcttctcaaggcggaggtggtggcggcggaggagcctccaccgacaccaccaacgacgtggcagcagctggtggaagcaacccttgtgtagatgaaaaatgtggacagcaacttggaatggaggattgggagagtgtgttgccaggttctcctagtcaagagcagtcaattttaaggctaattatgggtgatattgaggacccatccgtgggacttcacaaactgttacaaggtggaagtaggtctctagatatggagcatgcgtcgggttttggtgttgtagatcaagtttttggctttgatgtatccagtatgagttctgcaagtgccaatttggttgccaacaacaacaacattgatccttcttcaatccatgagcatcataataaccagcatttcttatcaccaccgccgtcgaaaaggcttaattctgggcttgttggagtcaattatgtgccaaaagtctttgattcgaggcctccagagttgtttcttccacgacaacatcaacagcagcagcagaatcatcagtttcgaatgttgcagcagcagcagcagaggcagggagtgatcacgaatcagaaaattgcaagcgatgaattggcaaaccagcagcagcttcaacaggcaataataaacccgatatgtcaagcagcagagctgatcgaaactgggaatccggtacttgcgcaagggatattggcgcggctcaatcaccagctctctcttcctatcggtaagccttaccaaaggactgctttttacttcaaggatgccttgcagttgcttctccatacgagcagcaacaactcaattgataatgcttgtagcctgattttcaagatcggtgcttataaatctttctctgagatctcaccaatccttcagtttgcgaattttacttgcaaccaagttcttctcgaggcttctgagggttttgagagaattcatattgttgattttgatattggatatggtggacaatgggcttctcttatgcaagaactggctttgaggactggaggtgccccttctcttaaaatcacagcttttgcttctccttcctcacatgatgagctcgagcttggtttcactcgagaaaatttaagaatctttgcaagtgaaatcaacatgccattcgagcttgaaattttaagccttgaatccttgggttctggttcttggccaatgcctcttcgcacgccggaaaaggaagtaactgctgtgaatcttccaattggctccttttcaaatgacacatcaactcttcctttggcgcttcgctttgtaaagcaactctcacccaaagtcgtggtctctttggacagaggctgtgaccgaagcgacctcccatttgcgcaccatgtaaatcatgccattcaatcttattcaaccctgctggaatcactggatgccgtgaatgtgaacctagatgcattgcaaaagattgagagttttttggtgcagccaggtattgagaaaattgtattgggtcgtcatcgttgccctgataggacttctccttggaggagtctctttttacagtctggtttcactccattgcctttcagtaactttaccgagtcacaagccgagtatttggtgcatcgtactccagttaggggtttccatgtcgaaaagaggcaatcttcgcttgttctttgctggcaacggaaggacctcatagcagcttctgcttggaggtgttaa

SEQ ID NO: 3564 - protein, 641 aa, Populus balsamifera subsp. trichocarpa
  misc_feature (1)..(641): useful for making plants with increased salt and oxidative stress resistance as described in USSN 12/922,143
  misc_feature (1)..(641): Ceres ANNOT ID no.1539565
  misc_feature (1)..(641): Bit score of 1403.2 for HMM based on sequences of FIGURE 6 of USSN 12/922,143.
  misc_feature (289)..(555): Pfam Name: GRAS Pfam Description: GRAS family transcription factor
  misc_feature (1)..(641): Functional Homolog Of Ceres LOCUS ID no. At4g00150
MPLPSEDFQGKGVLDFSSSTTSSPNSLYQHHQKWQNNNSKESCGFFLGSAEPTSVLDTISRQSPPTSSSTLSSSQGGGGGGGGASTDTTNDVAAAGGSNPCVDEKCGQQLGMEDWESVLPGSPSQEQSILRLIMGDIEDPSVGLHKLLQGGSRSLDMEHASGFGVVDQVFGFDVSSMSSASANLVANNNNIDPSSIHEHHNNQHFLSPPPSKRLNSGLVGVNYVPKVFDSRPPELFLPRQHQQQQQNHQFRMLQQQQQRQGVITNQKIASDELANQQQLQQAIINPICQAAELIETGNPVLAQGILARLNHQLSLPIGKPYQRTAFYFKDALQLLLHTSSNNSIDNACSLIFKIGAYKSFSEISPILQFANFTCNQVLLEASEGFERIHIVDFDIGYGGQWASLMQELALRTGGAPSLKITAFASPSSHDELELGFTRENLRIFASEINMPFELEILSLESLGSGSWPMPLRTPEKEVTAVNLPIGSFSNDTSTLPLALRFVKQLSPKVVVSLDRGCDRSDLPFAHHVNHAIQSYSTLLESLDAVNVNLDALQKIESFLVQPGIEKIVLGRHRCPDRTSPWRSLFLQSGFTPLPFSNFTESQAEYLVHRTPVRGFHVEKRQSSLVLCWQRKDLIAASAWRC

SEQ ID NO: 3565 - DNA, 1935 bp, Populus balsamifera subsp. trichocarpa
  misc_feature (1)..(1935): useful for making plants with increased salt and oxidative stress resistance as described in USSN 12/922,143
  misc_feature (1)..(1935): Ceres ANNOT ID no.1486151
atgaaggccatgcccctaccctctgaggactttcaagggaagggggtgttagatttctcttcgtctactacttcctctccaaattcactgtatcaacaccaccagaagtggcagaacaacaacagcaaagaaagttgtggtttttttttgggcagtgctgagcccacatctgtgcttgatacaataagcagacaaagcccaccaacatcgtcctcaacactgtcttcttctcaaggcggaggtggtggcggcggaggagcctccaccgacaccaccaacgacgtggcagcagctggtggaagcaacccttgtgtagatgaaaaatgtggacagcaacttggaatggaggattgggagagtgtgttgccaggttctcctagtcaagagcagtcaattttaaggctaattatgggtgatattgaggacccatccgtgggacttcacaaactgttacaaggtggaagtaggtctctagatatggagcatgcgtcgggttttggtgttgtagatcaagtttttggctttgatgtatccagtatgagttctgcaagtgccaatttggttgccaacaacaacaacattgatccttcttcaatccatgagcatcataataaccagcatttcttatcaccaccgccgtcgaaaaggcttaattctgggcttgttggagtcaattatgtgccaaaagtctttgattcgaggcctccagagttgtttcttccacgacaacatcaacagcagcagcagaatcatcagtttcgaatgttgcagcagcagcagcagaggcagggagtgatcacgaatcagaaaattgcaagcgatgaattggcaaaccagcagcagcttcaacaggcaataataaacccgatatgtcaagcagcagagctgatcgaaactgggaatccggtacttgcgcaagggatattggcgcggctcaatcaccagctctctcttcctatcggtaagccttaccaaaggactgctttttacttcaaggatgccttgcagttgcttctccatacgagcagcaacaactcaattgataatgcttgtagcctgattttcaagatcggtgcttataaatctttctctgagatctcaccaatccttcagtttgcgaattttacttgcaaccaagttcttctcgaggcttctgagggttttgagagaattcatattgttgattttgatattggatatggtggacaatgggcttctcttatgcaagaactggctttgaggactggaggtgccccttctcttaaaatcacagcttttgcttctccttcctcacatgatgagctcgagcttggtttcactcgagaaaatttaagaatctttgcaagtgaaatcaacatgccattcgagcttgaaattttaagccttgaatccttgggttctggttcttggccaatgcctcttcgcacgccggaaaaggaagtaactgctgtgaatcttccaattggctccttttcaaatgacacatcaactcttcctttggcgcttcgctttgtaaagcaactctcacccaaagtcgtggtctctttggacagaggctgtgaccgaagcgacctcccatttgcgcaccatgtaaatcatgccattcaatcttattcaaccctgctggaatcactggatgccgtgaatgtgaacctagatgcattgcaaaagattgagagttttttggtgcagccaggtattgagaaaattgtattgggtcgtcatcgttgccctgataggacttctccttggaggagtctctttttacagtctggtttcactccattgcctttcagtaactttaccgagtcacaagccgagtatttggtgcatcgtactccagttaggggtttccatgtcgaaaagaggcaatcttcgcttgttctttgctggcaacggaaggacctcatagcagcttctgcttggaggtgttaa

SEQ ID NO: 3566 - protein, 644 aa, Populus balsamifera subsp. trichocarpa
  misc_feature (1)..(644): useful for making plants with increased salt and oxidative stress resistance as described in USSN 12/922,143
  misc_feature (1)..(644): Ceres ANNOT ID no.1486151
  misc_feature (1)..(644): Bit score of 1403.2 for HMM based on sequences of FIGURE 6 of USSN 12/922,143.
  misc_feature (292)..(558): Pfam Name: GRAS Pfam Description: GRAS family transcription factor
  misc_feature (1)..(644): Functional Homolog Of Ceres LOCUS ID no. At4g00150
MKAMPLPSEDFQGKGVLDFSSSTTSSPNSLYQHHQKWQNNNSKESCGFFLGSAEPTSVLDTISRQSPPTSSSTLSSSQGGGGGGGGASTDTTNDVAAAGGSNPCVDEKCGQQLGMEDWESVLPGSPSQEQSILRLIMGDIEDPSVGLHKLLQGGSRSLDMEHASGFGVVDQVFGFDVSSMSSASANLVANNNNIDPSSIHEHHNNQHFLSPPPSKRLNSGLVGVNYVPKVFDSRPPELFLPRQHQQQQQNHQFRMLQQQQQRQGVITNQKIASDELANQQQLQQAIINPICQAAELIETGNPVLAQGILARLNHQLSLPIGKPYQRTAFYFKDALQLLLHTSSNNSIDNACSLIFKIGAYKSFSEISPILQFANFTCNQVLLEASEGFERIHIVDFDIGYGGQWASLMQELALRTGGAPSLKITAFASPSSHDELELGFTRENLRIFASEINMPFELEILSLESLGSGSWPMPLRTPEKEVTAVNLPIGSFSNDTSTLPLALRFVKQLSPKVVVSLDRGCDRSDLPFAHHVNHAIQSYSTLLESLDAVNVNLDALQKIESFLVQPGIEKIVLGRHRCPDRTSPWRSLFLQSGFTPLPFSNFTESQAEYLVHRTPVRGFHVEKRQSSLVLCWQRKDLIAASAWRC

SEQ ID NO: 3567 - protein, 558 aa, Arabidopsis thaliana
  misc_feature (1)..(558): useful for making plants with increased salt and oxidative stress resistance as described in USSN 12/922,143
  misc_feature (1)..(558): Public GI ID no.15236725
  misc_feature (1)..(558): Bit score of 1165.8 for HMM based on sequences of FIGURE 6 of USSN 12/922,143.
  misc_feature (179)..(467): Pfam Name: GRAS Pfam Description: GRAS family transcription factor
  misc_feature (1)..(558): Functional Homolog Of Ceres LOCUS ID no. At4g00150
MPLPFEEFQGKGISCFSSFSSSFPQPPSSPLLSHRKARGGEEEEEEVPAAEPTSVLDSLISPTSSSTVSSSHGGNSAVGGGGDATTDEQCGAIGLGDWEEQVPHDHEQSILGLIMGDSTDPSLELNSILQTSPTFHDSDYSSPGFGVVDTGFGLDHHSVPPSHVSGLLINQSQTHYTQNPAAIFYGHHHHTPPPAKRLNPGPVGITEQLVKAAEVIESDTCLAQGILARLNQQLSSPVGKPLERAAFYFKEALNNLLHNVSQTLNPYSLIFKIAAYKSFSEISPVLQFANFTSNQALLESFHGFHRLHIIDFDIGYGGQWASLMQELVLRDNAAPLSLKITVFASPANHDQLELGFTQDNLKHFASEINISLDIQVLSLDLLGSISWPNSSEKEAVAVNISAASFSHLPLVLRFVKHLSPTIIVCSDRGCERTDLPFSQQLAHSLHSHTALFESLDAVNANLDAMQKIERFLIQPEIEKLVLDRSRPIERPMMTWQAMFLQMGFSPVTHSNFTESQAECLVQRTPVRGFHVEKKHNSLLLCWQRTELVGVSAWRCRSS

SEQ ID NO: 3568 - protein, 721 aa, Petunia x hybrida
  misc_feature (1)..(721): useful for making plants with increased salt and oxidative stress resistance as described in USSN 12/922,143
  misc_feature (1)..(721): Public GI ID no.22087131
  misc_feature (1)..(721): Bit score of 1627.2 for HMM based on sequences of FIGURE 6 of USSN 12/922,143.
  misc_feature (371)..(635): Pfam Name: GRAS Pfam Description: GRAS family transcription factor
  misc_feature (1)..(721): Functional Homolog Of Ceres LOCUS ID no. At4g00150
MIAIPQGAKGVLGVSSFMPSISSEEQICKKDANFARNDPQICKKDGNFARNEPQICKKEGNFTRNEPVSVLDTRSPSPSSSSCSYAGKVEGQKEELVKELQPFPLVGLEPEKCSLGFGDLDNLLPELCGADQTLLRWISGDMEDPSVSLKQLLLGGNANGFHGSSGFEASAAGSLVHTDNVSFSGSDVSLNANIEKIGSVIDSNGRPSNGFDYLNANLYAKSLPLPPASSFQEQKLGQKPQSFSPNQALFQNASYGNMFDSSSYDDTNQEQPPSKRHNSGTLGSSVGGLLPKVPFFDPSGDLSMRRQLLGEMQQHFNLLPPQQFQPKPLIVPKLEAACGGGNGSLMVPRHQQQEQQFIYDQIFQASELLLAGHFSNAQMILARLNQQLSPIGKPFKRAAFYFKEALQLPFLLPCTSTFLPPRSPTPFDCVLKMDAYKSFSEVSPLIQFMNFTSNQAILEALGDVERIHIIDFDIGFGAQWSSFMQELPSSNRKATSLKITAFASPSTHHSVEIAIMHESLTQFANDAGIRFELEVINLDTFDPKSYPLSSLRSSDCEAIAINFPIWSISSCLFAFPSLLHYMKQLSPKIIVSLERGCERTELPLKHHLLHALQYYEILLASIDAANVTPEIGKKIEKSLLLPSIENMVLGRLRSPDRMPQWRNLFASAGFSPVAFSNLTEIQAECVVKRTQVGGFHVEKRQSSLVLCWKQQELLSALTWRC

SEQ ID NO: 3569 - DNA, 2395 bp, Triticum aestivum
  misc_feature (1)..(2395): useful for making plants with increased salt and oxidative stress resistance as described in USSN 12/922,143
  misc_feature (1)..(2395): Ceres CLONE ID no.788036
actactaggactgtgcactactaatggccccgtagactccacaccagagccaactttggagggagcgagcgacgagggagaagaggtcgacggaggaaggagaagactagactagaccagcacaagcacccaactcttgctgcgtggcggggattggtggtatgaggtgttgctgccgggctagatgagaggaatgccctttgctggagagggtcacgcggggacactgcagcagcccaagctgagcgccggcttctgggcggagcccacgtccgtgctcgaccgccgccacagccccagccccagcccgccctccgaggcttccgcgctgtcgtccgaggtggcgagcctcgcgcccggcggcgacgccaagaacgtctccccgccgccgcagcagcaggcatggccggctggggaggatgctactgctgctgcgccgggggtcaaggaggagtgggcgcaccagctggccccgctcgacatgggcatggaccttggcgccggcgaggggtgggacggcacggcgccttccgggctcgcgggacctgacagcaccttcctccgctggatcattggcggcggggaggacgcgtccgcggggatggccggcgtcatggatccgcctgctctggagctcgaccacgccacgtctatgatgtcgccgcctgcggcgtctctcgggcccagcctgtcgccgttcgcgccggccatggaggacgccaagggggcccctttcggccacgcgcccagcttcctgctccaccagcaccagcaccacccccagccacacgcggccttctttggcgcgcacccgtccttcgagtcggcgccgccgccgcctaagcgccaccacccgatggcaggcgcgccggcgccgaagctgcctgctttccaggggcatcacgctccggcgggcgggttcttccccgccctgaagcccaaggcggggacagcgaacgacgaggcggccgccacggtggaccagctcgccgaggctgccaagtttgccgaggcgggcgacgccttcggcgcacgcgagatattggcgcggctcaattatcggctccccgccgcccccgcggccgggacgccactcctccgctctgccttctacttcaaggaggctttgcgccttgcgctctccccaaacggagagacgcccgcgccgccggcgtccacgccgtacgacgtggtcctcaagctcggcgcgtacaaggccttctccgaggtctccccggtgctccagttcgcgcacctcacctgcgtccaggcggtgctcgacgggctccgcggcgcaggctgcatccacgtgctcgacttcgacatcggcatgggcgagcagtgggcgtcgctgatgcaggagctcgcgcagcgccgcccggcgacggcgctcaaggtcaccgcattggtctcgccggcgtcgcaccacccgctcgagctgcagctcatccacgagaacctatcctgcttcgccgcggagctcggcgtgttcttccagttcaccgtattcaacatcgacaccctcgaccccgcggagctcgtggccatcgccggcggggacgcgctcgccgtccacctccccgtcggcgcagcacacgcggccgcaatgcccgccgtcctccgcctcgtgaagagcctcggcgccaaggtggtcgtgtccgtggaccgcgggtgcgaccgcacggagctgcccttcgccgcccacctgttccaggcgttccagtccaccgtgttcctccttgagtccgtggacgccgtggtcacggacccggacacggccggcaagatcgagcggttcctggtccagccggccgtggagcaatgcgtggtcgggcgccaccgcgcgtccatcgagaaggcgccgctgccgtggcgggccgtgttcgcgtcggccgggttcacgccggtgcaggccagcacgttcgcggagtcgcaggccgagtcgctgctgcacaaggtgcccgtccgggggttccgcgtcgagaagcgcgccccgggatcgctctgcctctactggcagcgcgccgagctcgtgtcagtctcggcgtggcggtgctgacaaccccgacctcgccggcgccgtcgccggcgccaaaagaagccgatcggtcttagttaggactaatgatcctactacaaagtatttcgtcgttgtaatgatccgaatccgtctcgcttagtgtcctaaattggaagactatgttaatggtgtcgccttgcatttgccgctggttgctcgatatgctcaaactgtggtgtcagttgatcacgagtagaattggcatggcttggcaggttgcagggtgtgtgcgtgtcgtggtgcactgcgtttctactttctatcctctacgtgttgctactctatagctgtgaaatcaatggttatggcgttttc

SEQ ID NO: 3570 - protein, 624 aa, Triticum aestivum
  misc_feature (1)..(624): useful for making plants with increased salt and oxidative stress resistance as described in USSN 12/922,143
  misc_feature (1)..(624): Ceres CLONE ID no.788036
  misc_feature (1)..(624): Bit score of 1371.5 for HMM based on sequences of FIGURE 6 of USSN 12/922,143.
  misc_feature (238)..(535): Pfam Name: GRAS Pfam Description: GRAS family transcription factor
  misc_feature (1)..(624): Functional Homolog Of Ceres LOCUS ID no. At4g00150
MRGMPFAGEGHAGTLQQPKLSAGFWAEPTSVLDRRHSPSPSPPSEASALSSEVASLAPGGDAKNVSPPPQQQAWPAGEDATAAAPGVKEEWAHQLAPLDMGMDLGAGEGWDGTAPSGLAGPDSTFLRWIIGGGEDASAGMAGVMDPPALELDHATSMMSPPAASLGPSLSPFAPAMEDAKGAPFGHAPSFLLHQHQHHPQPHAAFFGAHPSFESAPPPPKRHHPMAGAPAPKLPAFQGHHAPAGGFFPALKPKAGTANDEAAATVDQLAEAAKFAEAGDAFGAREILARLNYRLPAAPAAGTPLLRSAFYFKEALRLALSPNGETPAPPASTPYDVVLKLGAYKAFSEVSPVLQFAHLTCVQAVLDGLRGAGCIHVLDFDIGMGEQWASLMQELAQRRPATALKVTALVSPASHHPLELQLIHENLSSFAAELGVFFQFTVFNIDTLDPAELVAIAGGDALAVHLPVGAAHAAAMPAVLRLVKSLGAKVVVSVDRGCDRTELPFAAHLFQAFQSTVFLLESVDAVVTDPDTAGKIERFLVQPAVEQCVVGRHRASIEKAPLPWRAVFASAGFTPVQASTFAESQAESLLHKVPVRGFRVEKRAPGSLCLYWQRAELVSVSAWRC

SEQ ID NO: 3571 - DNA, 1960 bp, Zea mays
  misc_feature (1)..(1960): useful for making plants with increased salt and oxidative stress resistance as described in USSN 12/922,143
  misc_feature (1)..(1960): Ceres CLONE ID no.282885
  misc_feature (336)..(336): s is g or c
atcgtgctctgctcactctctccaagaccaaatgacatgcgttgcgttgcgttgcttgctagcaacttgatatattcttgctgccatgccaatcgtcggtgctgatcctaatcatcctgtctaagctcagacgacgacacatcgagggatgcccctcgccggagccgcgacggccgcgaacctgccacgactcgccccctacgcccaagtaccagcccgcccaccacgctgtcttcgccactcggcatcgccgacgtggcggccctcgccgacgccgacgccgacgccaagagcgtctccccgcccgcatggccggacgacgacgacgacgacgtsgccgggagggacgactgggtccaccatctcccgccccttgacatgcacatgccgccgctcggcctcggcgccgcaaaggcctgggagccccacgcgcaacctccgggtccgggcggcctcaccctctcgcacgcccagcagacccacgacagcaccttcctcggctggtttattgccgacgacgtcgccatgtcgggcgtcatggacgaccacaactcccactcggtacttcatgacctcgaccacataccctcttcctccgtgccgccgccgcagttccagcctctcgcgccccacgtgcactacccgcccaagctgcaccaccaccaaaaccccgtggtgcccgcgtcgcctcccaagcacacgctcctgaaacccaagccggaggcgccggggaccgacgacgcttccacggcggtggaccagctcgccgaggccgccaagcttgccgaagccggagacgttttcggcgcccgcgagatactggcgcggctcaactacctgctcccgcccggcgccgcgacggcgacgccactgctccgctccgccttctacttcaaggaggctctgcgcgctgccctgtccaccaccgcctccgcaaccgccgccgccgccgccgcgccggtggacgtgctcctaaagctcggtgcctacaaggacttctccgagctctgccccgtgctccagttcgcgcacttcacctgcgtccaggccatgctcgacgagctgggtggcgctgcctgcatccacgtgctggacttggacatcggcgtcggcgagcagtgggcgtcgctcatgcaggagctggccagccgccgcccgggcgccgcgctcaaggtcaccgcattggtgtccgcggcgtcgcaccacccgctggagctgcagctcgtccacgagaacctgtccaacttcgcggccgagacccgcgtcccgttccagctggccttcttcaacctcgacgccatggaccccgcggagctcctcgctaccgccgccggcgacgccgtcgccgtccacctcccggccggctccgtgcacgcccccgcggtgccgtccgtccttcacctcgtcaggcggcttggcgccaagcttgtcgtctccgtggaccgcagctgtgaccgcggcgagctgcccttcgccgcgcacttccagtcctgcgtgttcctgctcgagtccctggacgccgtcggcacgggccccgacatcaccgccaagatcgagcgcttcttgatccagccgaggatcgagaggtgcctggcggagaggtaccgcgccgcggcggcgggcgacaagacgccgccctggcgggcaatgctcgtgtcggccggcttcgtgccggtgcaggcaagcagcttggcggaggcgcaggcggaggcgttgctcaagaaggtgcccgtgcggggcttccgcgtcgagaagcgcgccggctcgctcgtcctgcattggcaacgcggggagctgctctccgtgtccgcctggagatgctagcaccttactgctgctcaatctgccattgtttaaggatcctgatatatttatcttagatagaatccacaagtctgctcatgctttgtacaatcaaatgggggttatatggtgtatgaaatgttcccttcactcagac

SEQ ID NO: 3572 - protein, 481 aa, Zea mays
  misc_feature (1)..(481): useful for making plants with increased salt and oxidative stress resistance as described in USSN 12/922,143
  misc_feature (1)..(481): Ceres CLONE ID no.282885
  misc_feature (1)..(481): Bit score of 925.8 for HMM based on sequences of FIGURE 6 of USSN 12/922,143.
  misc_feature (99)..(392): Pfam Name: GRAS Pfam Description: GRAS family transcription factor
  misc_feature (1)..(481): Functional Homolog Of Ceres LOCUS ID no. At4g00150
MHMPPLGLGAAKAWEPHAQPPGPGGLTLSHAQQTHDSTFLGWFIADDVAMSGVMDDHNSHSVLHDLDHIPSSSVPPPQFQPLAPHVHYPPKLHHHQNPVVPASPPKHTLLKPKPEAPGTDDASTAVDQLAEAAKLAEAGDVFGAREILARLNYLLPPGAATATPLLRSAFYFKEALRAALSTTASATAAAAAAPVDVLLKLGAYKDFSELCPVLQFAHFTCVQAMLDELGGAACIHVLDLDIGVGEQWASLMQELASRRPGAALKVTALVSAASHHPLELQLVHENLSNFAAETRVPFQLAFFNLDAMDPAELLATAAGDAVAVHLPAGSVHAPAVPSVLHLVRRLGAKLVVSVDRSCDRGELPFAAHFQSCVFLLESLDAVGTGPDITAKIERFLIQPRIERCLAERYRAAAAGDKTPPWRAMLVSAGFVPVQASSLAEAQAEALLKKVPVRGFRVEKRAGSLVLHWQRGELLSVSAWRC

SEQ ID NO: 3573 - DNA, 2578 bp, Panicum virgatum
  misc_feature (1)..(2578): useful for making plants with increased salt and oxidative stress resistance as described in USSN 12/922,143
  misc_feature (1)..(2578): Ceres CLONE ID no.1806177
acccattcttcccttcacaaaccgcacaagagagagaccaccacgagtccacgacacaagaggaggtagagagagaaagggccggccgtgtagctaactagctgctgcctgctggtagtacgagagcgtactgatgagttcttggactctacaccgaggggacgttgtctgaagcgagaggagaagaaacacccgtaggacaagacgtgtcgggaggaggaggaggaggaggaagagaggcaaggagcagcaccatcgccattccttggtctggttgctgttatgaggtgttggattggatgagaggaatgctctttgctggtagcgcacgagaggggcacgcggggacactgctactgctgcaacagcaacaacaacaggggctcgccgccggcaaggtctccggcgtcggcggcctctgggagcccacctcggtgctcgaccaaaggcacagccccagcccgagcccgcccacctcggcttccacgctgtcgtcgcccctgggcgccgcgaccgccggcgtggcggccctcgccggtgctaacgccaagaacgtctccccgccgccacaggcggcggcatggccggggggagcggccgcggaggaggctgcggtggggggcaaggaggagtggcagctcacgccgcttgacatgggccttggcgccggcgaggggtgggacgccgccggctctgtgctgtccgacggcgcggcgccgccggggcttgcccccgaccacaccttcctaaggtggatcattgggggcgaggacgcgtccgtgggcatgggcgccgtcatggacccgccggtccttgagctcgaccacgccccgtccatgatgtcgccggcgttcgggtccaacatgcctttcgcgccggccatggaggacaccaaggctccgcctttcggccacgcgtccaacctcctcctgcaccaccaccagcaccacccccagccccacgcggcgttcttcggctctcacccatccttcgacgcggcgccgccgacgcctaagcggcaccacccgatggcccccgcgccggcgccaaagctgcagtcgttgcctggccctgccgccccggcgggcaggttcgtgccggccatgaagcccaaggcggaggcagcgaacgatgaggcggccgctgcggtggagcagctcgccgaggcggccaagcttgccgaggccggcgacgccttcggcgcccgcgagatattggcgcggctcaattaccggctccccgccgcccccgcggccgggacgccactgctccgctcagccttctacttcaaggaggctttgcgccttgcgctgtccccaaccggcgaggccccggcaccgccggtgtccacgccgtacgacgtggtcctcaagctcggcgcgtacaaggccttctccgaggtctcccccgtgctccagttcgcgcacctcacctgcgtccaggcggtgctggacgagatcggcggcgccgggcgcatccacgtgctcgacttcgacatcggcatgggggagcagtgggcgtcgctgatgcaggagctcgcgcagcgatgccccgcggcgacgctcaaggtcaccgcattggtgtccccggcgacgcaccacccgctggagctgcagctgatccacgagaacctcgctggcttcgccgccgagctcggcgtcttcctccagctggcggtcttcaacatcgacaccctggaccccgcggagctggtggccattaccagcggcgacgctgtcgccgtccacctccccgtgggctcggcccacgtggccgcaatgccggccgtcctccgcctcgtgaagcggctcggcgccaaggtggtgatctcggtggaccacggcggcgaccgcacggagctccccttcgccgcgcacctgttccaggcgttccagtcgtgcgtgtccctgctcgagtccgtcgacgccgtgcgcccggacgccgacgcggtcgccaagatggagcggttcctggtccagcccggcgtggagcgtcgcgtggtggcgcgccaccgcgcggcggccatggacaagccgccgctgccgtggcggaccgtgctcgcgtcggcggggttcgtgccggtgcaggccagcaccttcgccgagtcgcaggccgaggccctgctcaagcggatggccctgatggggttccgcgtggagaagcgcggcggcgcgctctgcctctactggcagcgcggcgagctggtctccgtgtcggcgtggcggtgctgaccaccggccacgccgccgcaccccgacgcgaatctaccaccacccagcccggttttagctaggactaatgatcctactgcgagcaaacaaaaacgtatttttcaccgtcgtcgttgtaaacttgtaatggttgttcgatctgatcgcctgcttatttagtgtcctaaaatttggagtgcgtcgtctgtcgcctggctttgcagccggtctgctcgcgtcgatcagcagagtagattgtgtttggaatagcaggttgtaaaaggtaggtgcggtgcggtaaccagtgcattctaccacccgtgttgttattgctgtgaaatcaatcaatggttatggcgttttaagcc

SEQ ID NO: 3574 - protein, 643 aa, Panicum virgatum
  misc_feature (1)..(643): useful for making plants with increased salt and oxidative stress resistance as described in USSN 12/922,143
  misc_feature (1)..(643): Ceres CLONE ID no.1806177
  misc_feature (1)..(643): Bit score of 1379.0 for HMM based on sequences of FIGURE 6 of USSN 12/922,143.
  misc_feature (257)..(553): Pfam Name: GRAS Pfam Description: GRAS family transcription factor
  misc_feature (1)..(643): Functional Homolog Of Ceres LOCUS ID no. At4g00150
MRGMLFAGSAREGHAGTLLLLQQQQQQGLAAGKVSGVGGLWEPTSVLDQRHSPSPSPPTSASTLSSPLGAATAGVAALAGANAKNVSPPPQAAAWPGGAAAEEAAVGGKEEWQLTPLDMGLGAGEGWDAAGSVLSDGAAPPGLAPDHTFLRWIIGGEDASVGMGAVMDPPVLELDHAPSMMSPAFGSNMPFAPAMEDTKAPPFGHASNLLLHHHQHHPQPHAAFFGSHPSFDAAPPTPKRHHPMAPAPAPKLQSLPGPAAPAGRFVPAMKPKAEAANDEAAAAVEQLAEAAKLAEAGDAFGAREILARLNYRLPAAPAAGTPLLRSAFYFKEALRLALSPTGEAPAPPVSTPYDVVLKLGAYKAFSEVSPVLQFAHLTCVQAVLDEIGGAGRIHVLDFDIGMGEQWASLMQELAQRCPAATLKVTALVSPATHHPLELQLIHENLAGFAAELGVFLQLAVFNIDTLDPAELVAITSGDAVAVHLPVGSAHVAAMPAVLRLVKRLGAKVVISVDHGGDRTELPFAAHLFQAFQSCVSLLESVDAVRPDADAVAKMERFLVQPGVERRVVARHRAAAMDKPPLPWRTVLASAGFVPVQASTFAESQAEALLKRMALMGFRVEKRGGALCLYWQRGELVSVSAWRC

SEQ ID NO: 3575 - protein, 530 aa, Oryza sativa subsp. indica
  misc_feature (1)..(530): useful for making plants with increased salt and oxidative stress resistance as described in USSN 12/922,143
  misc_feature (1)..(530): Public GI ID no.125542051
  misc_feature (1)..(530): Bit score of 535.3 for HMM based on sequences of FIGURE 6 of USSN 12/922,143.
  misc_feature (136)..(441): Pfam Name: GRAS Pfam Description: GRAS family transcription factor
  misc_feature (1)..(530): Functional Homolog Of Ceres LOCUS ID no. At4g00150
MWGWGREHCSLPALEREKREGEIELVDVWGRARGWLGEGQLGKGSPRSVVGGVIVEWELAASSSSFTLTSPGLRPPTHAASTPPPPPWLDDADHHHDNAFLHWVINDHHHPLLDLDDVDLDYAKPAPFFFADRGLHHHHPASSSFPNPKPTADDNTSTVEQLVQAAKLTEAGDVLAARHILARPAINYRLPASAAPPLLRSALYFKDALRRALISDDDDSSSSTPPPPLHEPHPHDLLLKLTAYKSFSDLSPLLHFAHFTCVQAVLDELSPSASCIHLLDFDIGVGEQWASLMHDLAHRHPGVALKVTALNVTASSSSHHPLQLQLIHDTLSTFAADLSVPFRFAAFNLDATDLTPLLAVAAATDAIAVHLPVGSVHATAVPSVLHLVRRLGAKLVVSVDRGCDRGELPFAAHLLQALRSTVSLLESLDAMGTDSDVAAKIERFWVQPKIQECVRAAVGVGGDKTAASAWRATLASAGFVPVQVSSMAEAQAESLLKKLPVRGFRLERRAGSLFLHWQRGELASVSAWRC

SEQ ID NO: 3576 - protein, 479 aa, Oryza sativa subsp. indica
  misc_feature (1)..(479): useful for making plants with increased salt and oxidative stress resistance as described in USSN 12/922,143
  misc_feature (1)..(479): Public GI ID no.125553722
  misc_feature (1)..(479): Bit score of 909.9 for HMM based on sequences of FIGURE 6 of USSN 12/922,143.
  misc_feature (127)..(397): Pfam Name: GRAS Pfam Description: GRAS family transcription factor
  misc_feature (1)..(479): Functional Homolog Of Ceres LOCUS ID no. At4g00150
MSSSSCHPHNPTTLPLPEPDSSKSPEPTSVLYNRSSPSTSLGSCSSKPPEDPPPPPIAADDDCDWDAVVDMHMHMLAPAPAPDSSFLRWIMDTGYADADTFPDHPSFDSDLLQLPMPMPSDHPPQPLVDDLLDAARLLDAGDSTSAREILARLNHRLPSLPSPPGHAHPPLLRAAALLRDALLPPTALPVSSTPLDVPLKLAAHKALADASPTVQFTTFTSTQAFLDALGSARRLHLLDFDVGFGAHWPPLMQELAHHWRRAAGPPPNLKVTALVSPGSSHPLELHLTNESLTRFAAELGIPFEFTALVFDPLSSASPPLGLSAAPDEAVAVHLTAGSGAFSPAPAHLRVVKELRPAVVVCVDHGCERGALNLLRSCAALLESLDAAGASPDVVSKVEQFVLRPRVERLAVGVGGGPPLQSMLASAGFAALQVSNAAEAQAECLLRRTASHGFHVEKRPAALALWWQRSELVSVSAWRC

SEQ ID NO: 3577 - protein, 711 aa, Oryza sativa subsp. japonica
  misc_feature (1)..(711): useful for making plants with increased salt and oxidative stress resistance as described in USSN 12/922,143
  misc_feature (1)..(711): Public GI ID no.115459828
  misc_feature (1)..(711): Bit score of 1562.3 for HMM based on sequences of FIGURE 6 of USSN 12/922,143.
  misc_feature (326)..(626): Pfam Name: GRAS Pfam Description: GRAS family transcription factor
  misc_feature (1)..(711): Functional Homolog Of Ceres LOCUS ID no. At4g00150
MRAAPFSADGNGAAELAGSIAALLWPEDKGGGGGGGGGSLLVEPRSVLDCRGSPSPPNSTSTLSSSHGSGAADSISTGVAAVSESSAAAAEATRWAAPGEHGGGGGGELPPIPGALDVGFVAEESWDAMLGDAAAAAGQEQTFLNWIMAAPGDMEPQAPGLSQQQLLANAAGFGFPLQHHPGGVSSPAALASDLSSSGGRSLTSSSGSNSKATSAFGLLSPEAALQPPPATTAPFHNGADMKPPLLGLPSPTLLLNQHQPTPASTLFMPFPSFSDHQQQPLLQPPPKRHHSVPDNLFLLHNQPQPPPPAPAQCLPFPTLHSAVPFQLQPSMQHPRNAMKSTAAAAAAQQQHLLDELAAAAKATEVGNSIGAREILARLNQQLPPIGKPFLRSASYLKDALLLALADGHHAATRLTSPLDVALKLTAYKSFSDLSPVLQFANFTVTQALLDEIASTTASCIRVIDFDLGVGGQWASFLQELAHRCGSGGVSLPMLKLTAFVSAASHHPLELHLTQDNLSQFAADLGIPFEFNAINLDAFDPMELIAPTADEVVAVSLPVGCSARTPLPAMLQLVKQLAPKIVVAIDYGSDRSDLPFSQHFLNCLQSCLCLLESLDAAGTDADAVSKIERFLIQPRVEDAVLGRRRADKAIAWRTVLTSAGFAPQPLSNLAEAQADCLLKRVQVRGFHVEKRGAGLALYWQRGELVSVSAWRC

SEQ ID NO: 3578 - protein, 558 aa, Oryza sativa subsp. japonica
  misc_feature (1)..(558): useful for making plants with increased salt and oxidative stress resistance as described in USSN 12/922,143
  misc_feature (1)..(558): Public GI ID no.125591237
  misc_feature (1)..(558): Bit score of 1147.0 for HMM based on sequences of FIGURE 6 of USSN 12/922,143.
  misc_feature (173)..(473): Pfam Name: GRAS Pfam Description: GRAS family transcription factor
  misc_feature (1)..(558): Functional Homolog Of Ceres LOCUS ID no. At4g00150
MEPQAPGLSQQQLLANAAGFGFPLQHHPGGVSSPAALASDLSSSGGRSLTSSSGSNSKATSAFGLLSPEAALQPPPATTAPFHNGADMKPPLLGLPSPTLLLNQHQPTPASTLFMPFPSFSDHQQQPLLQPPPKRHHSVPDNLFLLHNQPQPPPPAPAQCLPFPTLHSAVPFQLQPSMQHPRNAMKSTAAAAAAQQQHLLDELAAAAKATEVGNSIGAREILARLNQQLPPIGKPFLRSASYLKDALLLALADGHHAATRLTSPLDVALKLTAYKSFSDLSPVLQFANFTVTQALLDEIASTTASCIRVIDFDLGVGGQWASFLQELAHRCGSGGVSLPMLKLTAFVSAASHHPLELHLTQDNLSQFAADLGIPFEFNAINLDAFDPMELIAPTADEVVAVSLPVGCSARTPLPAMLQLVKQLAPKIVVAIDYGSDRSDLPFSQHFLNCLQSCLCLLESLDAAGTDADAVSKIERFLIQPRVEDAVLGRRRADKAIAWRTVLTSAGFAPQPLSNLAEAQADCLLKRVQVRGFHVEKRGAGLALYWQRGELVSVSAWRC

SEQ ID NO: 3579 - DNA, 2148 bp, Sorghum bicolor
  misc_feature (1)..(2148): useful for making plants with increased salt and oxidative stress resistance as described in USSN 12/922,143
  misc_feature (1)..(2148): Ceres ANNOT ID no.6017571
atgagggcggcgctgttcggtgcccagcggagcggggctgcggacctcgtcggaggcgggaggacgctgctctggccggaggaggggaaggcgaaggcgcagctggagccgagatccgtgccggactgcacgcggagccccagccccagcaactcaacatcgacgctgtcgtcgtacatgggcggtggcggcgctgcggactcgaccggcggcgtggcggtggtttcgggcagcagcgctgccgccgccgccgacgccgccaaatggggagcctccggcaagcacggcggcggcgggaaggaggactgggcaggcggctgtgcgctgccgccgattcctaccggcctcgacatgggggtcatcggcggcggcgacagctgggacgccatgctcggcagcgcggctgcggcgggacaggaccagacgttcttgaactggatcattggagccgccggcgacctggatcagtcagggccgccgctccccgtgcaccagcagccgctccttgacaatgtgggcttcgggttcccggcggcggaccccctgggtttctcgctcgatccccacctcggcggcgttgcctcggacatgtcgtcccctggtgcggtgtcgcacgctcccaacagcggcggcggtggtggcaacaaggcgtcctcggccttcggcctcttctcaccggagtctgcttcgctccagccgccgccgccgccggtgctgttccacgaaggtatcgacacaaagccccctcttcttggtgcgcagccgcccggccgcctccaccagtaccagcaccagccgacctccgccacaaccttcttcatgcccatcccctccttccccaatcacaatcagcagtcgccactcgtccaaccaccgcccaaacgtcatcaatccataggggatgacctctatctcgcccgaaatcggcttctgcctccgccggcggggcaaggtcacgcctttccaccactaaatggtcctgctctgttccagctccagccttcgccaccaccgccccacggggcgatgaagacgacggctgctgaggcggcgcagcagcagttgctggacgagcttgcggtggcggcaaaggccgccgaagccggcaattccattggcgcgcgagagatattggcgcggctcaatcaccagcttcccccgctcgggaagccgttcctccgctccgcctcctacctcaaggaggccctcctcctcgcgctcgccgaaggccaccatggcggctgccacctcacatcaccgctcgacgttgccctcaagctcgcggcgtacaagactttctctgatcactcgcccgtgctccagttcaccaacttcaccgcaacgcaggcacttctggacgaaattgccggcaacacatcatcctgcatccatgtcatcgattttgatcttgctgttggaggccagtgggcttctttcttgcaggagcttgcacaccgccgtggcgcaggtggtgcagctctgccgttcgtcaagctcactgcctttgtatcagctgcttcccaccatccactggaactgcgtcttgcgcgtgacaacattgcacagtttgctgcagaccttggaattccctttgagttcagtgctatcagtgctgatactatcaaccctacagagctcatttctgccactggtgatgaagttgtagctgttgtcctcccggctggttgctctgctcgtgcaccaccactgccagcgatccttcggttggtgaaacagctggctcctaagattgtgatagccatagaccatggcgctgatcgtgctgatcttcccttctcacagcacttcttgaattgctttcagtcttgcatgttcctccttgattcgcttgatgctgctggcattgatgctgattctgccggcaagattgagaagttccttattcagccaagaattgaggattcagtgcttgggcgggccaaggtggacaagccaattgcatggagaagtgcattcgcagctgctgggttcgcgcctattccgcccagcagtttggctgaggcgcaggctgactgcctcctgaagcgggtgcaggtccgcggtttccacgtggagaaatgtggggtcgggctcacactatactggcagcgaggcgagcttgtcactgtatcagcatggcggtgctga

SEQ ID NO: 3580 - protein, 715 aa, Sorghum bicolor
  misc_feature (1)..(715): useful for making plants with increased salt and oxidative stress resistance as described in USSN 12/922,143
  misc_feature (1)..(715): Ceres ANNOT ID no.6017571
  misc_feature (1)..(715): Bit score of 1550.4 for HMM based on sequences of FIGURE 6 of USSN 12/922,143.
  misc_feature (333)..(630): Pfam Name: GRAS Pfam Description: GRAS family transcription factor
  misc_feature (1)..(715): Functional Homolog Of Ceres LOCUS ID no. At4g00150
MRAALFGAQRSGAADLVGGGRTLLWPEEGKAKAQLEPRSVPDCTRSPSPSNSTSTLSSYMGGGGAADSTGGVAVVSGSSAAAAADAAKWGASGKHGGGGKEDWAGGCALPPIPTGLDMGVIGGGDSWDAMLGSAAAAGQDQTFLNWIIGAAGDLDQSGPPLPVHQQPLLDNVGFGFPAADPLGFSLDPHLGGVASDMSSPGAVSHAPNSGGGGGNKASSAFGLFSPESASLQPPPPPVLFHEGIDTKPPLLGAQPPGRLHQYQHQPTSATTFFMPIPSFPNHNQQSPLVQPPPKRHQSIGDDLYLARNRLLPPPAGQGHAFPPLNGPALFQLQPSPPPPHGAMKTTAAEAAQQQLLDELAVAAKAAEAGNSIGAREILARLNHQLPPLGKPFLRSASYLKEALLLALAEGHHGGCHLTSPLDVALKLAAYKTFSDHSPVLQFTNFTATQALLDEIAGNTSSCIHVIDFDLAVGGQWASFLQELAHRRGAGGAALPFVKLTAFVSAASHHPLELRLARDNIAQFAADLGIPFEFSAISADTINPTELISATGDEVVAVVLPAGCSARAPPLPAILRLVKQLAPKIVIAIDHGADRADLPFSQHFLNCFQSCMFLLDSLDAAGIDADSAGKIEKFLIQPRIEDSVLGRAKVDKPIAWRSAFAAAGFAPIPPSSLAEAQADCLLKRVQVRGFHVEKCGVGLTLYWQRGELVTVSAWRC

SEQ ID NO: 3581 - DNA, 2163 bp, Sorghum bicolor
  misc_feature (1)..(2163): useful for making plants with increased salt and oxidative stress resistance as described in USSN 12/922,143
  misc_feature (1)..(2163): Ceres ANNOT ID no.6026716
atgagggcggcgcccttcagtgccgacgggagcggggcggggaccatagaggcgctgctttggccggacgggaagggcggcggcggcggaggggacctgctggtggagccgacgtcggtgctggactgcagacggagcccgagcccgccgtactcgacatcgacgctgtcttcgtccctgggcggcgccgcgggggactcctcttccggcgtggcggcggtttcggacaacagcgccgccgccgccgccgaagccaccaaatgggcggcgccaggcgagcacggcggcggcggcggtggaggcggaggcgggggcgggaggaaggaggagtggtccggcggtgagctgccgcccataccggggaccctggacgtcgggttcgtcggggaggagggctgggacgccatgctcggcgacgccacggcggtggccggtcaggaccagacgttcctcaactggatcatgaccgcgccgggcgacatggagccgccagcgccgccgctcctcggcaatgccgccggctttgggttcccgacctcggacccgctcgggttctccctgcagcatcacccaggcggcggcggcggcgcctcggccggggcgctggcctccgacctgtcgtcccccggcgcgaggtcgctcaccagcagcagcggcagcagcagcaaggccacttccactttcggcctcctaccaaccgaggccgtgcttcagccgccgccgccggcggccacgaccatgcctttccacgacggtggcgacataaagcccccgcttcttggagtcccgtcggcaaatctactcctcaatcaacaccagacgttgccggcggcctccttcttcatgccgctcccctccttccccgaccatcagcaccagccacatctcccgcccccgccgaagcgccaccactctatgcccgacaacctgttcctcctccaaaaccagctccaaccgccgccgcagggtctaccgttcccaccagtgcataacaccgggcccttccagctccagccatcgctgcaaccgccgcgaggagcgttgaaaacaaccccggcggcgcagcaacatcaacagcttctggacgagcttgctgcggcggcaaaggcggctgaggtcggcaactccatcggcgcgctcgagatattggcgcggctcaatcagcagcttcccccagtcgggaagcctttcctccgctccgcttcctacctcaaggaggccctcctcctcgcgctctcggacggccaccagggctccacccgcctaacctctccgatcgacgtcgtcctcaagctcggtgcatacaagtctttctccgacctctcgcctgtgctccagttcgccaatttcacggccactcaggcgcttctcgacgagatcgcctcaaccacttcatcgtgtatccgcatcattgatttcgaccttggtgttggcggccagtgggcttcctttctgcaggagcttgcacaccgccgtggaactgggaatgtcaccctgccaatgttgaagctcacggccttcgtctcaagtgcttcccaccacccgcttgagctgcatcttactcgggagaacctctcacaatttgctgcggaccttggcattccatttgagttcactgccatcaatctcgatgcatttgatccagcggaactcattcctcctactgccgatgaggttgtcgctgtttgcctccctgttggttgctctgcacgcatgccaccgcttccaatgttgcttcagttagtgaaacaacttgctcctaagattgctgtggctattgaccatggcagtgaccggggtgacctcccattttcacagcacttcatgaattgcttccagtcttgtatgttccttctcgactcacttgatgctgctggcactaatgcggatgctgccagtaagattgagaggtttctgatccaatcgagagtagaggatgcagtacttggccggcgtaaagctgaaaaggcaatggcttggcgggcagtgtttacatcagccgggtttgctccagtgccgctcagcaaccttgcagaagcacaagctgactgcctcttgaagcgggtgcaggtccgtggattccatgtggagaagtgtggaatgggtctagcactctactggcagcgcggtgagctcgtgtctgtctcggcatggcggtgctga

SEQ ID NO: 3582 - protein, 720 aa, Sorghum bicolor
  misc_feature (1)..(720): useful for making plants with increased salt and oxidative stress resistance as described in USSN 12/922,143
  misc_feature (1)..(720): Ceres ANNOT ID no.6026716
  misc_feature (1)..(720): Bit score of 1328.0 for HMM based on sequences of FIGURE 6 of USSN 12/922,143.
  misc_feature (339)..(635): Pfam Name: GRAS Pfam Description: GRAS family transcription factor
  misc_feature (1)..(720): Functional Homolog Of Ceres LOCUS ID no. At4g00150
MRAAPFSADGSGAGTIEALLWPDGKGGGGGGDLLVEPTSVLDCRRSPSPPYSTSTLSSSLGGAAGDSSSGVAAVSDNSAAAAAEATKWAAPGEHGGGGGGGGGGGGRKEEWSGGELPPIPGTLDVGFVGEEGWDAMLGDATAVAGQDQTFLNWIMTAPGDMEPPAPPLLGNAAGFGFPTSDPLGFSLQHHPGGGGGASAGALASDLSSPGARSLTSSSGSSSKATSTFGLLPTEAVLQPPPPAATTMPFHDGGDIKPPLLGVPSANLLLNQHQTLPAASFFMPLPSFPDHQHQPHLPPPPKRHHSMPDNLFLLQNQLQPPPQGLPFPPVHNTGPFQLQPSLQPPRGALKTTPAAQQHQQLLDELAAAAKAAEVGNSIGALEILARLNQQLPPVGKPFLRSASYLKEALLLALSDGHQGSTRLTSPIDVVLKLGAYKSFSDLSPVLQFANFTATQALLDEIASTTSSCIRIIDFDLGVGGQWASFLQELAHRRGTGNVTLPMLKLTAFVSSASHHPLELHLTRENLSQFAADLGIPFEFTAINLDAFDPAELIPPTADEVVAVCLPVGCSARMPPLPMLLQLVKQLAPKIAVAIDHGSDRGDLPFSQHFMNCFQSCMFLLDSLDAAGTNADAASKIERFLIQSRVEDAVLGRRKAEKAMAWRAVFTSAGFAPVPLSNLAEAQADCLLKRVQVRGFHVEKCGMGLALYWQRGELVSVSAWRC

SEQ ID NO: 3583 - DNA, 1499 bp, Arabidopsis thaliana
  misc_feature (1)..(1499): useful for making plants with increased salt and oxidative stress resistance as described in USSN 12/922,143
  misc_feature (1)..(1499): Ceres SEEDLINE ID no.ME01395
  misc_feature (1)..(1499): Expected Sequence
atcaatggaggtttttgattcgccccaagctctcgcgattcctgatgttcttcagtaatttcttgcaatccttataaacaaagagcgtggagaatcgtttcagaggaaagaaaactaaaaatggcgactcttttcaacaaatttcagcaggctgttggagttcttgccaagagtaccacatttgctaagaacccaaggcaactgcagtttgaagcagacgttaacaaactctttatgtatacaagctataaccggttgggacgagaagctgaggagactgatgcagaggagatcattgagatggctggtaaagccactttatctgagcagcagaagcaagttcaagagaacattcactaccaagttgaaaaattctgctctttgatggatggaatccttcttcctgatgttaggaggaacgagtcggggtcacaatcaacaagccctcgtcctcctcgtagaagtggtcttactttcgccattggtagtaataatgcttttccacatgcagatcagccccttgttcccgagacaaagcctttgaaactcgctgacgtctcacagagattaatggatcaaatgggctacaccctcgagatcaaaccgtctgtaatacctcacaaagacgctggtcaaggttgttttatcaaaggcgaagcagatgttggaactgtcttagccttttaccctggagttatttattctcctgctttctacaggtacattcccgggtacccgaaggttgattcacagaactcgtatctcatcaccaggtatgatgggactgtgataaatgctcaaccttggggtcttgggggagaatcaagggaagcctggaacgggtcctacactcctgcggtcaaaacaaacactaaaaccgcagaaaacggttcagacaggttatggaaagcgttgagcaagcctctcgaaggttcgggtaaaggaaaagaggttcttgagaggagaaatccgttggcttttggtcacttagctaaccacccggcgaaagaaatgactccaaacgttatgatatgtccttatgacttccccttgatggcgaaagatctgcggccttacattccgaatatatcttttggggattctggagaaataaagatgaagagatttggaagcttctggttcaagacagggagtaaagacgggttagaagccccggttctgaagacactggtgttagtggcaacgaggtcgttgtgtaatgaggaactattactgaattacaggctgagcaactctaagagacgaccagattggtatactccggttaacgaagaggaagatcggagaagatggagctaaagttctcttttatgttttaatgaaacttgaaaggctctgtttcaaaacatgctcctcggttttctttggactattagtgcgacgtcgttttctgagtgtttcactattttggtttttcgattatttttggaagacattttattctaatcttttaaagacatttatgttgttcggttgtc

SEQ ID NO: 3584 - DNA, 1514 bp, Arabidopsis thaliana
  misc_feature (1)..(1514): useful for making plants with increased salt and oxidative stress resistance as described in USSN 12/922,143
  misc_feature (1)..(1514): Ceres SEEDLINE ID no.ME01395
  misc_feature (1)..(1514): Inplanta Sequence
atcaatggaggtttttgattcgccccaagctctcgcgattcctgatgttctccagtaatttcttgcaatccttataaacaaagagcgtggagaatcgtttcagaggaaagaaaactaaaaatggcgactcttttcaacaaatttcagcaggctgttggagttcttgccaagagtaccacatttgctaagaacccaaggcaactgcagtttgaagcagacgttaacaaactctttatgtatacaagctataaccggttgggacgagaagctgaggagactgatgcagaggagatcattgagatggctggtaaagccactttatctgagcagcagaagcaagttcaagagaacattcactaccaagttgaaaaattctgctctttgatggatggaatccttcttcctgatgttaggaggaacgagtcggggtcacaatcaacaagccctcgtcctcctcgtagaggtggtcttactttcgccattggtagtaataatgcttttccacatgcagatcagccccttgttcccgagacaaagcctttgaaactcgctgacgtctcacagagattaatggatcaaatgggctacaccctcgagatcaaaccgtctgtaatacctcacaaagacgctggtcaaggttgttttatcaaaggcgaagcagatgttggaactgtcttagccttttaccctggagttatttattctcctgctttctacaggtacattcccgggtacccgaaggttgattcacagaactcgtatctcatcaccaggtatgatgggactgtgataaatgctcaaccttggggtcttgggggagaatcaagggaggcctggaacgggtcctacactcctgcggtcaaaacaaacactaaaaccgcagaaaacggttcagacaggttatggaaagcgttgagcaagcctctcgaaggttcgggtaaaggaaaagaggttcttgagaggagaaatccgttggcttttggtcacttagctaaccacccggcgaaagaaatgactccaaacgttatgatatgtccttatgacttccccttgatggcgaaagatctgcggccttacattccgaatatatcttttggggattctggagaaataaagatgaagagatttggaagcttctggttcaagacagggagtaaagacgggttagaagccccggttctgaagacactggtgttagtggcaacgaggtcgttgtgtaatgaggaactattactgaattacaggctgagcaactctaagagacgaccagattggtatactccggttaacgaagaggaagatcggagaagatggagctaaagttctcttttatgttttaatgaaacttgaaaggctctgtttcaaaacatgctcctcggttttctttggactattagtgcgacgtcgttttctgagtgtttcactattttggtttttcgattatttttggaagacattttattctaatcttttaaagacatttatgttgttcggttgtcaaaaaaaaaaaaaaa

SEQ ID NO: 3585 - protein, 399 aa, Arabidopsis thaliana
  misc_feature (1)..(399): useful for making plants with increased salt and oxidative stress resistance as described in USSN 12/922,143
  misc_feature (1)..(399): Ceres SEEDLINE ID no.ME01395
  misc_feature (1)..(399): Bit score of 991.7 for HMM based on sequences of FIGURE 8 of USSN 12/922,143.
MATLFNKFQQAVGVLAKSTTFAKNPRQLQFEADVNKLFMYTSYNRLGREAEETDAEEIIEMAGKATLSEQQKQVQENIHYQVEKFCSLMDGILLPDVRRNESGSQSTSPRPPRRGGLTFAIGSNNAFPHADQPLVPETKPLKLADVSQRLMDQMGYTLEIKPSVIPHKDAGQGCFIKGEADVGTVLAFYPGVIYSPAFYRYIPGYPKVDSQNSYLITRYDGTVINAQPWGLGGESREAWNGSYTPAVKTNTKTAENGSDRLWKALSKPLEGSGKGKEVLERRNPLAFGHLANHPAKEMTPNVMICPYDFPLMAKDLRPYIPNISFGDSGEIKMKRFGSFWFKTGSKDGLEAPVLKTLVLVATRSLCNEELLLNYRLSNSKRRPDWYTPVNEEEDRRRWS

SEQ ID NO: 3586 - DNA, 1499 bp, Arabidopsis thaliana; identical to SEQ ID NO: 3583
  misc_feature (1)..(1499): useful for making plants with increased salt and oxidative stress resistance as described in USSN 12/922,143
  misc_feature (1)..(1499): Ceres CLONE ID no.151087

SEQ ID NO: 3587 - protein, 399 aa, Arabidopsis thaliana
  misc_feature (1)..(399): useful for making plants with increased salt and oxidative stress resistance as described in USSN 12/922,143
  misc_feature (1)..(399): Ceres CLONE ID no.151087
  misc_feature (1)..(399): Bit score of 993.0 for HMM based on sequences of FIGURE 8 of USSN 12/922,143.
  misc_feature (1)..(399): Functional Homolog Of Ceres SEEDLINE ID no. ME01395
MATLFNKFQQAVGVLAKSTTFAKNPRQLQFEADVNKLFMYTSYNRLGREAEETDAEEIIEMAGKATLSEQQKQVQENIHYQVEKFCSLMDGILLPDVRRNESGSQSTSPRPPRRSGLTFAIGSNNAFPHADQPLVPETKPLKLADVSQRLMDQMGYTLEIKPSVIPHKDAGQGCFIKGEADVGTVLAFYPGVIYSPAFYRYIPGYPKVDSQNSYLITRYDGTVINAQPWGLGGESREAWNGSYTPAVKTNTKTAENGSDRLWKALSKPLEGSGKGKEVLERRNPLAFGHLANHPAKEMTPNVMICPYDFPLMAKDLRPYIPNISFGDSGEIKMKRFGSFWFKTGSKDGLEAPVLKTLVLVATRSLCNEELLLNYRLSNSKRRPDWYTPVNEEEDRRRWS

SEQ ID NO: 3588 - protein, 399 aa, Arabidopsis thaliana
  misc_feature (1)..(399): useful for making plants with increased salt and oxidative stress resistance as described in USSN 12/922,143
  misc_feature (1)..(399): Public GI ID no.10177809
  misc_feature (1)..(399): Bit score of 980.3 for HMM based on sequences of FIGURE 8 of USSN 12/922,143.
  misc_feature (1)..(399): Functional Homolog Of Ceres SEEDLINE ID no. ME01395
MATLFNKFQQAVGVLAKSTTFAKNPRQLQFEADVNKLFMYTSYNRLGREAEETDAEEIIEMAGKATLSEQQKQVQENIHYQVEKFCSLMDGILLPDVRRNESGSQSTSPRPPRRSGLTFAIGSNNAFPHADQPLVPETKPLKLNDVSQRLMDQMGYTLETKPSVIPHKDAGQGCFIKGEADVGTVLAFYPGVIYSPAFYKYIPGYPKVDSQNSYLITRYDGTVINAQPWGLGGESREAWNGSYTPAVKANTKTAENGSDRLWKALSKPLEGSGKGKEVLERRNPLAFGHLANHPAKEMTPNVMICPYDFPLMAKDLRPYIPNISFGDSGEIKMKRFGSFWFKTGSKNGLEAPVLKTLVLVATRSLCNEELLLNYRLSNSKRRPDWYTPVNEEEDRRRWS

SEQ ID NO: 3589 - DNA, 1224 bp, Populus balsamifera subsp. trichocarpa
  misc_feature (1)..(1224): useful for making plants with increased salt and oxidative stress resistance as described in USSN 12/922,143
  misc_feature (1)..(1224): Ceres ANNOT ID no.1504145
atggcttctctttttaacaaatttcaagagtttgtgaaaactctagccaaaagtcccacatttgctagaaatccaagggagtttcaatttgaaacggacatgaatcgtctctttctttttaccagctacaatcgtttggggaaaaatgctgaggaggcagacgcggaggagatcattgaaatggccagtaaagcttctgttgctgatcagcagaaacaggttcaagaaaatatccactttcaaattacaaacttctgctcagctatgaatgaaattcttcttcccgatttggaaaaaagaagcaagaaggatgaagctcctgcacaatcaaatgctgctcctcggcgtagtggccttagttttgctgttggcaagagtggtccacctattgaccgtcctggtgagtttataacagctatacctgagacgaagcagttaagtcgtagcaaagtatcacagagtttaagggatgaaattggttacacacttgatctcaagccatctctgataccccacaaggaagctggagaaggtttgtttttaagtggtgaggctgatgtgggcactgtgattgccatataccctggtgtcatatacagccctgcttattaccggtatatcccagggtacccaagagttgatgcccagaacccatatttgatcactagatatgatgggactgtgatcaatgccctgccttggggttctgggggtgaaagtcgcgaagtgtgggatggcttaactgtgccagaaatcaggtctaatgtgcaaagtgttgagaaaggtcaagaccgggtctggagaatgctgagtaaacctttggaaggtacacgagttggttctattggtgatgtcttggagcggagaaacccattagcattggctcattttgctaaccacccagcgaagggtatggatccaaatgttatgatttgcccctatgacttcccactgactgagaaggatatgaggacctttataccaaacgtatcttttggaaatcatgaagaagtgaatatgagaagatttggcagtttttggttcaaatctagtgccaaaaatagcgtatctgatgttcctgttctcaagactctggttttagttgccactagggcgctttgtaatgaagaggtgctcctgaactacaggttgagcaacacaaaacgtcgaccagcatggtatagtccggtggatgaagaggaagaccggaggagatggagctaa

SEQ ID NO: 3590 - protein, 407 aa, Populus balsamifera subsp. trichocarpa
  misc_feature (1)..(407): useful for making plants with increased salt and oxidative stress resistance as described in USSN 12/922,143
  misc_feature (1)..(407): Ceres ANNOT ID no.1504145
  misc_feature (1)..(407): Bit score of 989.9 for HMM based on sequences of FIGURE 8 of USSN 12/922,143.
  misc_feature (1)..(407): Functional Homolog Of Ceres SEEDLINE ID no. ME01395
MASLFNKFQEFVKTLAKSPTFARNPREFQFETDMNRLFLFTSYNRLGKNAEEADAEEIIEMASKASVADQQKQVQENIHFQITNFCSAMNEILLPDLEKRSKKDEAPAQSNAAPRRSGLSFAVGKSGPPIDRPGEFITAIPETKQLSRSKVSQSLRDEIGYTLDLKPSLIPHKEAGEGLFLSGEADVGTVIAIYPGVIYSPAYYRYIPGYPRVDAQNPYLITRYDGTVINALPWGSGGESREVWDGLTVPEIRSNVQSVEKGQDRVWRMLSKPLEGTRVGSIGDVLERRNPLALAHFANHPAKGMDPNVMICPYDFPLTEKDMRTFIPNVSFGNHEEVNMRRFGSFWFKSSAKNSVSDVPVLKTLVLVATRALCNEEVLLNYRLSNTKRRPAWYSPVDEEEDRRRWS

SEQ ID NO: 3591 - protein, 386 aa, Arabidopsis thaliana
  misc_feature (1)..(386): useful for making plants with increased salt and oxidative stress resistance as described in USSN 12/922,143
  misc_feature (1)..(386): Public GI ID no.15241572
  misc_feature (1)..(386): Bit score of 721.2 for HMM based on sequences of FIGURE 8 of USSN 12/922,143.
  misc_feature (1)..(386): Functional Homolog Of Ceres SEEDLINE ID no. ME01395
MAFAKMMFLFGKFQQGVGVLAKSTTFAKNPRQLQFEADINKLFMFTSYNRLGRDAEEADAEEIIEMAGKATFSEQQKQVQENIHYQLQNFCSSMNEILLTNIDKTKDLNEPGSESRRDNIVPAADKPIVPETKPLKLDEVSHRLKDRVGYTLEIKPSLIPHKDAGQGCFIEGEADVGAVLAFYPGVIYSPAFHRYIPGYPNVDAQNSYLITGYDGTVINAQPWGRGGISREVWNGSFTTPEIRTEATTTENSSDKVWKMLSRPLEGSGGVEAVIEMRNPLAFGHFINHPGKEMESNVMICPYDFLLSETEMRAYIPNVAFGNTGDVKMGRFESFLSRTGSNSSLDAHVLKTIVLVATKALCNEELMLNYRLSNSEKRLEWYIPLDE

SEQ ID NO: 3592 - protein, 386 aa, Arabidopsis thaliana
  misc_feature (1)..(386): useful for making plants with increased salt and oxidative stress resistance as described in USSN 12/922,143
  misc_feature (1)..(386): Public GI ID no.26453064
  misc_feature (1)..(386): Bit score of 718.2 for HMM based on sequences of FIGURE 8 of USSN 12/922,143.
  misc_feature (1)..(386): Functional Homolog Of Ceres SEEDLINE ID no. ME01395
MAFAKMMFLFGKFQQGVGVLAKSTTFAKNPRQLQFEADINKLFMFTSYNRLGRDAEEADAEEIIEMAGKATFSEQQKQVQENIHYQLQNFCSSMNEILLTNIDKTKDLNEPGSESRRDNIVPAADKPIVPETKPLKLDEVSHRLKDRVGYTLEIKPSLIPHKDAGQGCFIEGEADVGAVLAFYPGVIYTPAFHRYIPGYPNVDAQNSYLITGYDGTVINAQPWGRGGISREVWNGSFTTPEIRTEATTTENSSDKVWKMLSRPLEGSGGVEAVIEMRNPLAFGHFINHPGKEMESNVMICPYDFLLSETEMRAYIPNVAFGNTGDVKMGRFESFLSRTGSNSSLDAHVLKTIVLVATKALCNEELMLNYRLSNSEKRLEWYIPLDE

SEQ ID NO: 3593 - DNA, 1488 bp, Populus balsamifera subsp. trichocarpa
  misc_feature (1)..(1488): useful for making plants with increased salt and oxidative stress resistance as described in USSN 12/922,143
  misc_feature (1)..(1488): Ceres ANNOT ID no.1451079
atggaggagaaggggatgactaatgtcgaacaaacataccaaacaaacaaaagacagaaagaaaggaaagcccaagctgaaaagcctactcattggggttccggttaccaaagaaatttggcccagcatgtatggacacaacttcggcctgagattttttcattcaacaaggcagaaggcaagagtgcgagtgttcctcagttgctgctgcagtttcttcaatggcttctctttttaacaaatttcaagagatattgggtagattcagggtcatgtttattgacaaggatggagtttgtgaaaactctagccaaaagtcccacatttgctagaaatccaagggagtttcaatttgaaacggacatgaatcgtctctttctttttaccagctacaatcgtttggggaaaaatgctgaggaggcagacgcggaggagatcattgaaatggccagtaaagcttctgttgctgatcagcagaaacaggttcaagaaaatatccactttcaaattacaaacttctgctcagctatgaatgaaattcttcttcccgatttggaaaaaagaagcaagaaggatgaagctcctgcacaatcaaatgctgctcctcggcgtagtggccttagttttgctgttggcaagagtggtccacctattgaccgtcctggtgagtttataacagctatacctgagacgaagcagttaagtcgtagcaaagtatcacagagtttaagggatgaaattggttacacacttgatctcaagccatctctgataccccacaaggaagctggagaaggtttgtttttaagtggtgaggctgatgtgggcactgtgattgccatataccctggtgtcatatacagccctgcttattaccggtatatcccagggtacccaagagttgatgcccagaacccatatttgatcactagatatgatgggactgtgatcaatgccctgccttggggttctgggggtgaaagtcgcgaagtgtgggatggcttaactgtgccagaaatcaggtctaatgtgcaaagtgttgagaaaggtcaagaccgggtctggagaatgctgagtaaacctttggaaggtacacgagttggttctattggtgatgtcttggagcggagaaacccattagcattggctcattttgctaaccacccagcgaagggtatggatccaaatgttatgatttgcccctatgacttcccactgactgagaaggatatgaggacctttataccaaacgtatcttttggaaatcatgaagaagtgaatatgagaagatttggcagtttttggttcaaatctagtgccaaaaatagcgtatctgatgttcctgttctcaagactctggttttagttgccactagggcgctttgtaatgaagaggtgctcctgaactacaggttgagcaacacaaaacgtcgaccagcatggtatagtccggtggatgaagaggaagaccggaggagatggagctaa

SEQ ID NO: 3594 - protein, 399 aa, Populus balsamifera subsp. trichocarpa
  misc_feature (1)..(399): useful for making plants with increased salt and oxidative stress resistance as described in USSN 12/922,143
  misc_feature (1)..(399): Ceres ANNOT ID no.1451079
  misc_feature (1)..(399): Bit score of 951.2 for HMM based on sequences of FIGURE 8 of USSN 12/922,143.
  misc_feature (1)..(399): Functional Homolog Of Ceres SEEDLINE ID no. ME01395
MEFVKTLAKSPTFARNPREFQFETDMNRLFLFTSYNRLGKNAEEADAEEIIEMASKASVADQQKQVQENIHFQITNFCSAMNEILLPDLEKRSKKDEAPAQSNAAPRRSGLSFAVGKSGPPIDRPGEFITAIPETKQLSRSKVSQSLRDEIGYTLDLKPSLIPHKEAGEGLFLSGEADVGTVIAIYPGVIYSPAYYRYIPGYPRVDAQNPYLITRYDGTVINALPWGSGGESREVWDGLTVPEIRSNVQSVEKGQDRVWRMLSKPLEGTRVGSIGDVLERRNPLALAHFANHPAKGMDPNVMICPYDFPLTEKDMRTFIPNVSFGNHEEVNMRRFGSFWFKSSAKNSVSDVPVLKTLVLVATRALCNEEVLLNYRLSNTKRRPAWYSPVDEEEDRRRWS

SEQ ID NO: 3595 - DNA, 1811 bp, Panicum virgatum
  misc_feature (1)..(1811): useful for making plants with increased salt and oxidative stress resistance as described in USSN 12/922,143
  misc_feature (1)..(1811): Ceres CLONE ID no.1786527
accccttctcccgtcttcacccccagctggagcgttccggccgacggcgtcgctcgatctcctagctcccgcggagccagcaaggggccgccggctgccgctctccgccgcgccgcgccagaatggctttcctcttcaacaaattccaggaggcggtcaaaacacttgctaagaaccccatgtttgctcgtgatccaagacatcttcaatttgaagctgatgtgaaccgtctgtttctctatacgagctattatcgtctgggagagaatgctgaagagaaggatgcagaggagattattgatttggctggcaaagcatctgttgccgaacagcagaatcaagtgcaggaaaatgtccactatcaacttacgcatatgtgccgagcaatggatggcattcttcgtcctgatataacaaatgacccgtcaaaagatccttcagaaacacatagctattctcggcgtagtggattgagttttgctgttggcggagctgcatctgcaaacaagcaaagtgcagctatccctgctacacggcctataactcgagcagaactgtcaaataaattcagggatcattttgggtacacccttgacatcagaccatctggaattcctcacaaagatgcaggccaaggtctgttcttatctggagaagcaaatgttggtgctgtccttgccatctatcctggtgttatatattcacctgcttattatcgatatatacctggatacccaagaattgatgcatgcaacaactatctgatcacaagatatgatggaacaataattgatgcaaaaccatggtctttggatggtgaaactagagatttatgggatggttcatatttggtggaccataacgctgtgccacctaaaggctcagataacaactctgatcgagtgtggagaatgcttagcaagcctcttgagaaaaatatgagggaaaattttggtgaagtgcttgaacgaagaaatccccttgcttttggtcattttgcaaatcatccaccaaaaggttcaagtcctaatgtcatgatctgcccatatgattttccgctgtcagagaagaacatgagagtatacatccctaacattacgtttggtggtgaagagcccattaagatgaagaggtttggctccttctatttcaagtctggaagttctgataatcaggctggggattctctagttctaaagacactagtattggtgagtacaagatccattcgcgatgaagagctcttccttaactaccgttacagtaactcaaagcggcgaccagaatggtatagccctgttgatgaagaagaggacaagaggagatggagctagttcagcacttctgtaccattctggctatgcaattgtttgctaacacttctgtttttcctggaaattgcaacagagcactaagctcctgaaatgagatggcagtttccggttcctattgtttggcctggcatttatcagcatgaaaaaagtagtccgcctccttgaaactctactcatgggtcgtttgtagcgcataaagaatactggttacattgttgttactccttttttgtgttccctatcccagtgatttaagggagattttatgaatccacaacaatagttttggcatggcatttatcatcatgagaaaaagtagagtgcctccagtaaactctactcgcgggtactttgtagcatataaagaatactgattacatttgttgttactccttttatgtgttccctacccccctgattgatttaagggagataaataatttatgaatctattgcctgatatcaaagtttactttg

SEQ ID NO: 3596 - protein, 403 aa, Panicum virgatum
  misc_feature (1)..(403): useful for making plants with increased salt and oxidative stress resistance as described in USSN 12/922,143
  misc_feature (1)..(403): Ceres CLONE ID no.1786527
  misc_feature (1)..(403): Bit score of 1021.8 for HMM based on sequences of FIGURE 8 of USSN 12/922,143.
  misc_feature (1)..(403): Functional Homolog Of Ceres SEEDLINE ID no. ME01395
MAFLFNKFQEAVKTLAKNPMFARDPRHLQFEADVNRLFLYTSYYRLGENAEEKDAEEIIDLAGKASVAEQQNQVQENVHYQLTHMCRAMDGILRPDITNDPSKDPSETHSYSRRSGLSFAVGGAASANKQSAAIPATRPITRAELSNKFRDHFGYTLDIRPSGIPHKDAGQGLFLSGEANVGAVLAIYPGVIYSPAYYRYIPGYPRIDACNNYLITRYDGTIIDAKPWSLDGETRDLWDGSYLVDHNAVPPKGSDNNSDRVWRMLSKPLEKNMRENFGEVLERRNPLAFGHFANHPPKGSSPNVMICPYDFPLSEKNMRVYIPNITFGGEEPIKMKRFGSFYFKSGSSDNQAGDSLVLKTLVLVSTRSIRDEELFLNYRYSNSKRRPEWYSPVDEEEDKRRWS

SEQ ID NO: 3597 - DNA, 1696 bp, Triticum aestivum
  misc_feature (1)..(1696): useful for making plants with increased salt and oxidative stress resistance as described in USSN 12/922,143
  misc_feature (1)..(1696): Ceres CLONE ID no.1005083
ctcactccccttcaccactgctcccgcagccttcgttcggccttgcccctcccgccgaaccaaggagtaccgggcgcggcggcggcggctaccgcccgcagggccagcatggcgtttctcttcaacaaattccaggaggcaatcaaaacacttgctaagagtccaagctttgctcgagacccacggcatcttcagtttgatgctgacgtgaatcgtttatttctctataccagctataatcgtttgggagagcattctgaagaaaaggacgccgaggagattattgacctggctagcaaagcatctgttactgaccagcagaagcaagttcagggaaatgttcattatcaacttaagcatatatgcaaatcaatggataacattcttcgtcctgatacaaaagatccatcacaatcttcttctgatgcttataataattctcgacgaagtggcttgagtttggccgttggcacaggagttgcagctgcaaacaagccagctgttcctgctacgcgacctttaactcaagctgaattgtcaaacaaattcagggatcagtttggctacacccttgacatcaagccgtcactaatacctcacaaagatgcagggcaaggtctgttcttatctggagaagctaatattggtgctgtcctagccatctaccctggagttatatactcacctgcgtattatcgatatatccctggatacccaagaatcgatgcgtgcaacagctatcttatcacaagatatgacggaacaataatcaacgcgaaaccatggcatttaggtggtgaaacaagagaaatatgggatggttcagatccagtggattacaatacaacgccacccaaaagcccagagagcaactctgaccgggcgtggaggatgcttaacaagcccctgcagaagagtggcactgaaaacttcggggatgtgcttgaacggcgaaatccactagcctttggtcatttcgcgaaccacccaccgggagggtcgactcctaatgtcatgatctgcccatatgattttccactgacagagaaggacatgagagtatacatcccgaacattgcatttggtggtgaagagcccgttacaatgaagaggtttggctccttctggttcaagtccagagcccctggtaaagagactggggagtcaccggttctgaggacgctagtaagtacgaggtccgtatgtgacgaagagctctacctgaactaccggtacagctcaaaggggcggccagactggtataccccagtggatgaagaagaggataagaggagatggagctaggtctgaaccgacctgcctgtaatgttttgttccaatgtttctttcatcagtaactggtgaactccagaagccgattcggccattctttctatgtttcagtcaaccgcataggtagtgtctctgctgaactcttctcgcaggtcttttgtggcaataaaaagaacaccagttacgtctcatgttatttgaggtagtatctgtattatccatcccgttgttgtaaggggatatttacgagcttatcactcaatctgtgtcagcagtgccatacttatttgctttcggaatagtaacaagctatgccatattgccagcgaactgcttctcatctaaataaatactacctcagtaacttaatataagacatttttttgacactattacagtgtcc

SEQ ID NO: 3598 - protein, 398 aa, Triticum aestivum
  misc_feature (1)..(398): useful for making plants with increased salt and oxidative stress resistance as described in USSN 12/922,143
  misc_feature (1)..(398): Ceres CLONE ID no.1005083
  misc_feature (1)..(398): Bit score of 1005.5 for HMM based on sequences of FIGURE 8 of USSN 12/922,143.
  misc_feature (1)..(398): Functional Homolog Of Ceres SEEDLINE ID no. ME01395
MAFLFNKFQEAIKTLAKSPSFARDPRHLQFDADVNRLFLYTSYNRLGEHSEEKDAEEIIDLASKASVTDQQKQVQGNVHYQLKHICKSMDNILRPDTKDPSQSSSDAYNNSRRSGLSLAVGTGVAAANKPAVPATRPLTQAELSNKFRDQFGYTLDIKPSLIPHKDAGQGLFLSGEANIGAVLAIYPGVIYSPAYYRYIPGYPRIDACNSYLITRYDGTIINAKPWHLGGETREIWDGSDPVDYNTTPPKSPESNSDRAWRMLNKPLQKSGTENFGDVLERRNPLAFGHFANHPPGGSTPNVMICPYDFPLTEKDMRVYIPNIAFGGEEPVTMKRFGSFWFKSRAPGKETGESPVLRTLVSTRSVCDEELYLNYRYSSKGRPDWYTPVDEEEDKRRWS

SEQ ID NO: 3599 - protein, 405 aa, Oryza sativa subsp. japonica
  misc_feature (1)..(405): useful for making plants with increased salt and oxidative stress resistance as described in USSN 12/922,143
  misc_feature (1)..(405): Public GI ID no.115447467
  misc_feature (1)..(405): Bit score of 1015.8 for HMM based on sequences of FIGURE 8 of USSN 12/922,143.
  misc_feature (1)..(405): Functional Homolog Of Ceres SEEDLINE ID no. ME01395
MGSLFIRFQEAVKTLAKNPMFANNRLFARDPRHLQFEADVNRLFLYTSYYRLGANAEEKDAEEIIDMASKASVSEQQKQVQENVHYQLTNMCQAMDSILLPDTKNGASEANNYPRRSGLSFAVGTGVASANKPDVPSTRPLNRAELSNKFRDHFQYTLDIRPSQIPHKDAGQGLFLSGETNAGAVLAIYPGVVYSPAYYRYIPGYPKIDACNNYLITRYDGTIIDAKPWQLGGDSREIWDGSDLVDYNAVPSKSQESNSDRAWRMLSKPLKKGHTENFGEVLERRNPLAFGHFANHPPKGSTPNVMICPYDFPLTEKDMRVYIPNITFGGEEEPVTMKRFGSFWFKSGRSGNQEGESPVLKTLVLVSTRSICDEELFLNYRYSNSKKRPEWYIPVDEEEDKRRWS

SEQ ID NO: 3600 - protein, 439 aa, Oryza sativa subsp. japonica
  misc_feature (1)..(439): useful for making plants with increased salt and oxidative stress resistance as described in USSN 12/922,143
  misc_feature (1)..(439): Public GI ID no.125582985
  misc_feature (1)..(439): Bit score of 986.3 for HMM based on sequences of FIGURE 8 of USSN 12/922,143.
  misc_feature (1)..(439): Functional Homolog Of Ceres SEEDLINE ID no. ME01395
MGSLFIRFQEVHTLSLFAVYIPPQTITSGSRSAPCASERSAVDPAVKTLAKNPMFANNRLFARDPRHLQFEADVNRLFLYTSYYRLGANAEEKDAEEIIDMASKASVSEQQKQVQENVHYQLTNMCQAMDSILLPDTKNGASEANNYPRRSGLSFAVGTGVASANKPDVPSTRPLNRAELSNKFRDHFQYTLDIRPSQIPHKDAGQGLFLSGETNAGAVLAIYPGVVYSPAYYRYIPGYPKIDACNNYLITRYDGTIIDAKPWQLGGDSREIWDGSDLVDYNAVPSKSQESNSDRAWRMLSKPLKKGHTENFGEVLERRNPLAFGHFANHPPKGSTPNVMICPYDFPLTEKDMRVYIPNITFGGEEEPVTMKRFGSFWFKSGRSGNQEGESPVLKTLVLVSTRSICDEELFLNYRYSNSKKRPEWYIPVDEEEDKRRWS

SEQ ID NO: 3601 - protein, 325 aa, Arabidopsis thaliana
  misc_feature (1)..(325): useful for making plants with increased salt and oxidative stress resistance as described in USSN 12/922,143
  misc_feature (1)..(325): Public GI ID no.8346564
  misc_feature (1)..(325): Bit score of 526.6 for HMM based on sequences of FIGURE 8 of USSN 12/922,143.
  misc_feature (1)..(325): Functional Homolog Of Ceres SEEDLINE ID no. ME01395
MAFAKMMFLFGKFQQGVGVLAKSTTFAKNPRQLQFEADINKLFMFTSYNRLGRDAEEADAEEIIEMAGKATFSEQQKQVQENIHYQLQNFCSSMNEILLTNIDKTKDLNEPGSESRRDNIVPAADKPIVPETKPLKLDEVSHRLKDRVGYTLEIKPSLIPHKDAGQGCFIEGEADVGAVLAFYPGVIYSPAFHRYIPGYPNVDAQNSYLITGYDGTVINAQPWGRGGISREVWNGSFTTPEIRTEATTTENSSDKVWKMLSRPLEGSGGVEAVIEMRNPLAFGHFINHPGKEMESNVMICPYDFLLSETEMRAYIPNVAFGNTGD

SEQ ID NO: 3602 - DNA, 1597 bp, Glycine max
  misc_feature (1)..(1597): useful for making plants with increased salt and oxidative stress resistance as described in USSN 12/922,143
  misc_feature (1)..(1597): Ceres CLONE ID no.667071
  misc_feature (1012)..(1012): m is a or c
  misc_feature (1222)..(1222): y is t/u or c
  misc_feature (1275)..(1275): y is t/u or c
  misc_feature (1336)..(1336): y is t/u or c
  misc_feature (1340)..(1340): r is g or a
  misc_feature (1427)..(1427): y is t/u or c
attactttttcgatttgttacacccattacctgctaccacacttctatgccttctcatttttctggtgctgctttgggagaataaggtttccgagcaataaatactggattcatttgatgacttttaaagtcttcaattgtgtgagtttcttttccagtatctaaaatttaatgtgcataaaaatcttgttgaggttgtgaatggtagcttcttcctccccaaatcaccgatggcttttttatttcagaaatttcaagaggctgtgaaaacccttgcaaaaaatcctgcttttgctagggatcctagtcaactacaatttgaagctgacattaaccgcttattcctttatacaagctacaatctgttgggaaagaatgctgatgaagcagatgcggaagagattattgaaattgccaataaagcctcttttgctgatcaacaaatgcaagtaaaagaaaatgttcattctcaaatcaaagcattttgcacgtacatggatgaaatgcttcttccaaatgaaaagagggtgaatgatcccatggaattatctcagcaggaaaacagttcacctcaccatagtgggctaaattctgctaaagttgtctctaaacaaagatcatatacccaagcagaagtttctcagaagttaaaagatcaacttggctacaagcttaatgttaaaccttctcaaatatctcacaaggattctggccaaggtctatttttagatggtgcagctgatgttggtgccgtaattgccttttatcctggtgtggtctattctccagcttattaccaatatattcccggataccttgatgagcagaacccctatttgattacaagatatgacgggactgtcattgatgcccaaccttggggttgtggaggtgaagggccggaacgattcaatggtagaaaaatgttagaaagaaagcttgacaatgaaggagctgagaagggttcagacagaatgagtaaacctttggaaggttcccaggtagaaaatgmcaatgaaaatgatgatgtagtcgagcgcagaaacccgttggccttggcacattttgctaatcaccccgcaaaagggatgcttccaaatgtcatgatttgcccttatgactttccattgactgaaaacaacatgagagtttacatacccaacatattatttggaaacgcagaagtaaacatcaagagacttggcagcttttggttcaaatytggagtttcaagaaatagtcaatcagatgttcttaccctgaaaactgttgttytggtagcaactaggagtcttcaagatgaagaactgctcctgaactacaggctgagcaactytaaraagtggccagaatggtatgctccagtggatgaagaagaggacataatgacaggaaaagatgaaagtagccaatgaccaacagttttytgtacgaaacaccttctcacatggtggcttagtagtggcatttgttccttaatttccctgtttttgcatgaaactgtggtagttgtctcgtcattgttttgataataatctctaaacagtcagaatgagtcgtatctttttgtgatggatgaaatgaaactttttgattt

SEQ ID NO: 3603 - protein, 394 aa, Glycine max
  misc_feature (1)..(394): useful for making plants with increased salt and oxidative stress resistance as described in USSN 12/922,143
  misc_feature (1)..(394): Ceres CLONE ID no.667071
  misc_feature (1)..(394): Bit score of 668.8 for HMM based on sequences of FIGURE 8 of USSN 12/922,143.
  misc_feature (1)..(394): Functional Homolog Of Ceres SEEDLINE ID no. ME01395
  misc_feature (261)..(261): Xaa is any aa, unknown or other
  misc_feature (331)..(331): Xaa is any aa, unknown or other
  misc_feature (349)..(349): Xaa is any aa, unknown or other
  misc_feature (369)..(369): Xaa is any aa, unknown or other
  misc_feature (370)..(370): Xaa is any aa, unknown or other
MAFLFQKFQEAVKTLAKNPAFARDPSQLQFEADINRLFLYTSYNLLGKNADEADAEEIIEIANKASFADQQMQVKENVHSQIKAFCTYMDEMLLPNEKRVNDPMELSQQENSSPHHSGLNSAKVVSKQRSYTQAEVSQKLKDQLGYKLNVKPSQISHKDSGQGLFLDGAADVGAVIAFYPGVVYSPAYYQYIPGYLDEQNPYLITRYDGTVIDAQPWGCGGEGPERFNGRKMLERKLDNEGAEKGSDRMSKPLEGSQVENXNENDDVVERRNPLALAHFANHPAKGMLPNVMICPYDFPLTENNMRVYIPNILFGNAEVNIKRLGSFWFKXGVSRNSQSDVLTLKTVVXVATRSLQDEELLLNYRLSNXXKWPEWYAPVDEEEDIMTGKDESSQ

SEQ ID NO: 3604 - protein, 386 aa, Oryza sativa subsp. indica
  misc_feature (1)..(386): useful for making plants with increased salt and oxidative stress resistance as described in USSN 12/922,143
  misc_feature (1)..(386): Public GI ID no.125540418
  misc_feature (1)..(386): Bit score of 777.6 for HMM based on sequences of FIGURE 8 of USSN 12/922,143.
  misc_feature (1)..(386): Functional Homolog Of Ceres SEEDLINE ID no. ME01395
MGSLFIRFQEVHTLSLFAVYIPPQTITSGSRSAPCASERSAVDPAVKTLAKNPMFANNRLFARDPRHLQFEADVNRLFLYTSYYRLGANAEEKDAEEIIDMASKASVSEQQKQVQENVHYQLTNMCQAMDSILLPDTKNGASEANNYPRRSGLSFAVGTGVASANKPAIYPGVVYSPAYYRYIPGYPKIDACNNYLITRYDGTIIDAKPWQLGGDSREIWDGSDLVDYNAVPSKSQESNSDRAWRMLSKPLKKGHTENFGEVLERRNPLAFGHFANHPPKGSTPNVMICPYDFPLTEKDMRVYIPNITFGGEEEPVTMKRFGSFWFKSGRSGNQVGESPVLKTLVLVSTRSICDEELFLNYRYSNSKKRPEWYIPVDEEEDKRRWS

SEQ ID NO: 3605 - DNA, 1425 bp, Populus balsamifera subsp. trichocarpa
  misc_feature (1)..(1425): useful for making plants with increased salt and oxidative stress resistance as described in USSN 12/922,143
  misc_feature (1)..(1425): Ceres ANNOT ID no.1451080
atggctataaggaaatcacctttccaaaacccacataggtttttcaatcaacgaagcacaagacaataccagacagcaagtgttgtgaaaactctagccaaaagtcccacagatggtacaagtacaaaggaccttaaacgtctctttattttaaccagatctgtaattgcttgttcttttgagtatcttgagtttctaatgagaggtaaagttttcagctgcaatcgtttgggaaggaatgctgataaggctgacgcaaaggatatcattgaaatggccaataaattttatgttgctgaacagcagaaacagatccaagaaaacatccattttcaaattaaaaacttctgcacagctatgaatgatattcttcttcctgatgcgagaaagagaagtaggaaggatgaagcacctgcacaatcaaatgctttttctgttggcaagagtggtccacctactgatcgtcatgctatacctgagatgaggcggttgagtcatgctgaagtatcacagagtttaaaggatcacattggttacacacttgatgtgaagccatctctgatgccccatgaaaaagctggacaaggtttgctcataaacggtgaggctgatgctggcgctgttattgccatataccccggcatcatacacagtcctgcttattaccagtacatcccagggtacccaagaattcatgcccggaaccggtacttgatcactagacatgatgggacagttatcaatgcacaaccttggggttttggtggtgaaattcgtgaagtgtgggatggcttcacagtgccagaaatcatgcctaatgtgcaaagtactggtaaagatggtccagagctagtctggagggtgttgagtaagcctttggaaggtactggggttggttctattggtgatgtcttggagaggagaaacccattagctttggctcattttgccaaccaggtagcagtgggcatgcatcaaaatgttatggcttgcccttatgacttcccactgaccgagatggatatgaggacctatataccaaatgtatcgtttgcaaatccagaagtgaatattagaagatatggcagtttttggttcagttccaaaagcagtgaatccaatgttcctgttctcaagactctcgtactagtcgctactagggcactctgtgatgaagaagtgctcgtagactacagagttagagcctctgtggctcttgagcatgtccttgtagtgccccaagtgggagatcgcattccatcttatcatccttccatccataaaacgctagtgagatttcgtagcccttgcaattggaaccacaagctgtgggacattctcatgtcaagctccaataaagaactcatctgttcatgtaaagtcattttaaaagagtcaatgagattgcaaatggagaactactga

SEQ ID NO: 3606 - protein, 408 aa, Populus balsamifera subsp. trichocarpa
  misc_feature (1)..(408): useful for making plants with increased salt and oxidative stress resistance as described in USSN 12/922,143
  misc_feature (1)..(408): Ceres ANNOT ID no.1451080
  misc_feature (1)..(408): Bit score of 522.0 for HMM based on sequences of FIGURE 8 of USSN 12/922,143.
  misc_feature (1)..(408): Functional Homolog Of Ceres SEEDLINE ID no. ME01395
MRGKVFSCNRLGRNADKADAKDIIEMANKFYVAEQQKQIQENIHFQIKNFCTAMNDILLPDARKRSRKDEAPAQSNAFSVGKSGPPTDRHAIPEMRRLSHAEVSQSLKDHIGYTLDVKPSLMPHEKAGQGLLINGEADAGAVIAIYPGIIHSPAYYQYIPGYPRIHARNRYLITRHDGTVINAQPWGFGGEIREVWDGFTVPEIMPNVQSTGKDGPELVWRVLSKPLEGTGVGSIGDVLERRNPLALAHFANQVAVGMHQNVMACPYDFPLTEMDMRTYIPNVSFANPEVNIRRYGSFWFSSKSSESNVPVLKTLVLVATRALCDEEVLVDYRVRASVALEHVLVVPQVGDRIPSYHPSIHKTLVRFRSPCNWNHKLWDILMSSSNKELICSCKVILKESMRLQMENY

SEQ ID NO: 3607 - DNA, 1143 bp, Populus balsamifera subsp. trichocarpa
  misc_feature (1)..(1143): useful for making plants with increased salt and oxidative stress resistance as described in USSN 12/922,143
  misc_feature (1)..(1143): Ceres ANNOT ID no.1504146
atggctataaggaaatcacctttccaaaacccacataggtttttcaatcaacgaagcacaagacaataccagacagcaagtgttgtgaaaactctagccaaaagtcccacagatggtacaagtacaaaggaccttaaacgtctctttattttaaccagatctgtaattgcttgttcttttgagtatcttgagtttctaatgagaggtaaagttttcagctgcaatcgtttgggaaggaatgctgataaggctgacgcaaaggatatcattgaaatggccaataaattttatgttgctgaacagcagaaacagatccaagaaaacatccattttcaaattaaaaacttctgcacagctatgaatgatattcttcttcctgatgcgagaaagagaactatacctgagatgaggcggttgagtcatgctgaagtatcacagagtttaaaggatcacattggttacacacttgatgtgaagccatctctgatgccccatgaaaaagctggacaaggtttgctcataaacggtgaggctgatgctggcgctgttattgccatataccccggcatcatacacagtcctgcttattaccagtacatcccagggtacccaagaattcatgcccggaaccggtacttgatcactagacatgatgggacagttatcaatgcacaaccttggggttttggtggtgaaattcgtgaagtgtgggatggcttcacagtgccagaaatcatgcctaatgtgcaaagtactggtaaagatggtccagagctagtctggagggtgttgagtaagcctttggaaggtactggggttggttctattggtgatgtcttggagaggagaaacccattagctttggctcattttgccaaccaggtagcagtgggcatgcatcaaaatgttatggcttgcccttatgacttcccactgaccgagatggatatgaggacctatataccaaatgtatcgtttgcaaatccagaagtgaatattagaagatatggcagtttttggttcagttccaaaagcagtgaatccaatgttcctgttctcaagactctcgtactagtcgctactagggcactctgtgatgaagaagtgctcgtagactacaggttgacaaacatgaagtgttag

SEQ ID NO: 3608 - protein, 314 aa, Populus balsamifera subsp. trichocarpa
  misc_feature (1)..(314): useful for making plants with increased salt and oxidative stress resistance as described in USSN 12/922,143
  misc_feature (1)..(314): Ceres ANNOT ID no.1504146
  misc_feature (1)..(314): Bit score of 459.2 for HMM based on sequences of FIGURE 8 of USSN 12/922,143.
  misc_feature (1)..(314): Functional Homolog Of Ceres SEEDLINE ID no. ME01395
MRGKVFSCNRLGRNADKADAKDIIEMANKFYVAEQQKQIQENIHFQIKNFCTAMNDILLPDARKRTIPEMRRLSHAEVSQSLKDHIGYTLDVKPSLMPHEKAGQGLLINGEADAGAVIAIYPGIIHSPAYYQYIPGYPRIHARNRYLITRHDGTVINAQPWGFGGEIREVWDGFTVPEIMPNVQSTGKDGPELVWRVLSKPLEGTGVGSIGDVLERRNPLALAHFANQVAVGMHQNVMACPYDFPLTEMDMRTYIPNVSFANPEVNIRRYGSFWFSSKSSESNVPVLKTLVLVATRALCDEEVLVDYRLTNMKC

SEQ ID NO: 3609 - DNA, 1212 bp, Sorghum bicolor
  misc_feature (1)..(1212): useful for making plants with increased salt and oxidative stress resistance as described in USSN 12/922,143
  misc_feature (1)..(1212): Ceres ANNOT ID no.6113886
atggcttccctcttcaacaagatccaagaggcgatcagaacaattgctaagagccccatgtttgctcgtgatccaaggcatcttcaatttgaagctgatgtaaatcgtttgtttctctatacgagctattctcgtctgggggagaatgctgaagagaaggacgcagaggagattattgacttggctagcaaagcttctgttgctgatcagcagaaacaagtgcaggaaaatgttcattatcaacttaggcatatgtgccaatcaatggataacattttatgccctgatacaacaaatgatccgtcaaaggaaccttcagaagcacataatcattctcggcgtagtggattgagttttgccgttggtggggctgcatctacaaacaagcaaagtgcagttatccctgctacacgacctttgactcgagcagaattgtcaaagaaattcagggatcattttgggtacacccttgacatcggaccatctggaattcctcacaaagatgcaggccaaggtctgttcttatccggaaaagcaaatgttggtgctgtcctagccatctatcctggtgttatatattcacctgcttactatcgatatatacctggatacccaagaattgatgtttgcaacaactatctgatcacaagatatgatggaacaataattgacgcaaaaccatggtattttggtggtgaaacaagagaattatgggatggttcagatttggtggattacaatgctatgccacctaaaggctcagagaacaactctgatcgagtgtggagaatgcttagcaagcctctagagaaaagtgtaagggaaaattttggtgaagtgcttgaacgacgaaatccccttgcttttggtcattttgcaaaccatccacctaaaggttcaagtcctaatgtcatgatctgtccatacgattttcccttgacagagaagaacatgagagtatacatccctaacgttacgtttggtggtgaagagaccattaagatgaagaggtttggctccttctatttcaagtctggaggttctgataatcaggctggtgattctctagtgctgaagacgctagtgctagtgagtacaaggtccatctgtgatgaagaactcttccttaattaccgttacagtaactcaaagcgacggccagagtggtacagccctgtcgatgaagaagaggataagaggagatggagctag

SEQ ID NO: 3610 - protein, 403 aa, Sorghum bicolor
  misc_feature (1)..(403): useful for making plants with increased salt and oxidative stress resistance as described in USSN 12/922,143
  misc_feature (1)..(403): Ceres ANNOT ID no.6113886
  misc_feature (1)..(403): Bit score of 988.2 for HMM based on sequences of FIGURE 8 of USSN 12/922,143.
  misc_feature (1)..(403): Functional Homolog Of Ceres SEEDLINE ID no. ME01395
MASLFNKIQEAIRTIAKSPMFARDPRHLQFEADVNRLFLYTSYSRLGENAEEKDAEEIIDLASKASVADQQKQVQENVHYQLRHMCQSMDNILCPDTTNDPSKEPSEAHNHSRRSGLSFAVGGAASTNKQSAVIPATRPLTRAELSKKFRDHFGYTLDIGPSGIPHKDAGQGLFLSGKANVGAVLAIYPGVIYSPAYYRYIPGYPRIDVCNNYLITRYDGTIIDAKPWYFGGETRELWDGSDLVDYNAMPPKGSENNSDRVWRMLSKPLEKSVRENFGEVLERRNPLAFGHFANHPPKGSSPNVMICPYDFPLTEKNMRVYIPNVTFGGEETIKMKRFGSFYFKSGGSDNQAGDSLVLKTLVLVSTRSICDEELFLNYRYSNSKRRPEWYSPVDEEEDKRRWS

SEQ ID NO: 3611 - DNA, 497 bp, Arabidopsis thaliana
  misc_feature (1)..(497): useful for making plants with increased salt and oxidative stress resistance as described in USSN 12/922,143
  misc_feature (1)..(497): Ceres SEEDLINE ID no.ME02441
aagagtccaagaataaaaatcaatcagaaagaagattgaatctagatctcaagagtcaagatcgatgggtttggttgtggtcatatctctgcctctaattttcttctgtctacttcttggatttggctgctacttcctaggaaaatctcgcggccgtcgtgagatccgtacaaatcctcaggtgtatggagctcctgctccgcctcctggggctattgccgcctcctctccgccgttgtctcctcacgccaagcccgacaattctcacaacgtctgattttccttcattttctcttctttgtctgtcttgcttgtctctattggaagatgcttttgtttgacttattgtgaattgttgtaacttgtaatcttttgattgtctttagttttcttgggatgaattcccttctttatttgtgtattttcctatctctttgatgtaaataagaaagctagtaatggtttacacattgattattccaaaaaaaaaaaaaaaa

SEQ ID NO: 3612 - protein, 70 aa, Arabidopsis thaliana
  misc_feature (1)..(70): useful for making plants with increased salt and oxidative stress resistance as described in USSN 12/922,143
  misc_feature (1)..(70): Ceres SEEDLINE ID no.ME02441
  misc_feature (1)..(70): Bit score of 154.1 for HMM based on sequences of FIGURE 12 of USSN 12/922,143.
MGLVVVISLPLIFFCLLLGFGCYFLGKSRGRREIRTNPQVYGAPAPPPGAIAASSPPLSPHAKPDNSHNV

SEQ ID NO: 3613 - DNA, 543 bp, Gossypium hirsutum
  misc_feature (1)..(543): useful for making plants with increased salt and oxidative stress resistance as described in USSN 12/922,143
  misc_feature (1)..(543): Ceres CLONE ID no.1921510
aaagacaacaaacaaagaatttttgcagacagaaattcggcaagagttttgaagtgaagatgggtatggttgtagtcatctctctgcctctaatcatcttctgcatattacttggtaccggatgtttcttctttggaagagccaaaggtagacaagatttccgcaccaaccctcaggtttatggtgttccagctccgccgcccggtgcaccaaccacctttttcccatctcctccacataccaagcccccgccgcccgtggcagcaaccacctctttcccatctcctccacacaccaagcccaacaacttagccaatgtttaatcaagtcatttcagaattgaagttacacacacccaagttccaagattggattttatatctgggttcttttgaaaaaattgattctctttgttttctttgtttgtatacctgtgtgaatttttttaagacatgtcgtgttggttggtgtatattggttgacatgtaaaatcaataagatttatagaagctataaataaatctatactagttcaagttgctt

SEQ ID NO: 3614 - protein, 87 aa, Gossypium hirsutum
  misc_feature (1)..(87): useful for making plants with increased salt and oxidative stress resistance as described in USSN 12/922,143
  misc_feature (1)..(87): Ceres CLONE ID no.1921510
  misc_feature (1)..(87): Bit score of 101.2 for HMM based on sequences of FIGURE 12 of USSN 12/922,143.
  misc_feature (1)..(87): Functional Homolog Of Ceres SEEDLINE ID no. ME02441
MGMVVVISLPLIIFCILLGTGCFFFGRAKGRQDFRTNPQVYGVPAPPPGAPTTFFPSPPHTKPPPPVAATTSFPSPPHTKPNNLANV

SEQ ID NO: 3615 - DNA, 207 bp, Populus balsamifera subsp. trichocarpa
  misc_feature (1)..(207): useful for making plants with increased salt and oxidative stress resistance as described in USSN 12/922,143
  misc_feature (1)..(207): Ceres ANNOT ID no.1491256
atgggtatggtcgtggtgatctctttgcctttgataatcttttgcctgcttcttggttttggatgttactacttggggaggtacaagggaagacaagatacccgtacaaatgctcaggtatttggagatcctattccaccacctggttttgctagtacgccacctcctccacctcataccaagccagacaacttgcacagtgtttag

SEQ ID NO: 3616 - protein, 68 aa, Populus balsamifera subsp. trichocarpa
  misc_feature (1)..(68): useful for making plants with increased salt and oxidative stress resistance as described in USSN 12/922,143
  misc_feature (1)..(68): Ceres ANNOT ID no.1491256
  misc_feature (1)..(68): Bit score of 142.8 for HMM based on sequences of FIGURE 12 of USSN 12/922,143.
  misc_feature (1)..(68): Functional Homolog Of Ceres SEEDLINE ID no. ME02441
MGMVVVISLPLIIFCLLLGFGCYYLGRYKGRQDTRTNAQVFGDPIPPPGFASTPPPPPHTKPDNLHSV

SEQ ID NO: 3617 - DNA, 258 bp, Populus balsamifera subsp. trichocarpa
  misc_feature (1)..(258): useful for making plants with increased salt and oxidative stress resistance as described in USSN 12/922,143
  misc_feature (1)..(258): Ceres ANNOT ID no.1447703
atggagcatgatgttggcccacccaaaaaaaccttgaagggaatattggaaatgggtatggtagtggtgatctctttgcctttgataatcttctgcttacttcttggttttggatgctactacttggggagatacaaaggaagacaagatgtccgtacaaatgctcaagtttttggggtacctattccaccacctgatactgctagtaaaccacctcctccacctcattccaagccaggaaacttggagaatgtttag

SEQ ID NO: 3618 - protein, 68 aa, Populus balsamifera subsp. trichocarpa
  misc_feature (1)..(68): useful for making plants with increased salt and oxidative stress resistance as described in USSN 12/922,143
  misc_feature (1)..(68): Ceres ANNOT ID no.1447703
  misc_feature (1)..(68): Bit score of 130.3 for HMM based on sequences of FIGURE 12 of USSN 12/922,143.
  misc_feature (1)..(68): Functional Homolog Of Ceres SEEDLINE ID no. ME02441
MGMVVVISLPLIIFCLLLGFGCYYLGRYKGRQDVRTNAQVFGVPIPPPDTASKPPPPPHSKPGNLENV

SEQ ID NO: 3619 - DNA, 633 bp, Populus balsamifera subsp. trichocarpa
  misc_feature (1)..(633): useful for making plants with increased salt and oxidative stress resistance as described in USSN 12/922,143
  misc_feature (1)..(633): Ceres ANNOT ID no.1438429
atgggtatggtcgtggtgatctctttgcctttgataatcttttgcctgcttcttggttttggatgttactacttggggaggtacaagggaagacaagatacccgtacaaatgctcagaagccagcaggatggactaatatcatttgttcagtacctcctactcccaacgatatcatcatcctttctcatgctgatactaaacataatatgacattcctacttcaatcaaagatgtacgaggaaccccttatttcttcacaagtgatgatgtttcatcgccaagacactgagtatttcccatcatatatgccataccagcttccctcgcaccctccagttcctccaattcctttaacacttcacacgccacaaaatcttactctcttgcgtctagtctctgacccagccccagacccattctcaagtcccgtatcccgtgctaacatcatccaacaaaactatcagggagaaaatgagagggagccaggcagccagcctcctttggccactctgaccaggcaggaagacaagcctcctttggccactccgaccaggcaggaagacaagcagagcaatccaaaaacaattacaaaagtaaaggcttccagaataccccccgcttccacagcataa

SEQ ID NO: 3620 - protein, 210 aa, Populus balsamifera subsp. trichocarpa
  misc_feature (1)..(210): useful for making plants with increased salt and oxidative stress resistance as described in USSN 12/922,143
  misc_feature (1)..(210): Ceres ANNOT ID no.1438429
  misc_feature (1)..(210): Bit score of 81.3 for HMM based on sequences of FIGURE 12 of USSN 12/922,143.
  misc_feature (1)..(210): Functional Homolog Of Ceres SEEDLINE ID no. ME02441
MGMVVVISLPLIIFCLLLGFGCYYLGRYKGRQDTRTNAQKPAGWTNIICSVPPTPNDIIILSHADTKHNMTFLLQSKMYEEPLISSQVMMFHRQDTEYFPSYMPYQLPSHPPVPPIPLTLHTPQNLTLLRLVSDPAPDPFSSPVSRANIIQQNYQGENEREPGSQPPLATLTRQEDKPPLATPTRQEDKQSNPKTITKVKASRIPPASTA

SEQ ID NO: 3621 - DNA, 481 bp, Arabidopsis thaliana
  misc_feature (1)..(481): useful for making plants with increased salt and oxidative stress resistance as described in USSN 12/922,143
  misc_feature (1)..(481): Ceres CLONE ID no.109156
aagagtccaagaataaaaatcaatcagaaagaagattgaatctagatctcaagagtcaagatcgatgggtttggttgtggtcatatctctgcctctaattttcttctgtctacttcttggatttggctgctacttcctaggaaaatctcgcggccgtcgtgagatccgtacaaatcctcaggtgtatggagctcctgctccgcctcctggggctattgccgcctcctctccgccgttgtctcctcacgccaagcccgacaattctcacaacgtctgattttccttcattttctcttctttgtctgtcttgcttgtctctattggaagatgcttttgtttgacttattgtgaattgttgtaacttgtaatcttttgattgtctttagttttcttgggatgaattcccttctttatttgtgtattttcctatctctttgatgtaaataagaaagctagtaatggtttacacattgattattcc

SEQ ID NO: 3622 - protein, 70 aa, Arabidopsis thaliana; identical to SEQ ID NO: 3612
  misc_feature (1)..(70): useful for making plants with increased salt and oxidative stress resistance as described in USSN 12/922,143
  misc_feature (1)..(70): Ceres CLONE ID no.109156
  misc_feature (1)..(70): Bit score of 154.1 for HMM based on sequences of FIGURE 12 of USSN 12/922,143.
  misc_feature (1)..(70): Functional Homolog Of Ceres SEEDLINE ID no. ME02441

SEQ ID NO: 3623 - DNA, 614 bp, Triticum aestivum
  misc_feature (1)..(614): useful for making plants with increased salt and oxidative stress resistance as described in USSN 12/922,143
  misc_feature (1)..(614): Ceres CLONE ID no.1053866
cccagcgcagagcaccgcagcaattcgatcccaagcatccccccaccaacctcaccatcctcgtaccgcacgtccaggcagctaatcagtcaagctcaagcatccaagccggcctcggattgaaggcatccatccgggagggaggggaatggggttcgtgctggtgatctcgctgcccttcatattcttcaccatcctgctcggcttcggctgctacttcctcggcaagcacaagggccgcgaggagatgcgcgccggcgtcggcgcccagatctacggcacgccgctgccgccgcctggcgtggccgggcagtccccggggccgtacccggtcccggttccgatgaagaaggagggccccgacgccgtctgatcggtcgagcttcctcctcctcctcggctggagcgttggtgttgtttgtttactgggtttgattattaccgtgtacatggagtcatttgttgctcgtttcttgtgtggtgtttactgtgaaggaggaagggatgttgatccggtgtgatgatttgtgatcacagttgcgtttctatgagatgcgcaaatcgatgtaatgaatattagtttgtgataatcaatcaaccgttgcttggtttgt

SEQ ID NO: 3624 - protein, 74 aa, Triticum aestivum
  misc_feature (1)..(74): useful for making plants with increased salt and oxidative stress resistance as described in USSN 12/922,143
  misc_feature (1)..(74): Ceres CLONE ID no.1053866
  misc_feature (1)..(74): Bit score of 157.8 for HMM based on sequences of FIGURE 12 of USSN 12/922,143.
  misc_feature (1)..(74): Functional Homolog Of Ceres SEEDLINE ID no. ME02441
MGFVLVISLPFIFFTILLGFGCYFLGKHKGREEMRAGVGAQIYGTPLPPPGVAGQSPGPYPVPVPMKKEGPDAV

SEQ ID NO: 3625 - DNA, 615 bp, Zea mays
  misc_feature (1)..(615): useful for making plants with increased salt and oxidative stress resistance as described in USSN 12/922,143
  misc_feature (1)..(615): Ceres CLONE ID no.1526732
tgccccaaagcaaagcaaagcttcaaagcatctctgctaggattttagcgagcggcaacgacgagcgacccaaaaaagcaatcattagtcaccatatctggtcctctcgctccacccccctcctctgcgacttgaggcaggacaggaggcacagacgtgcaatggggttcgtgctggtggtctctctgcccttcatcttcttctccatcctcctcggcttcggctgctacttcctcggcaagcacaggggccgggaggagatgcggaccggcatcggcgtgcagatctacggcacgccgctgccgccgcccggcgtcgtcggagcctcctcgccgccgcctgagccgttccacagcaagaaacaatggtccgaggctgtgtgactgagattcagacgtctctccatccatccattctactactactacatatatgtcttggtggtgatgttggatttatattcttagttctttcttctttaatttcgccctggctgtcttgagagtgtagattgagagtcaaatctgtgcttgtgtctaaagatggtgtgtgtggatgttgtgatacgattgcaatcacactttatatcttctgtaatcaagcaaaaaatttccg

SEQ ID NO: 3626 - protein, 73 aa, Zea mays
  misc_feature (1)..(73): useful for making plants with increased salt and oxidative stress resistance as described in USSN 12/922,143
  misc_feature (1)..(73): Ceres CLONE ID no.1526732
  misc_feature (1)..(73): Bit score of 170.7 for HMM based on sequences of FIGURE 12 of USSN 12/922,143.
  misc_feature (1)..(73): Functional Homolog Of Ceres SEEDLINE ID no. ME02441
MGFVLVVSLPFIFFSILLGFGCYFLGKHRGREEMRTGIGVQIYGTPLPPPGVVGASSPPPEPFHSKKQWSEAV

SEQ ID NO: 3627 - DNA, 513 bp, Zea mays
  misc_feature (1)..(513): useful for making plants with increased salt and oxidative stress resistance as described in USSN 12/922,143
  misc_feature (1)..(513): Ceres CLONE ID no.211136
tcatgtcccaaagcaaagcaaagcttcaaagcatctctgcttggattttagcgagcggcaacgacgagcgacccaatggggttcgtgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccggcgtcgtcggagcctcctcgccgccgcctgagccgttccacagcaagaaacaatggtccgaggctgtgtgactgagattcagacgtctctccatccatccattctactactactacttatatgtcttggtggtgatgttggatttatattctttcttctttaatttcgccctggctgtcttgagagtgtagattgagagtcaaatatgtgcttgtgtggatgttgtgatacgattgcaatcacactttatatcttctgtaatcaagcaaaaaccaatgcgttgcagc

SEQ ID NO: 3628 - protein, 73 aa, Zea mays
  misc_feature (1)..(73): useful for making plants with increased salt and oxidative stress resistance as described in USSN 12/922,143
  misc_feature (1)..(73): Ceres CLONE ID no.211136
  misc_feature (1)..(73): Bit score of 169.1 for HMM based on sequences of FIGURE 12 of USSN 12/922,143.
  misc_feature (1)..(73): Functional Homolog Of Ceres SEEDLINE ID no. ME02441
MGFVLVVSLPFIFLSILLGFGCYFLGKHRGREEMRTGVGAQIYGTPLPPPGVVGASSPPPEPFHSKKQWSEAV

SEQ ID NO: 3629 - DNA, 603 bp, Zea mays
  misc_feature (1)..(603): useful for making plants with increased salt and oxidative stress resistance as described in USSN 12/922,143
  misc_feature (1)..(603): Ceres CLONE ID no.446737
aaagcgaagctaagcaaagcgaagcttcaaagcatcctcccctgcgagaagagaggaggacaatggggttcgtgctggtggtctctttgcacttcattttcctctccatccttctcggcttcggctgcttcttcctcggcaagcacaggggccgggaggagatgcgaaccggcgtcggcgcgcaggtctacggcacgccgctgccgccgcccggtgtcgtcggagtcccatcgccgccgactgagccgattcacgccaagaaaccagggcccgaagccgtctgattgggatccatttcgtttctacctactactgcctatgttttggtgacgttggatttattctttcttctttattttcgtccaggccgtgtcgaggggtgtaagctgagagtgaatatatgtttgtgtctaaaaattgttcattgttacgacttacgaggggagggggtgatggtgtgtgtatgttgtgatatgatttgcaatcacggcaagcaaaaccagatgtcttgtgtcactgtcctgactagctggtgagtggtggtgtgtgtatggatatcacatattttgtaaagtgtttttagagattacattgagcttgttt

SEQ ID NO: 3630 - protein, 73 aa, Zea mays
  misc_feature (1)..(73): useful for making plants with increased salt and oxidative stress resistance as described in USSN 12/922,143
  misc_feature (1)..(73): Ceres CLONE ID no.446737
  misc_feature (1)..(73): Bit score of 147.7 for HMM based on sequences of FIGURE 12 of USSN 12/922,143.
  misc_feature (1)..(73): Functional Homolog Of Ceres SEEDLINE ID no. ME02441
MGFVLVVSLHFIFLSILLGFGCFFLGKHRGREEMRTGVGAQVYGTPLPPPGVVGVPSPPTEPIHAKKPGPEAV

SEQ ID NO: 3631 - protein, 63 aa, Zea mays
  misc_feature (1)..(63): useful for making plants with increased salt and oxidative stress resistance as described in USSN 12/922,143
  misc_feature (1)..(63): CERES CLONE ID no.101142179
  misc_feature (1)..(63): Bit score of 132.3 for HMM based on sequences of FIGURE 12 of USSN 12/922,143.
  misc_feature (1)..(63): Functional Homolog Of Ceres SEEDLINE ID no. ME02441
MGFVLVVSLPFIFLSILLGFGCYFLGKHRGREEMRTGVGAQIYGTPLPPPEPFHSKKQWSEAV

SEQ ID NO: 3632 - DNA, 515 bp, Zea mays
  misc_feature (1)..(515): useful for making plants with increased salt and oxidative stress resistance as described in USSN 12/922,143
  misc_feature (1)..(515): Ceres CLONE ID no.370528
aaaagcgaagcgaagcaaagcaaagcttcaaagcatcctcccctgcgagaagagaggaggacaatggggttcgtgctggtggtctctttgcacttcatcttcctctccatccttctcggcttcggctgcttcttcctcggcaagcacaggggccgggaggagatgcgaaccggcgtcggcgcgcaggtctacggcacgccgctgcgccgcccggcgtcgtcggagtctcatcgccgccgcctgagccgattcacgccaagaaacaagggcccgaagccgtctgattgagatccattcgtttctacctactactgcctatgttttggtgatgttggatttattctttcttctttattttcgtccagaccgtgtcgacgggtgtaagctgagagtgaatatatgtttgtgtctaaaaattgttcattgttacgacttacgaggggagggggtgatggtgtgtgtatgtcgtgatatgatttgcaatcacggcaagcaaaaaccagatgtcttgtgtc

SEQ ID NO: 3633 - protein, 74 aa, Zea mays
  misc_feature (1)..(74): useful for making plants with increased salt and oxidative stress resistance as described in USSN 12/922,143
  misc_feature (1)..(74): Ceres CLONE ID no.370528
  misc_feature (1)..(74): Bit score of 102.6 for HMM based on sequences of FIGURE 12 of USSN 12/922,143.
  misc_feature (1)..(74): Functional Homolog Of Ceres SEEDLINE ID no. ME02441
MGFVLVVSLHFIFLSILLGFGCFFLGKHRGREEMRTGVGAQVYGTPLRRPASSESHRRRLSRFTPRNKGPKPSD

SEQ ID NO: 3634 - DNA, 407 bp, Panicum virgatum
  misc_feature (1)..(407): useful for making plants with increased salt and oxidative stress resistance as described in USSN 12/922,143
  misc_feature (1)..(407): Ceres CLONE ID no.2026154
aaaaacaaagcacagggcacctcatctcccttcaaagaacactctgctttgcttgtttttcttgttctttcttcacgttctcacctgctcctccagctagtgggaattccggagcaggaagagaggaagcatggggttcgtgctagtgatctccctacctttcatcttcttcaccatcctgctcgggttcggctgctacttcctcggcaagcacagggggcgggaggagatgcggtcaggcgtcgccgcccagatatacggcacgccgctgccgccgcccggcgtcgtgggctgggcctcgccggcgcatgagccgttcgccatgaagaaagaaggggctgagaacgtctgagtgggatgatgtttctggatttgtttaaatgataattaattcctttcgtcgatgc

SEQ ID NO: 3635 - protein, 73 aa, Panicum virgatum
  misc_feature (1)..(73): useful for making plants with increased salt and oxidative stress resistance as described in USSN 12/922,143
  misc_feature (1)..(73): Ceres CLONE ID no.2026154
  misc_feature (1)..(73): Bit score of 170.9 for HMM based on sequences of FIGURE 12 of USSN 12/922,143.
  misc_feature (1)..(73): Functional Homolog Of Ceres SEEDLINE ID no. ME02441
MGFVLVISLPFIFFTILLGFGCYFLGKHRGREEMRSGVAAQIYGTPLPPPGVVGWASPAHEPFAMKKEGAENV

SEQ ID NO: 3636 - DNA, 539 bp, Panicum virgatum
  misc_feature (1)..(539): useful for making plants with increased salt and oxidative stress resistance as described in USSN 12/922,143
  misc_feature (1)..(539): Ceres CLONE ID no.1770718
tgagcttagcggagctgaaacaaagcacaggccaccacctcaaagcatcctctgcttcgcttgctttcttgggtcttccaccaggctctctccagtctccactgctcctgcaggcaagtcagaattccggagcaagagaggagacatggggttcgtgctggtgatctccctgcccttcatcttcttctccatcctgctcggcttcggctgctacttcctcggcaagcacaggggccgggaggagatgcgggcaggcgtcggcgcgcagatctacggcacgccgctgccgccgcccggcgtcgtgggcggggcctcgccggcgcacgagccgttcgccatgaagaaagaagggcttgagaacgtctgagtgggatgatgtttctgaatttgtttaaatgataattaattcctttcgtcgatgcaatgtacattgagcaatttatgcatgtgtttgttactttgttgaggggaaagatggtgacgcggtgtgatataatgtaatcacagtatgagacaataacagtgtttctcattgattc

SEQ ID NO: 3637 - protein, 73 aa, Panicum virgatum
  misc_feature (1)..(73): useful for making plants with increased salt and oxidative stress resistance as described in USSN 12/922,143
  misc_feature (1)..(73): Ceres CLONE ID no.1770718
  misc_feature (1)..(73): Bit score of 166.1 for HMM based on sequences of FIGURE 12 of USSN 12/922,143.
  misc_feature (1)..(73): Functional Homolog Of Ceres SEEDLINE ID no. ME02441
MGFVLVISLPFIFFSILLGFGCYFLGKHRGREEMRAGVGAQIYGTPLPPPGVVGGASPAHEPFAMKKEGLENV

SEQ ID NO: 3638 - protein, 71 aa, Oryza sativa subsp. japonica
  misc_feature (1)..(71): useful for making plants with increased salt and oxidative stress resistance as described in USSN 12/922,143
  misc_feature (1)..(71): Public GI ID no.115455695
  misc_feature (1)..(71): Bit score of 157.1 for HMM based on sequences of FIGURE 12 of USSN 12/922,143.
  misc_feature (1)..(71): Functional Homolog Of Ceres SEEDLINE ID no. ME02441
MGFVLVISLPFIFFSILLGFGCYFLGKHKGREEMRTGVGAQVYGTPLPPPGVGAPPPEPFTAKKDGPENLV

SEQ ID NO: 3639 - DNA, 228 bp, Sorghum bicolor
  misc_feature (1)..(228): useful for making plants with increased salt and oxidative stress resistance as described in USSN 12/922,143
  misc_feature (1)..(228): Ceres ANNOT ID no.6034829
atggggttcgtgctggtggtctccctgcctttcatcttcctctccatcctgcttggcttcggctgctacttcctcggcaagcacaggggccgggaggagatgcggaccggcgtcggcgcgcagatctacggcacgccgctgccgccgccgggcgtcgtcggagtctcctcgccgccgcctggggctgagccgttccacgccaagaaacaggggcccgaggccgtctga

SEQ ID NO: 3640 - protein, 75 aa, Sorghum bicolor
  misc_feature (1)..(75): useful for making plants with increased salt and oxidative stress resistance as described in USSN 12/922,143
  misc_feature (1)..(75): Ceres ANNOT ID no.6034829
  misc_feature (1)..(75): Bit score of 157.0 for HMM based on sequences of FIGURE 12 of USSN 12/922,143.
  misc_feature (1)..(75): Functional Homolog Of Ceres SEEDLINE ID no. ME02441
MGFVLVVSLPFIFLSILLGFGCYFLGKHRGREEMRTGVGAQIYGTPLPPPGVVGVSSPPPGAEPFHAKKQGPEAV

SEQ ID NO: 3641 - DNA, 156 bp, Sorghum bicolor
  misc_feature (1)..(156): useful for making plants with increased salt and oxidative stress resistance as described in USSN 12/922,143
  misc_feature (1)..(156): Ceres ANNOT ID no.6064505
atgctcgaggttgtgatctccatcccagcgatcctcctgctgatcctcctggccgtcgggtgctacctgctcggccggaaccgaggccgcgccgcggcgtcgcagcagttcgcgccgccggcgccgccgccagggctctcgccctcgcccaagtaa

SEQ ID NO: 3642 - protein, 51 aa, Sorghum bicolor
  misc_feature (1)..(51): useful for making plants with increased salt and oxidative stress resistance as described in USSN 12/922,143
  misc_feature (1)..(51): Ceres ANNOT ID no.6064505
  misc_feature (1)..(51): Bit score of 18.8 for HMM based on sequences of FIGURE 12 of USSN 12/922,143.
  misc_feature (1)..(51): Functional Homolog Of Ceres SEEDLINE ID no. ME02441
MLEVVISIPAILLLILLAVGCYLLGRNRGRAAASQQFAPPAPPPGLSPSPK

SEQ ID NO: 3643 - DNA, 1250 bp, Arabidopsis thaliana
  misc_feature (1)..(1250): useful for making plants with increased salt and oxidative stress resistance as described in USSN 12/922,143
  misc_feature (1)..(1250): Ceres SEEDLINE ID no.ME02927
  misc_feature (1)..(1250): Inplanta Sequence
aaacacacacatatacacccaaacgttatgtaactgcaaaaaaaatatcgaaacgagattctacaattagtctctagtcaaagagcttcatggcaatggtgtgaccccaaagttagtcttcacatgtttcttaagtttcaaacattgaatttttttccttttataaatagttaagacttatcttcattttctaaaatagtcaagatttatattcctcttaaaaaataatttatttccttcctaagaagaattattagatttattttctttgctagtatagattgatgaaagtgaggaaatgggagaagaaatgaagaacacaggatgtgtcttcttcttctaagtcactaacaaaatcaacaaagaggagaagccattattatataatagagagattgagagaagagatttatccaaaaaaatattgcaattcttcttggagtgaataatgccagtccctcttgcaccatatccaacacctccggcaccggcactggctccgtcgtacaacactcctccggcaaatggaagtacaagtgggcagagccagttagtgtgttcaggttgcagaaaccttctgatgtatcccgtcggagcaacctccgtctgttgcgccgtctgtaacgccgtcacggccgttcctccgcccggaacggagatggcacagttggtatgtggaggatgtcatacactcttaatgtacattcgtggagctacaagtgttcaatgttcttgttgtcacactgttaatctcgccctcgaagcaaaccaagtagcgcatgtgaattgcggaaactgcatgatgctactaatgtatcaatatggagcaagatcagtgaaatgtgccgtttgtaactttgtcacatctgttgggggttcaacgagcacgactgattcgaagtttaacaattaaaacttggatctatctacctatcaatacatattgagttatgagcaatatagaggaagcatcaaatctttttcactctctcttcgatcaagaatccggcagtgatgagtttgaaaccattttcggaagtaaatgaaatatgtaattcgtcgaaatttctgactttggtctctttgtccgtttgtatagagctatctctcttctttggtttttgttttgttctcttaagaaaaatttgattcaccagtttgtaagagtgattcagaaatcaaagctagactttttatgcatgaaaaaaatagattgttttaaaaaaaaaaaaaaaaaaaaaaaaaaaaaa

SEQ ID NO: 3644 - protein, 154 aa, Arabidopsis thaliana
  misc_feature (1)..(154): useful for making plants with increased salt and oxidative stress resistance as described in USSN 12/922,143
  misc_feature (1)..(154): Ceres SEEDLINE ID no.ME02927
  misc_feature (1)..(154): Bit score of 409.4 for HMM based on sequences of FIGURE 14 of USSN 12/922,143.
  misc_feature (114)..(138): Pfam Name: zf-LSD1 Pfam Description: LSD1 zinc finger
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 3645 - DNA, 452 bp, Zea mays
  misc_feature (1)..(452): useful for making plants with increased salt and oxidative stress resistance as described in USSN 12/922,143
  misc_feature (1)..(452): Ceres CLONE ID no.475293
atacgtgcctcgcttctttttcctctttcgattccaggtatgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaactttgctgatgtatactcgcagtgcagacaccgtaaggtgttcatgttgcaacacagtgaaccttgttagaccagtgaataatatagctcatgtgaactgcggccagtgccggacaactttgatgtatccatacggcgcaccttcagtaaaatgtgccgtatgcaattatgtcacagctactggagtaaatactgtggcacccaccccatctgcgaggccaacatcagatgggtcttcatatagtggctcatctacttctgc

SEQ ID NO: 3646 - protein, 137 aa, Zea mays
  misc_feature (1)..(137): useful for making plants with increased salt and oxidative stress resistance as described in USSN 12/922,143
  misc_feature (1)..(137): Ceres CLONE ID no.475293
  misc_feature (1)..(137): Bit score of 168.3 for HMM based on sequences of FIGURE 14 of USSN 12/922,143.
  misc_feature (84)..(108): Pfam Name: zf-LSD1 Pfam Description: LSD1 zinc finger
  misc_feature (1)..(137): Functional Homolog Of Ceres SEEDLINE ID no. ME02927
MQNQIMCHACRTLLLYPRGASSVCCAVCQAITTVPPPGLEMAQLICGGCRTLLMYTRSADTVRCSCCNTVNLVRPVNNIAHVNCGQCRTTLMYPYGAPSVKCAVCNYVTATGVNTVAPTPSARPTSDGSSYSGSSTS

SEQ ID NO: 3647 - DNA, 1491 bp, Gossypium hirsutum
  misc_feature (1)..(1491): useful for making plants with increased salt and oxidative stress resistance as described in USSN 12/922,143
  misc_feature (1)..(1491): Ceres CLONE ID no.1835943
aatcctctcttttctctctctatttctcaccacttcatctgcatattgaacagtatgggagaaagcttgatgctctctggttctagacagtgaactattgaaaggagagtttagctctgtctgattttacaatgccagttccccttgcgccatatcccacacctccagcaccctacactcctcctgctgccaatggtatcttgttctcttctatctgttctgcaacagatttttctttaaacaatgtgaattccattgctatttagttgaaggacctctttcattagccttttttttcattcagaaaagagttaagtctcattgtaactacatatatgattagcaaatccaaatagaatttctgatatctgattcaggacgtctgcttcaatttcgttttgcccccttttgcttcttttttttttttccgtttttttctgatgttcatgctgtgcaagggtatggctttggcattaagatacacaggttgttatggatgtaaagtaccaatattacaagtctagtttggcttctaacaagcttggcctcatcaacaaattggtcaaagacaggagaatttatgaattaagtcattaacctttctgcatctacaaaagttactgtatttctactctcttttttttttttttactttccattgacaactgatctagtggccaaacctatgctaaccaggtgctcaaagccaacttgtgtgttccggttgtcgaaatttattgctctatccagttggagcaacctctgtgtgttgtgctgtttgcaatgcagtaacagcagtgccgcctcccggtacatcatctgctatttacttgattgaatcttctttttggaaagcctgtgtataaattgtaagtcaaacttctgaaatatacaggcacagaaatggcacagttggtttgcggaggctgtcataccttattaatgtacatccgcggagcaacaagcgttcaatattcgtgttgtcacactgtcaatctggccttggaagcaaatcaggtggcacatgtaaattgtgggaactgcaggatgttactaatgtaccagtatggagcgagatccgtaaaatgtgcagtttgcaattttgtgacatcagttgggggctcagctagtgctgctgaacagaagttcaacagctgagactatattagaccccaagtcaaatattaaaagcaacaagtttgctttgcacgttataaatatcttccaccgaggttgcgtcccatcggcaaatggaggaaactcctcctcctcgcattgtattgagttatttttccttgcgtgacatatgaaataagcggttttgggtagctggttggatgcattataagtaattccatcagagaagacgttttttaacagtttgaacaatcggttatcttccgagtccagataagataaactttgttttcttttgatttgctatgaatatgagtggcaataaatacagggcataaagttcatctctgatac

SEQ ID NO: 3648 - protein, 84 aa, Gossypium hirsutum
  misc_feature (1)..(84): useful for making plants with increased salt and oxidative stress resistance as described in USSN 12/922,143
  misc_feature (1)..(84): Ceres CLONE ID no.1835943
  misc_feature (1)..(84): Bit score of 143.9 for HMM based on sequences of FIGURE 14 of USSN 12/922,143.
  misc_feature (44)..(68): Pfam Name: zf-LSD1 Pfam Description: LSD1 zinc finger
  misc_feature (1)..(84): Functional Homolog Of Ceres SEEDLINE ID no. ME02927
MAQLVCGGCHTLLMYIRGATSVQYSCCHTVNLALEANQVAHVNCGNCRMLLMYQYGARSVKCAVCNFVTSVGGSASAAEQKFNS

SEQ ID NO: 3649 - DNA, 711 bp, Gossypium hirsutum
  misc_feature (1)..(711): useful for making plants with increased salt and oxidative stress resistance as described in USSN 12/922,143
  misc_feature (1)..(711): Ceres CLONE ID no.1912352
attttctatcaggccagcaatggcaaacggttttcatgaatgttgtggttgctcatggacatccaaaacaggagatttaatctcttcaaactagcaagatttcctcaagtttggttgccttctcaaaatagcctttggccgagctggtggattgtggagctgttctttttgcctgctattttgttcatataactgaagcaatttctgttctccaaagaaatcctctagtttcttgttgctagtaaagcactattagtgtatattttgtttgcaacttctactgatttcagagttcaccgctgaagactttcttgccctctcatctgcgcttcctgcacttttcccagggcttcatgcagggcaaagcagccggtttccgacgcctgatagccgccggaatctgcgagatctccacgagcagcgtcctcggataaggcagccggcacggcaatgccggttccccttgccccgtatccaactcctccggtgccattcacaccccccaatggggcccaaagccagcttgtctgcaccgggtgccggaatcttctcatgtatccagctggtgcgacgtctgtctgctgtgcagtttgcagcaccgtcaccgccgtgccggctccaggaactgagatggcacagttagtttgcggaggatgccacactctcctgatgtacatacgtggggcgacaagtgtacaatgttcttgctgc

SEQ ID NO: 3650 - protein, 87 aa, Gossypium hirsutum
  misc_feature (1)..(87): useful for making plants with increased salt and oxidative stress resistance as described in USSN 12/922,143
  misc_feature (1)..(87): Ceres CLONE ID no.1912352
  misc_feature (1)..(87): Bit score of 149.6 for HMM based on sequences of FIGURE 14 of USSN 12/922,143.
  misc_feature (27)..(51): Pfam Name: zf-LSD1 Pfam Description: LSD1 zinc finger
  misc_feature (1)..(87): Functional Homolog Of Ceres SEEDLINE ID no. ME02927
MPVPLAPYPTPPVPFTPPNGAQSQLVCTGCRNLLMYPAGATSVCCAVCSTVTAVPAPGTEMAQLVCGGCHTLLMYIRGATSVQCSCC

SEQ ID NO: 3651 - DNA, 447 bp, Brassica napus
  misc_feature (1)..(447): useful for making plants with increased salt and oxidative stress resistance as described in USSN 12/922,143
  misc_feature (1)..(447): Ceres CLONE ID no.978312
  misc_feature (441)..(441): m is a or c
aatttggattggctctcgagttcgatcttcccttcccatcttctccaatcgagatgcaggaccagctcgtgtgtcatggctgtagaaacacattgctctatcctagaggagctaccaacgttcgttgtgccttatgcaacactgtcaacatgatccctcatcatccttctcctcatgctcgtgcagggatggacatggctcacattgtatgtggtggttgtcgaactatgcttatgtatacccgtgggggaactagcgtcagatgctcttgctgtcagactctcaaccttgttccagcaccaacaccatccaatcagtttgcgcatatcaactgtgggaactgtcggacgacactcatgtatccgtacggtgcatcatctgttaaatgcgctgtttgccagttcgttactaacgttaatctgatgggcaatggaagggtgmcttaac

SEQ ID NO: 3652 - protein, 130 aa, Brassica napus
  misc_feature (1)..(130): useful for making plants with increased salt and oxidative stress resistance as described in USSN 12/922,143
  misc_feature (1)..(130): Ceres CLONE ID no.978312
  misc_feature (1)..(130): Bit score of 131.8 for HMM based on sequences of FIGURE 14 of USSN 12/922,143.
  misc_feature (94)..(118): Pfam Name: zf-LSD1 Pfam Description: LSD1 zinc finger
  misc_feature (1)..(130): Functional Homolog Of Ceres SEEDLINE ID no. ME02927
  misc_feature (130)..(130): Xaa is any aa, unknown or other
MQDQLVCHGCRNTLLYPRGATNVRCALCNTVNMIPHHPSPHARAGMDMAHIVCGGCRTMLMYTRGGTSVRCSCCQTLNLVPAPTPSNQFAHINCGNCRTTLMYPYGASSVKCAVCQFVTNVNLMGNGRVX

SEQ ID NO: 3653 - DNA, 932 bp, Zea mays
  misc_feature (1)..(932): useful for making plants with increased salt and oxidative stress resistance as described in USSN 12/922,143
  misc_feature (1)..(932): Ceres CLONE ID no.1437985
ttggattggcctctttgcatatctgctctttagagttggccgggtctgcaatcggatcctctcttccccatcttcccaatcgaagcttttggctttgaattggatttgggtttcaaaaagccacctccttttcttcttcttatcagatatgcaggaccagctggtgtgtcatggatgtagaaatacattgatgtatcctagaggagcaaccaatgtgcgttgtgcgttatgtcacattgtcaacatggttcctcttcatcctcatcctcctcctcctcatcatgctcatgcagggatggacatggctcacattgtatgtggtggttgccgaactatgcttatgtacacgcgtggggctagtagtgtaagatgctcttgctgtcagactgtcaaccttgtcccaggacccccaccgtccaatcaggttgcgcatatcaactgcgggaactgccggacgacactcatgtacccttacggtgcatcatctgttaaatgcgctgtttgccagtttgttactaacgttaacatgagcaatggaagggtgcctctcgcaagtaaccggccaaatggaacagcttctcccgggacaatgccctctacatccacttcaacaccaccgtctcagacacaaactgttgtagtagagaacccaatgtccgttaacgaaagtggaaagttggtgagcaacgttgtggttggagtgacaacaggccaaaaataacttttaaagaatgatttgatctgaaagatcaaaattggtttcatctatccctgcgtctggtttgtgcatattacatactgttgatgaacactttttttttttgttaaaaaaaaagttgatgaacacaaaggttttttggttcagtaatgtggcaatcctgtttgtagactccattgaccatttgtggcattgttaatgtatgtattactat

SEQ ID NO: 3654 - protein, 138 aa, Zea mays
  misc_feature (1)..(138): useful for making plants with increased salt and oxidative stress resistance as described in USSN 12/922,143
  misc_feature (1)..(138): Ceres CLONE ID no.1437985
  misc_feature (1)..(138): Bit score of 145.1 for HMM based on sequences of FIGURE 14 of USSN 12/922,143.
  misc_feature (98)..(122): Pfam Name: zf-LSD1 Pfam Description: LSD1 zinc finger
  misc_feature (1)..(138): Functional Homolog Of Ceres SEEDLINE ID no. ME02927
MQDQLVCHGCRNTLMYPRGATNVRCALCHIVNMVPLHPHPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNR

SEQ ID NO: 3655 - protein, 189 aa, Arabidopsis thaliana
  misc_feature (1)..(189): useful for making plants with increased salt and oxidative stress resistance as described in USSN 12/922,143
  misc_feature (1)..(189): Public GI ID no.30685085
  misc_feature (1)..(189): Bit score of 147.4 for HMM based on sequences of FIGURE 14 of USSN 12/922,143.
  misc_feature (100)..(124): Pfam Name: zf-LSD1 Pfam Description: LSD1 zinc finger
  misc_feature (1)..(189): Functional Homolog Of Ceres SEEDLINE ID no. ME02927
MKVADMQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 3656 - protein, 184 aa, Arabidopsis thaliana
  misc_feature (1)..(184): useful for making plants with increased salt and oxidative stress resistance as described in USSN 12/922,143
  misc_feature (1)..(184): Public GI ID no.30685083
  misc_feature (1)..(184): Bit score of 140.9 for HMM based on sequences of FIGURE 14 of USSN 12/922,143.
  misc_feature (95)..(119): Pfam Name: zf-LSD1 Pfam Description: LSD1 zinc finger
  misc_feature (1)..(184): Functional Homolog Of Ceres SEEDLINE ID no. ME02927
MQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 3657 - DNA, 462 bp, Zea mays
  misc_feature (1)..(462): useful for making plants with increased salt and oxidative stress resistance as described in USSN 12/922,143
  misc_feature (1)..(462): Ceres CLONE ID no.1705168
gaactgagatggcgcagctagtgtgcggaggatgccgcaccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggaacctcacctggtgcagagcagaagcccagcagctgagctgatagtgtccctggaagtgctgtgagaccacctatgaaaaggatgctttgagtgcacatgtatagagttcttccctgaagcgattctttcactttcttttctcttgttttcttttgttttcttttcttttttggttcctcctcaccatctccaccccacccgtccacttctgcgttccttcgatggatctcgcgagccc

SEQ ID NO: 3658 - protein, 83 aa, Zea mays
  misc_feature (1)..(83): useful for making plants with increased salt and oxidative stress resistance as described in USSN 12/922,143
  misc_feature (1)..(83): Ceres CLONE ID no.1705168
  misc_feature (1)..(83): Bit score of 138.5 for HMM based on sequences of FIGURE 14 of USSN 12/922,143.
  misc_feature (6)..(30): Pfam Name: zf-LSD1 Pfam Description: LSD1 zinc finger
  misc_feature (1)..(83): Functional Homolog Of Ceres SEEDLINE ID no. ME02927
MAQLVCGGCRTLLMYIRGATSVQCSCCHTVNLAMEANQVAHVNCGNCRMLLMYQYGARSVKCAVCSFVTSVGTSPGAEQKPSS

SEQ ID NO: 3659 - DNA, 598 bp, Musa acuminata
  misc_feature (1)..(598): useful for making plants with increased salt and oxidative stress resistance as described in USSN 12/922,143
  misc_feature (1)..(598): Ceres CLONE ID no.1713823
  misc_feature (549)..(549): n is a, c, t, g, unknown, or other
accaccaccacaactctcctcgaatagttacaggactcggaggaggagaaaactatagtaagcagatgagagacgagcaaaaaagatcaacttggtgaggtattcccggatcagacacagtaatcgaaggtgggcagagccaagttgtctgttgtgggtgtagaaatctcctcatctatccaggtggggcaacatcagtatgctgtgccgtctgcagtgcagtgaccactgtacctccacctggaacagaaatggcacagttaatttgtagaagctgccacacactgttgatgtatgttcgtggagcgagtagggttcagtgttcttgctgtcacacagtcaatctggctccagaagcaaaccaggttgcacatgtcaattgcgggaactgccatatgctgctgatgtatcaatatggagcaagatcagtgaagtgcgcagtttgcagctttgtcacctcagttggggcttcaccaagcactgagcagaagcctggcaactgaaaccttggaatccggtgaattggctgcctatgacttgaaccaactnccatcagcttaagagagtcccacagttaatgtatagagcttcttcccaa

SEQ ID NO: 3660 - protein, 83 aa, Musa acuminata
  misc_feature (1)..(83): useful for making plants with increased salt and oxidative stress resistance as described in USSN 12/922,143
  misc_feature (1)..(83): Ceres CLONE ID no.1713823
  misc_feature (1)..(83): Bit score of 116.0 for HMM based on sequences of FIGURE 14 of USSN 12/922,143.
  misc_feature (44)..(68): Pfam Name: zf-LSD1 Pfam Description: LSD1 zinc finger
  misc_feature (1)..(83): Functional Homolog Of Ceres SEEDLINE ID no. ME02927
MAQLICRSCHTLLMYVRGASRVQCSCCHTVNLAPEANQVAHVNCGNCHMLLMYQYGARSVKCAVCSFVTSVGASPSTEQKPGN

SEQ ID NO: 3661 - DNA, 570 bp, Triticum aestivum
  misc_feature (1)..(570): useful for making plants with increased salt and oxidative stress resistance as described in USSN 12/922,143
  misc_feature (1)..(570): Ceres CLONE ID no.1052130
gttatactgagcaaaccaaacttattcgtctcgaaatctgcaccagatcgagctcagcaacgcgagccgagccggaggcgttcgtctgcccggggtggcgccatgcggatccgcctcttcctctgaaccgggcaagcgcgagccgccttcctcctcgtgctcgacggcggcgacgagcgtcggtggccgcatagcaaagtccagcaacgagcagggtttcatgtaggggagggcaacctgttcccagccctcgatttccaccggagcgtgcgaagtccagtcggcagcaacggcgacgccggtggaggcagccgcgggcacggcaatgccggttcctcttgccccttacccaacccctcctgtgcccttcacaccacccgctcccaatgcaggggctcaaagccaacttgtctgctctgggtgccggaatctgctcatgtatcctgccggcgcaacgtcggtctgctgcgcagtttgcagtaccgtgaccgctgttccggctcccgggactgaaatggcgcagctagtttgcggaggatgccacactcttctcatgtacatacgcggcgc

SEQ ID NO: 3662 - protein, 81 aa, Triticum aestivum
  misc_feature (1)..(81): useful for making plants with increased salt and oxidative stress resistance as described in USSN 12/922,143
  misc_feature (1)..(81): Ceres CLONE ID no.1052130
  misc_feature (1)..(81): Bit score of 113.9 for HMM based on sequences of FIGURE 14 of USSN 12/922,143.
  misc_feature (30)..(54): Pfam Name: zf-LSD1 Pfam Description: LSD1 zinc finger
  misc_feature (1)..(81): Functional Homolog Of Ceres SEEDLINE ID no. ME02927
MPVPLAPYPTPPVPFTPPAPNAGAQSQLVCSGCRNLLMYPAGATSVCCAVCSTVTAVPAPGTEMAQLVCGGCHTLLMYIRG

SEQ ID NO: 3663 - DNA, 555 bp, Glycine max
  misc_feature (1)..(555): useful for making plants with increased salt and oxidative stress resistance as described in USSN 12/922,143
  misc_feature (1)..(555): Ceres CLONE ID no.518615
  misc_feature (534)..(534): n is a, c, t, g, unknown, or other
aagatgatgaggaaacattggtagaagaaattgaagagagagagagagagagagagagagagagagagggttggattggttttcttcttccttttctctaaagagaatctaatctcaatcctcattacagatttcttcattcctctctcagtcttttctgttttccccctttgacatcctcgttttcgccgaaacaaaaacaactaagattttttgtttgttttgtttttcttctccttgttgttatttgactcggttgtctgaataggttgttgcagcagggtcgggagccacagctatgcagagccaagttgtgtgcaatggttgtaggagccttctgctttacccaagaggggcaaccaatgtttgttgtgcattgtgcaacacaattacctctgttcctccccctgggatggaaatgtctcaactttattgtggagggtgtaggacattgctaatgtacacacgtggagctacaagtgtgagatgttcctgctgtcacactgtaaaccttgttccaccagcatctaatcnagtagctcatgtccattgtgg

SEQ ID NO: 3664 - protein, 85 aa, Glycine max
  misc_feature (1)..(85): useful for making plants with increased salt and oxidative stress resistance as described in USSN 12/922,143
  misc_feature (1)..(85): Ceres CLONE ID no.518615
  misc_feature (1)..(85): Bit score of 71.9 for HMM based on sequences of FIGURE 14 of USSN 12/922,143.
  misc_feature (46)..(70): Pfam Name: zf-LSD1 Pfam Description: LSD1 zinc finger
  misc_feature (1)..(85): Functional Homolog Of Ceres SEEDLINE ID no. ME02927
  misc_feature (79)..(79): Xaa is any aa, unknown or other
MQSQVVCNGCRSLLLYPRGATNVCCALCNTITSVPPPGMEMSQLYCGGCRTLLMYTRGATSVRCSCCHTVNLVPPASNXVAHVHC

SEQ ID NO: 3665 - DNA, 509 bp, Glycine max
  misc_feature (1)..(509): useful for making plants with increased salt and oxidative stress resistance as described in USSN 12/922,143
  misc_feature (1)..(509): Ceres CLONE ID no.1069264
gacgacgacgctaccactctccttccttcctttccttcaccgcgtctcctcccagacaaaatcccatccggaatcaacttctctccctccgatcctcttcctcccccttccccgccgcctccgccggcgagaatcgccgccgcgtccgtcgccacgacctaggagccctccttcacgggcggacctcttcccggagccaccggagggcggggacgggcggccagtctcgtccagagccggtatgcagagccagatcgtgtgccaccgctgccggagggtgctggcctacccgtcaggggcgcccagcgtgtgctgcgccatgtgccgagccatcaccgccgtgccacccccagcgccagcagtggaaatggctcagcttatatgtggtggttgccgaactttgctgatgtacacccgtaatgcagacactgtgagatgctcatgttgcagtactgtcaatcttgtcagaccagtcaataatatagcccacgtgaactgtggtcggtgcc

SEQ ID NO: 3666 - protein, 89 aa, Glycine max
  misc_feature (1)..(89): useful for making plants with increased salt and oxidative stress resistance as described in USSN 12/922,143
  misc_feature (1)..(89): Ceres CLONE ID no.1069264
  misc_feature (1)..(89): Bit score of 56.8 for HMM based on sequences of FIGURE 14 of USSN 12/922,143.
  misc_feature (48)..(72): Pfam Name: zf-LSD1 Pfam Description: LSD1 zinc finger
  misc_feature (1)..(89): Functional Homolog Of Ceres SEEDLINE ID no. ME02927
MQSQIVCHRCRRVLAYPSGAPSVCCAMCRAITAVPPPAPAVEMAQLICGGCRTLLMYTRNADTVRCSCCSTVNLVRPVNNIAHVNCGRC

SEQ ID NO: 3667 - protein, 84 aa, Gossypium hirsutum
  misc_feature (1)..(84): useful for making plants with increased salt and oxidative stress resistance as described in USSN 12/922,143
  misc_feature (1)..(84): CERES CLONE ID no.100068940
  misc_feature (1)..(84): Bit score of 60.2 for HMM based on sequences of FIGURE 14 of USSN 12/922,143.
  misc_feature (43)..(67): Pfam Name: zf-LSD1 Pfam Description: LSD1 zinc finger
  misc_feature (1)..(84): Functional Homolog Of Ceres SEEDLINE ID no. ME02927
  misc_feature (82)..(82): Xaa is any aa, unknown or other
  misc_feature (84)..(84): Xaa is any aa, unknown or other
MQSQLICTGCRSILLYPRGATSVCCALCNTITPPGMEMAQLICGGCRTLLMYTRGAASIRCSCCHTINVAPDGQCKGSPSRXQX

SEQ ID NO: 3668 - DNA, 952 bp, Zea mays
  misc_feature (1)..(952): useful for making plants with increased salt and oxidative stress resistance as described in USSN 12/922,143
  misc_feature (1)..(952): Ceres CLONE ID no.501403
gcacgagacccgtccttgaggggcacgtcctagatcggtggcgcctgcctctcgccgccgatacggtgcctctcgcggtctcgctccccctcgcaggtcttttggtttttttagttcctccctttgcttcttggaggtgtttgttgccgtctcacccgcagttcttgagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaagtgacggcatatcacaacccgtatagctttgtccaaactatctaaaaagggtttaagaatacataccttgtatcatactgctgtttggcgatcggctgcgacggaggaatccccctccctggagagcgtagtggcaaggcagcgctgctttcgccactgcgatcgtgctagaacgagccaaaaaaaaaacgaagtgcgggtgtgcatactcagagtatatctgtagcttgttaccccttgattcttttgtatgtaatatgggctctgcctgactttcactgtgtgatcaaatttccaagcccgtggcgctgttgctgcgtgccttgttattagtgaataacaaacattgcaaatggctctgg

SEQ ID NO: 3669 - protein, 140 aa, Zea mays
  misc_feature (1)..(140): useful for making plants with increased salt and oxidative stress resistance as described in USSN 12/922,143
  misc_feature (1)..(140): Ceres CLONE ID no.501403
  misc_feature (1)..(140): Bit score of 55.4 for HMM based on sequences of FIGURE 14 of USSN 12/922,143.
  misc_feature (46)..(70): Pfam Name: zf-LSD1 Pfam Description: LSD1 zinc finger
  misc_feature (1)..(140): Functional Homolog Of Ceres SEEDLINE ID no. ME02927
MEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 3670 - DNA, 695 bp, Glycine max
  misc_feature (1)..(695): useful for making plants with increased salt and oxidative stress resistance as described in USSN 12/922,143
  misc_feature (1)..(695): Ceres CLONE ID no.646446
aaaccgatcaatacccatcaatttgcatctagaatatttgataaacccgaaccatgactggtagcttcatttcatggctccaaaataaaaagtgaagggtgggaaagggggaggttgtggaacttagcagcgaagcgaggaagatgcaaagtcaacaaacagtgaaagaagaagatgatgaaggtccacctccgggatggcaacctctccccgctcagccaccgccaccgccacgtccatccggttgggctcaaatggtttgcggttcttgtcgtcgcctgctttcatatccacgaggtgccaaacatgtcaaatgttcatgctgtcagactgtcaacattgtattagaagctgatcaggttgggcaagttaagtgtggcagttgtgcggtattgctgatgtacccatatggtgcttcacaagttagatgttcatcatgccgatttgtgacagaaattggggcacacaacaagcggcctccatggtctgtacaacaaaggaagccatctcctccaaaaactggttgttagtggcctgtccgttggcctagtaaatggatcatccttgtacatcaaacaaattaggtatgaggattcatgtaccaatctcaaaattgctttgttattgagatacgcatccttaaggaattatttattaatgtaaagttttggaatttcaccagaatttttaagatg

SEQ ID NO: 3671 - protein, 128 aa, Glycine max
  misc_feature (1)..(128): useful for making plants with increased salt and oxidative stress resistance as described in USSN 12/922,143
  misc_feature (1)..(128): Ceres CLONE ID no.646446
  misc_feature (1)..(128): Bit score of 53.9 for HMM based on sequences of FIGURE 14 of USSN 12/922,143.
  misc_feature (40)..(64): Pfam Name: zf-LSD1 Pfam Description: LSD1 zinc finger
  misc_feature (1)..(128): Functional Homolog Of Ceres SEEDLINE ID no. ME02927
MQSQQTVKEEDDEGPPPGWQPLPAQPPPPPRPSGWAQMVCGSCRRLLSYPRGAKHVKCSCCQTVNIVLEADQVGQVKCGSCAVLLMYPYGASQVRCSSCRFVTEIGAHNKRPPWSVQQRKPSPPKTGC

SEQ ID NO: 3672 - DNA, 565 bp, Arabidopsis thaliana
  misc_feature (1)..(565): useful for making plants with increased salt and oxidative stress resistance as described in USSN 12/922,143
  misc_feature (1)..(565): Ceres CLONE ID no.1008476
  misc_feature (103)..(103): y is t/u or c
  misc_feature (117)..(117): y is t/u or c
  misc_feature (413)..(413): y is t/u or c
  misc_feature (542)..(542): k is g or t/u
  misc_feature (553)..(553): m is a or c
  misc_feature (556)..(556): m is a or c
atggaagagatacaacaacaaacgcagaaggaagaacaaaagcaccgtgaagaagaagaggaggaagaggaaggtccgcctccgggatgggaatctgcagttyttcctcctccaatygtcaccatcaccgccgccgtaaaccccaatcccaccaccgtagaaattcccgaaaaggcccaaatggtatgtggatcttgcaggcgtttgctttcttatctaagaggatccaaacatgttaagtgctcctcttgtcagactgttaatctcgttcttgaagctaaccaggttggtcaggtgaattgcaacaattgcaaactgctactgatgtatccttatggagctccagctgttagatgttcctcctgcaattctgtcacagatatcagtgaaaacaacaaacgacctccatggtytgagcagcaaggaccactcaaaagtttaagcagtctcaggagagcagagaattaaacttgaaccgatttttgtcaattttgaaccggtttgacgactaaaaaccttgtaataatgtcgaaggatagatkaaataaaatcmccmttaataatc

SEQ ID NO: 3673 - protein, 155 aa, Arabidopsis thaliana
  misc_feature (1)..(155): useful for making plants with increased salt and oxidative stress resistance as described in USSN 12/922,143
  misc_feature (1)..(155): Ceres CLONE ID no.1008476
  misc_feature (1)..(155): Bit score of 66.2 for HMM based on sequences of FIGURE 14 of USSN 12/922,143.
  misc_feature (101)..(125): Pfam Name: zf-LSD1 Pfam Description: LSD1 zinc finger
  misc_feature (1)..(155): Functional Homolog Of Ceres SEEDLINE ID no. ME02927
  misc_feature (35)..(35): Xaa is any aa, unknown or other
  misc_feature (39)..(39): Xaa is any aa, unknown or other
  misc_feature (138)..(138): Xaa is any aa, unknown or other
MEEIQQQTQKEEQKHREEEEEEEEGPPPGWESAVXPPPXVTITAAVNPNPTTVEIPEKAQMVCGSCRRLLSYLRGSKHVKCSSCQTVNLVLEANQVGQVNCNNCKLLLMYPYGAPAVRCSSCNSVTDISENNKRPPWXEQQGPLKSLSSLRRAEN

SEQ ID NO: 3674 - protein, 155 aa, Arabidopsis thaliana
  misc_feature (1)..(155): useful for making plants with increased salt and oxidative stress resistance as described in USSN 12/922,143
  misc_feature (1)..(155): Public GI ID no.15234540
  misc_feature (1)..(155): Bit score of 64.7 for HMM based on sequences of FIGURE 14 of USSN 12/922,143.
  misc_feature (101)..(125): Pfam Name: zf-LSD1 Pfam Description: LSD1 zinc finger
  misc_feature (1)..(155): Functional Homolog Of Ceres SEEDLINE ID no. ME02927
MEEIQQQTQKEEQKHREEEEEEEEGPPPGWESAVLPPPIVTITAAVNPNPTTVEIPEKAQMVCGSCRRLLSYLRGSKHVKCSSCQTVNLVLEANQVGQVNCNNCKLLLMYPYGAPAVRCSSCNSVTDISENNKRPPWSEQQGPLKSLSSLRRAEN

SEQ ID NO: 3675 - protein, 163 aa, Oryza sativa subsp. japonica
  misc_feature (1)..(163): useful for making plants with increased salt and oxidative stress resistance as described in USSN 12/922,143
  misc_feature (1)..(163): Public GI ID no.40809631
  misc_feature (1)..(163): Bit score of 66.8 for HMM based on sequences of FIGURE 14 of USSN 12/922,143.
  misc_feature (111)..(135): Pfam Name: zf-LSD1 Pfam Description: LSD1 zinc finger
  misc_feature (1)..(163): Functional Homolog Of Ceres SEEDLINE ID no. ME02927
MSQLPLASQATTTDLVSTTAMQPQSEGIVDESLQPQHPPSSTAHDSPCLQDSVPLVPPPPSPYLNKEVGQMVCGSCRILLAYFRGAGYVHCTCCQTMNYVLEAHEVGKVHCGHCATLLMYPFGAPAVKCSLCLFVTEIGERNVRRRLSIEQPTRTNSSGLAEA

SEQ ID NO: 3676 - protein, 155 aa, Brassica rapa
  misc_feature (1)..(155): useful for making plants with increased salt and oxidative stress resistance as described in USSN 12/922,143
  misc_feature (1)..(155): Public GI ID no.62751057
  misc_feature (1)..(155): Bit score of 410.1 for HMM based on sequences of FIGURE 14 of USSN 12/922,143.
  misc_feature (77)..(101): Pfam Name: zf-LSD1 Pfam Description: LSD1 zinc finger
  misc_feature (1)..(155): Functional Homolog Of Ceres SEEDLINE ID no. ME02927
MPVPLAPYPTPPATPLAPAYTPPSPANGSTGGQSQLVCSGCRNLLMYPVGATSVCCAVCNAVTAVPPPGTEMAQLVCGGCHTLLMYIRGATSVQCSCCHTVNLALEANQVAHVNCGSCKMLLMYQYGARSVKCAVCSFITSVGGSTSTTDQKLNN

SEQ ID NO: 3677 - DNA, 884 bp, Gossypium hirsutum
  misc_feature (1)..(884): useful for making plants with increased salt and oxidative stress resistance as described in USSN 12/922,143
  misc_feature (1)..(884): Ceres CLONE ID no.1839135
acccccatcgtttcccttgtgtctcacagttgaactgtatgggagaaagcttgatgctctctggttctagacagtgaactattgaaaggagagtttagctctgtctgattttacaatgccagttccccttgcgccatatcccacacctccagcaccctacactcctcctgctgccaatggtgctcaaagccaacttgtgtgttccggttgtcgaaatttattgctctatccagttggagcaacctctgtgtgttgtgctgtttgcaatgcagtaacagcagtgccgcctcccggcacagaaatggcacagttggtttgcggaggctgtcataccttattaatgtacatccgcggagcaacaagcgttcaatgttcgtgttgtcacactgtcaatctggccttggaagcaaatcaggtggcacatgtaaattgtgggaactgcaggatgttactaatgtaccagtatggagcgagatccgtaaaatgtgcagtttgcaattttgtgacatcagttgggggctcagctagtgctgctgaacagaagttcaacagctgagactatattagaccccaagtcaaatattaaaagcaacaagtttgctttgcacgttataaatatcttccaccgaggttgcgtcccatcggcaaatggaggaaactcctcctcctcgcattgtattgagttatttttccttgcgtgacatatgaaataagcggttttgggtagctggttggatgcattataagtaattccatcagagaagacgttttttaacagtttgaacaatcggttatcttccgagtccagataagataaactttgttttcttttgatttgctatgaatatgagtggcaataaatacagggcataaagttcatctct

SEQ ID NO: 3678 - protein, 146 aa, Gossypium hirsutum
  misc_feature (1)..(146): useful for making plants with increased salt and oxidative stress resistance as described in USSN 12/922,143
  misc_feature (1)..(146): Ceres CLONE ID no.1839135
  misc_feature (1)..(146): Bit score of 413.1 for HMM based on sequences of FIGURE 14 of USSN 12/922,143.
  misc_feature (106)..(130): Pfam Name: zf-LSD1 Pfam Description: LSD1 zinc finger
  misc_feature (1)..(146): Functional Homolog Of Ceres SEEDLINE ID no. ME02927
MPVPLAPYPTPPAPYTPPAANGAQSQLVCSGCRNLLLYPVGATSVCCAVCNAVTAVPPPGTEMAQLVCGGCHTLLMYIRGATSVQCSCCHTVNLALEANQVAHVNCGNCRMLLMYQYGARSVKCAVCNFVTSVGGSASAAEQKFNS

SEQ ID NO: 3679 - DNA, 375 bp, Glycine max
  misc_feature (1)..(375): useful for making plants with increased salt and oxidative stress resistance as described in USSN 12/922,143
  misc_feature (1)..(375): Ceres CLONE ID no.1371813
atcttagagtgagtttcgaagagcagtagaaagaaactagaatggccactttagacgaacgcccttctgcgaaaaggtggcttcctcttgaagctaaccctgaagtcatgaaccagttcctttggggtcttggccttccactggacgaggcagagtgctgtgatgtgtttggcttagatgaagagcttctggaaatggttccgaagcccgtcctcgccgtgctttttctttatccaattaccgcaaagtccgaagaagaaaggttgcaacaggaaaacgaaaaaaaggattatagcagcaaagtgtattttatgaagcaaaccgtgggtaatgcttgtggtacaatagggttttcatgcacttgggaacataacc

SEQ ID NO: 3680 - protein, 145 aa, Glycine max
  misc_feature (1)..(145): useful for making plants with increased salt and oxidative stress resistance as described in USSN 12/922,143
  misc_feature (1)..(145): Ceres CLONE ID no.1371813
  misc_feature (1)..(145): Bit score of 403.5 for HMM based on sequences of FIGURE 14 of USSN 12/922,143.
  misc_feature (67)..(91): Pfam Name: zf-LSD1 Pfam Description: LSD1 zinc finger
  misc_feature (1)..(145): Functional Homolog Of Ceres SEEDLINE ID no. ME02927
MPVPLAPYPTPPAPYTPPANGVQSQLVCSGCRNLLVFPVGATSVCCAVCNAVTAVPPPGTEMAQLVCGGCHTLLMYIRGATSVQCSCCHTVNLALEANQVAHVNCGNCRMLLAYQYGARSVKCAVCNFVTSVGATASTTEQKFST

SEQ ID NO: 3681 - DNA, 875 bp, Gossypium hirsutum
  misc_feature (1)..(875): useful for making plants with increased salt and oxidative stress resistance as described in USSN 12/922,143
  misc_feature (1)..(875): Ceres CLONE ID no.1914866
gtaaggcttcaaataaatttctttggttatcaagtgctctcaagctttctatttttgtttgcatacatccattttatcatcatcttaatgggagaaggattggtgctatctgttttgaaggcagtgaactattaggatcctccaaaagagagtttaccctctgcctgattttacaatgccagttcctcttgctccatatccaacaccttcagggtcatatactcctcctgcgaatggggctcaaagccagcttgtatgttctggatgccgaaatctattaatgtatccagctggagcaacctctgtgtgttgtgctgtttgcaatgcaataacagctgtgccacctcctggaacagaaatggcccagttagtttgtggaggctgccataccttattgatgtacattcgtggagccacaagtgttcaatgttcatgctgtcacactgtcaatttggccttggaagcaaatcaggtggcacatgtaaattgtgggaactgcaggatgctactaatgtaccagtatggagcaagatctgtaaaatgtgcagtttgcaattttgtcacatcagttgggggatcagcaagtggtgcagcagaacagaagttcaacaacacctaaatttaacttcacagttgagattaaaattctagtttacaactttggttttgcatattacaaatatcctcttctattgcacccctcagcaacatagaggaaatcaaatccttgcattgtatagagttgttctttcttttccttttttgcttgcgtggccaattactgaataagcagtttgactttttgttttttgtttttagagttgtttttagagttgaacaatcatttatcatatgataagataaacttcattttc

SEQ ID NO: 3682 - protein, 147 aa, Gossypium hirsutum
  misc_feature (1)..(147): useful for making plants with increased salt and oxidative stress resistance as described in USSN 12/922,143
  misc_feature (1)..(147): Ceres CLONE ID no.1914866
  misc_feature (1)..(147): Bit score of 394.8 for HMM based on sequences of FIGURE 14 of USSN 12/922,143.
  misc_feature (105)..(129): Pfam Name: zf-LSD1 Pfam Description: LSD1 zinc finger
  misc_feature (1)..(147): Functional Homolog Of Ceres SEEDLINE ID no. ME02927
MPVPLAPYPTPSGSYTPPANGAQSQLVCSGCRNLLMYPAGATSVCCAVCNAITAVPPPGTEMAQLVCGGCHTLLMYIRGATSVQCSCCHTVNLALEANQVAHVNCGNCRMLLMYQYGARSVKCAVCNFVTSVGGSASGAAEQKFNNT

SEQ ID NO: 3683 - protein, 187 aa, Arabidopsis thaliana
  misc_feature (1)..(187): useful for making plants with increased salt and oxidative stress resistance as described in USSN 12/922,143
  misc_feature (1)..(187): Public GI ID no.42570227
  misc_feature (1)..(187): Bit score of 344.9 for HMM based on sequences of FIGURE 14 of USSN 12/922,143.
  misc_feature (147)..(171): Pfam Name: zf-LSD1 Pfam Description: LSD1 zinc finger
  misc_feature (1)..(187): Functional Homolog Of Ceres SEEDLINE ID no. ME02927
MHTWKNQIFSDSQFVLLFMGKNCSIIFPEPHLFISHVFIIHLNVLFLVKKINKNNLRFVGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 3684 - DNA, 471 bp, Populus balsamifera subsp. trichocarpa
  misc_feature (1)..(471): useful for making plants with increased salt and oxidative stress resistance as described in USSN 12/922,143
  misc_feature (1)..(471): Ceres ANNOT ID no.1485466
atgccagttcctcttgcaccttatccaacacctccagccccatatgctcctcctgctccagctccagctcctcctcctcctcctccagccaacggtgcacagagccagctcgtgtgttctggatgtcgaaacctgttactctatccagttggagcaacctctgtatgttgtgctgtttgcaatgcagtcacagctgtgccacctcctggcacagaaatggcccagttggtttgcggaggttgccacaccttactgatgtacatccgtggagcaacgagcgtgcagtgttcttgttgtcatacagtcaatctagccttggaggcaaatcaagtggcacacgtcaattgtgggagctgcaggatgctgttgatgtaccgatatggagcacggtctgtgaaatgtgctgtttgcaattttgtcacaccagttggggtctcatcaagcgttaatgaacgcaagttcaatacctga

SEQ ID NO: 3685 - protein, 156 aa, Populus balsamifera subsp. trichocarpa
  misc_feature (1)..(156): useful for making plants with increased salt and oxidative stress resistance as described in USSN 12/922,143
  misc_feature (1)..(156): Ceres ANNOT ID no.1485466
  misc_feature (1)..(156): Bit score of 376.8 for HMM based on sequences of FIGURE 14 of USSN 12/922,143.
  misc_feature (116)..(140): Pfam Name: zf-LSD1 Pfam Description: LSD1 zinc finger
  misc_feature (1)..(156): Functional Homolog Of Ceres SEEDLINE ID no. ME02927
MPVPLAPYPTPPAPYAPPAPAPAPPPPPPANGAQSQLVCSGCRNLLLYPVGATSVCCAVCNAVTAVPPPGTEMAQLVCGGCHTLLMYIRGATSVQCSCCHTVNLALEANQVAHVNCGSCRMLLMYRYGARSVKCAVCNFVTPVGVSSSVNERKFNT

SEQ ID NO: 3686 - DNA, 708 bp, Gossypium hirsutum
  misc_feature (1)..(708): useful for making plants with increased salt and oxidative stress resistance as described in USSN 12/922,143
  misc_feature (1)..(708): Ceres CLONE ID no.1939451
atcttgtatggttctctaagaaagtttccaaattgggaaccaagtattttgttgttatacatacactcctttctcatcatttccctttctgtttcattgttaactgttataatcttcattatagtccattctgattccactttctgagtttttgcagttactaaatttcttgtttcttactttttctggacatggtaagaatgggagaaggattggtgctatctgttttgaaggcagtgaactattaggatcctccaaaagagagtttaccctctgcctgattttacaatgccagttcctcttgctccatatccaacaccttcagggtcatatactcctcctgcgaatggggctcaaagccagcttgtatgttctggatgccgaaatctattaatgtatccagctggagcaacctctgtgtgttgtgctgtttgcaatgcaataacagctgtgccacctcctggaacagaaatggcccagttagtttgtggaggctgccataccttattgatgtacattcgtggagccacaagtgttcaatgttcatgctgtcacactgtcaatttggccttggaagcaaatcaggtggcacatgtaaattgtgggaactgcaggatgctactaatgtaccagtatggagcaagatctgtaaaatgtgcagtttgcaattttgtcacatcagttgggggatcagcaagtggtgcagca

SEQ ID NO: 3687 - protein, 140 aa, Gossypium hirsutum
  misc_feature (1)..(140): useful for making plants with increased salt and oxidative stress resistance as described in USSN 12/922,143
  misc_feature (1)..(140): Ceres CLONE ID no.1939451
  misc_feature (1)..(140): Bit score of 370.5 for HMM based on sequences of FIGURE 14 of USSN 12/922,143.
  misc_feature (105)..(129): Pfam Name: zf-LSD1 Pfam Description: LSD1 zinc finger
  misc_feature (1)..(140): Functional Homolog Of Ceres SEEDLINE ID no. ME02927
MPVPLAPYPTPSGSYTPPANGAQSQLVCSGCRNLLMYPAGATSVCCAVCNAITAVPPPGTEMAQLVCGGCHTLLMYIRGATSVQCSCCHTVNLALEANQVAHVNCGNCRMLLMYQYGARSVKCAVCNFVTSVGGSASGAA

SEQ ID NO: 3688 - DNA, 1107 bp, Glycine max
  misc_feature (1)..(1107): useful for making plants with increased salt and oxidative stress resistance as described in USSN 12/922,143
  misc_feature (1)..(1107): Ceres CLONE ID no.530218
ttttctctctctctctccccactttcatctgtaacaagttgtcaagggcgtgtgtttttgccccacttgggagttgggacactattctatttaatttaatttcacttctggtgagagggcctcaactcttctctacttctgtgctccaatttcctgttgcttcatgcatggctccctaagggaagaaagcttgtcatttgactcttattacgttatcctgtttgcaaatttatttgctctacaatctgcttcacaggtttctctctctgtttctgctggagttgttcaaatgggagaaagagttttattctctacgtagagtttggtagacaaagataatattttgagataatgctagttccacttgccccgtaccctccaccccctccaccagctccatatacgcctccaccaaatggtgcacagagtcaactagtctgttctgggtgtagaaaccttctgctctatccagttggagccacctctgtgtgctgtgctgtttgcaatgcagtcacaacagtgccacctcctggcacagaaatggcccagttagtttgtggaggctgtcacactttcctcatgtacatccgtggagccacaagtgtgcaatgctcttgctgtcacacggtcaatctagctttggaagcaaatctggtggcgcatgtcaactgtgggaactgtaagatgctactcaggtaccaatatggagcaagatccgtgaaatgtgccgtttgcagttttgtaacgtcagttggggcctcgacaagcaccactgagcagaaattcagcacctaaatcttactgtaaaattggtgacagacaccacgaccttggttttaatcaaatatcgcccttgaggaataacgagtgcatatgagatagctgaggaaattttcttaacatgtatagagctatttttcccttgagtgaaataattaaataaattttgtattattggtgtaccatgtaatgctttatttgtaagcagtgtaagcctctaaaggaaatgagtagtggagtttatagttctccaatttcaattgcagtgtgccaaaaagctatttggaataactatatatgataagattattgattctgagtgctttt

SEQ ID NO: 3689 - protein, 147 aa, Glycine max
  misc_feature (1)..(147): useful for making plants with increased salt and oxidative stress resistance as described in USSN 12/922,143
  misc_feature (1)..(147): Ceres CLONE ID no.530218
  misc_feature (1)..(147): Bit score of 374.4 for HMM based on sequences of FIGURE 14 of USSN 12/922,143.
  misc_feature (69)..(93): Pfam Name: zf-LSD1 Pfam Description: LSD1 zinc finger
  misc_feature (1)..(147): Functional Homolog Of Ceres SEEDLINE ID no. ME02927
MLVPLAPYPPPPPPAPYTPPPNGAQSQLVCSGCRNLLLYPVGATSVCCAVCNAVTTVPPPGTEMAQLVCGGCHTFLMYIRGATSVQCSCCHTVNLALEANLVAHVNCGNCKMLLRYQYGARSVKCAVCSFVTSVGASTSTTEQKFST

SEQ ID NO: 3690 - DNA, 844 bp, Glycine max
  misc_feature (1)..(844): useful for making plants with increased salt and oxidative stress resistance as described in USSN 12/922,143
  misc_feature (1)..(844): Ceres CLONE ID no.562250
  misc_feature (404)..(404): s is g or c
  misc_feature (432)..(432): m is a or c
  misc_feature (615)..(615): m is a or c
  misc_feature (624)..(624): m is a or c
  misc_feature (627)..(627): m is a or c
  misc_feature (628)..(628): y is t/u or c
  misc_feature (649)..(649): w is a or t/u
  misc_feature (743)..(743): r is g or a
  misc_feature (783)..(783): y is t/u or c
  misc_feature (786)..(786): s is g or c
  misc_feature (839)..(839): y is t/u or c
acttaactcttatagtctttcttattccttctggaatccttccctttagtttcatgcgcaaggggaagaagcaattcatttgactcttactttattatttgatttgccggcaccctcttcttcacgggagctgaaaaaaaatgggagaaagtgctttgttctctgtgtagagtttggcagagaaagataacaacattttttagtcctttataatgccagttccacttgccccctacccaacaccgccagctccttatacaccaccagctaatggtgtacagagtcaacttgtctgttctgggtgtagaaaccttctagtgtttccagttggagccacctccgtgtgctgtgctgtttgcaatgctgtcacagcagtgccacctcctggcacagaaatggcccasttagtatgtggaggttgccatactttamtcatgtacatccggggcgcgacaagtgtgcaatgttcatgttgtcacactgtcaatctagctttggaagcaaatcaggtggcacatgtcaactgtgggaactgcaggatgctactggcgtaccaatatggagcaagatccgtgaaatgtgcagtttgcaattttgtaacatcagttggggccmcagcaagcmccmytgagcagaagttcagcacctwaaacatacaaaatagcaaggtcattatagactctacaaccttggttttgagttacatatcgcccttaaggaataaagaggttatcagattggaraggaaactcgtttcacgtgtatagagttatttttttgccytgsgtgattgtattaaattatatttttgttagattgggtgtatgaaaaaactattyatgac

SEQ ID NO: 3691 - protein, 184 aa, Glycine max
  misc_feature (1)..(184): useful for making plants with increased salt and oxidative stress resistance as described in USSN 12/922,143
  misc_feature (1)..(184): Ceres CLONE ID no.562250
  misc_feature (1)..(184): Bit score of 389.9 for HMM based on sequences of FIGURE 14 of USSN 12/922,143.
  misc_feature (105)..(129): Pfam Name: zf-LSD1 Pfam Description: LSD1 zinc finger
  misc_feature (1)..(184): Functional Homolog Of Ceres SEEDLINE ID no. ME02927
  misc_feature (64)..(64): Xaa is any aa, unknown or other
  misc_feature (74)..(74): Xaa is any aa, unknown or other
  misc_feature (135)..(135): Xaa is any aa, unknown or other
  misc_feature (138)..(138): Xaa is any aa, unknown or other
  misc_feature (139)..(139): Xaa is any aa, unknown or other
  misc_feature (146)..(146): Xaa is any aa, unknown or other
  misc_feature (177)..(177): Xaa is any aa, unknown or other
MPVPLAPYPTPPAPYTPPANGVQSQLVCSGCRNLLVFPVGATSVCCAVCNAVTAVPPPGTEMAXLVCGGCHTLXMYIRGATSVQCSCCHTVNLALEANQVAHVNCGNCRMLLAYQYGARSVKCAVCNFVTSVGAXASXXEQKFSTXNIQNSKVIIDSTTLVLSYISPLRNKEVIRLXRKLVSRV

SEQ ID NO: 3692 - protein, 143 aa, Oryza sativa subsp. japonica
  misc_feature (1)..(143): useful for making plants with increased salt and oxidative stress resistance as described in USSN 12/922,143
  misc_feature (1)..(143): Public GI ID no.40809629
  misc_feature (1)..(143): Bit score of 397.5 for HMM based on sequences of FIGURE 14 of USSN 12/922,143.
  misc_feature (104)..(128): Pfam Name: zf-LSD1 Pfam Description: LSD1 zinc finger
  misc_feature (1)..(143): Functional Homolog Of Ceres SEEDLINE ID no. ME02927
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGTDQKPSS

SEQ ID NO: 3693 - protein, 184 aa, Oryza sativa subsp. japonica
  misc_feature (1)..(184): useful for making plants with increased salt and oxidative stress resistance as described in USSN 12/922,143
  misc_feature (1)..(184): Public GI ID no.115474891
  misc_feature (1)..(184): Bit score of 397.5 for HMM based on sequences of FIGURE 14 of USSN 12/922,143.
  misc_feature (145)..(169): Pfam Name: zf-LSD1 Pfam Description: LSD1 zinc finger
  misc_feature (1)..(184): Functional Homolog Of Ceres SEEDLINE ID no. ME02927
MHLSAGFLSCRERKGDFSCLTAARICEASTSDAVVQAAGTAMPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGTDQKPSS

SEQ ID NO: 3694 - protein, 143 aa, Oryza sativa subsp. japonica
  misc_feature (1)..(143): useful for making plants with increased salt and oxidative stress resistance as described in USSN 12/922,143
  misc_feature (1)..(143): Public GI ID no.42406064
  misc_feature (1)..(143): Bit score of 395.1 for HMM based on sequences of FIGURE 14 of USSN 12/922,143.
  misc_feature (104)..(128): Pfam Name: zf-LSD1 Pfam Description: LSD1 zinc finger
  misc_feature (1)..(143): Functional Homolog Of Ceres SEEDLINE ID no. ME02927
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGIDQKPSS

SEQ ID NO: 3695 - protein, 165 aa, Oryza sativa subsp. indica
  misc_feature (1)..(165): useful for making plants with increased salt and oxidative stress resistance as described in USSN 12/922,143
  misc_feature (1)..(165): Public GI ID no.125560221
  misc_feature (1)..(165): Bit score of 376.1 for HMM based on sequences of FIGURE 14 of USSN 12/922,143.
  misc_feature (104)..(128): Pfam Name: zf-LSD1 Pfam Description: LSD1 zinc finger
  misc_feature (1)..(165): Functional Homolog Of Ceres SEEDLINE ID no. ME02927
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGEHWDPGDLYNLSDCHPKLMSAWQQLAVMACDAF

SEQ ID NO: 3696 - protein, 165 aa, Oryza sativa subsp. japonica
  misc_feature (1)..(165): useful for making plants with increased salt and oxidative stress resistance as described in USSN 12/922,143
  misc_feature (1)..(165): Public GI ID no.125602263
  misc_feature (1)..(165): Bit score of 377.3 for HMM based on sequences of FIGURE 14 of USSN 12/922,143.
  misc_feature (104)..(128): Pfam Name: zf-LSD1 Pfam Description: LSD1 zinc finger
  misc_feature (1)..(165): Functional Homolog Of Ceres SEEDLINE ID no. ME02927
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGEHWDPGDWYNLSDCHPKLMSAWQQLAVMACDAF

SEQ ID NO: 3697 - DNA, 484 bp, Panicum virgatum
  misc_feature (1)..(484): useful for making plants with increased salt and oxidative stress resistance as described in USSN 12/922,143
  misc_feature (1)..(484): Ceres CLONE ID no.1720386
tgtgctaacccatgaactgctcttatgcatgcgacagccataagcattgctattagggcaaagcagccagtttccgacgcctgatagccgccggaatctgcgagatctccacgagcagcgtcgtcggataaggcagccggcacggcaatgccggttccccttgccccgtatccaactcctccggtgccattcacaccccccaatggggcccaaagccagcttgtatgcaccgggtgccggaatcttctcatgtatccagctgatgcaacgtccgtctgctgtgcagtttgcagcaccgtcaccgccgtgccggctccgggaactgagatggcacagttagtttgcggaggatgccacactctcctgatgtacatacgtggcgcgacaagtgtacaatgttcttgctgccacactgttaacctggctatggaagcgaatcaggtcgcccatgtaaattgcgggaactgccgtatgctgcttatgt

SEQ ID NO: 3698 - protein, 143 aa, Panicum virgatum
  misc_feature (1)..(143): useful for making plants with increased salt and oxidative stress resistance as described in USSN 12/922,143
  misc_feature (1)..(143): Ceres CLONE ID no.1720386
  misc_feature (1)..(143): Bit score of 394.6 for HMM based on sequences of FIGURE 14 of USSN 12/922,143.
  misc_feature (104)..(128): Pfam Name: zf-LSD1 Pfam Description: LSD1 zinc finger
  misc_feature (1)..(143): Functional Homolog Of Ceres SEEDLINE ID no. ME02927
MPVPLAPYPTPPVPFTPPNGAQSQLVCTGCRNLLMYPADATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGAEQKPSS

SEQ ID NO: 3699 - DNA, 1451 bp, Zea mays
  misc_feature (1)..(1451): useful for making plants with increased salt and oxidative stress resistance as described in USSN 12/922,143
  misc_feature (1)..(1451): Ceres CLONE ID no.391080
gattggctgggaactacatcttggaattccttttttttctctctctcactcgatttctttgtttgattattggccatggtgggtgattcctcgcctgttttatctcgaaactggattagctgcgagtttttttttcttctttcaacccgctgcgttattctaagctcggtctactcgttgcatcaggccaacaatggcaagtggcttccatgaacatggctgtccatgaaaaatcccccgtatgcatgctcggtctaatctcctcaagctagcgaaacgaaatttcctaaaagccggtctggtcctcgaatacagcttgttgcctgagccgctgggagtcctatggagtagtagagttcttcaccttcttctgcgcgcgattactgttagccggcttgaggagaagctggaacgatcttgacgtgcattcagagaatcgatttttccccgtctcccaaggactcctcgtccattagtaatcgattttactgctactgaacagctctttgcgtgcattttctccgagatttctgtggatttcaaatttcaatgcaactgaagccactctgtctctctccctcgctctgtttcgtcagcgtctcctgcacgtgctgtgtcgtttccagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgcggaggatgccacaccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggaacctcacctggtgcagagcagaagcccagcagctgagctgatagtgtccctgaaattgctgtgagaccacctatgaaaaggatgctttgagtgcacatgtatagagttcttccctgaagcgattctttcactttcttttcttttgttttcttttttggttcctcctcaccatctccaccccacccgtccacttctgcgttccttcgatggatctggcgagcccgcggaataaatgagagttttggatatatagctagggcttaacctcgtcgacttgtctgtaaaatcgaatgagacatatatataaacctatgttgttttc

SEQ ID NO: 3700 - protein, 143 aa, Zea mays
  misc_feature (1)..(143): useful for making plants with increased salt and oxidative stress resistance as described in USSN 12/922,143
  misc_feature (1)..(143): Ceres CLONE ID no.391080
  misc_feature (1)..(143): Bit score of 392.0 for HMM based on sequences of FIGURE 14 of USSN 12/922,143.
  misc_feature (104)..(128): Pfam Name: zf-LSD1 Pfam Description: LSD1 zinc finger
  misc_feature (1)..(143): Functional Homolog Of Ceres SEEDLINE ID no. ME02927
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCSFVTSVGTSPGAEQKPSS

SEQ ID NO: 3701 - DNA, 695 bp, Panicum virgatum
  misc_feature (1)..(695): useful for making plants with increased salt and oxidative stress resistance as described in USSN 12/922,143
  misc_feature (1)..(695): Ceres CLONE ID no.1950743
gtcagcctctctatactacatagagagagagagagagagagatgtgctaacccatgaactgctcttatgcatgcgacagccataagcattgctattagggcaaagcagccagtttccgacgcctgatagccgccggaatctgcgagatctccacgagcagcgtcgtcggataaggcagccggcacggcaatgccggttccccttgccccgtatccaactcctccggtgccattcacaccccccaatggggcccaaagccagcttgtatgcaccgggtgccggaatcttctcatgtatccagctgatgcaacgtccgtctgctgtgcagtttgcagcaccgtcaccgccgtgccggctccgggaactgagatggcacagttagtttgcggaggatgccacactctcctgatgtacatacgtggcgcgacaagtgtacaatgttcttgctgccacactgttaacctggctatggaaggtacgaatcaggtcgcccatgtaaattgcgggaactgccgtatgctgcttatgtaccagtatggcgctaggtctgtgaaatgtgcagtctgcaattttgtgacatcagttggggcctcacctggtgcagagcacaagcccagcagctgatgttcctgaaaatactgagatcacctatgaaggcagcttctgaataggatgctttgagtgcaaatgtatag

SEQ ID NO: 3702 - protein, 144 aa, Panicum virgatum
  misc_feature (1)..(144): useful for making plants with increased salt and oxidative stress resistance as described in USSN 12/922,143
  misc_feature (1)..(144): Ceres CLONE ID no.1950743
  misc_feature (1)..(144): Bit score of 382.4 for HMM based on sequences of FIGURE 14 of USSN 12/922,143.
  misc_feature (105)..(129): Pfam Name: zf-LSD1 Pfam Description: LSD1 zinc finger
  misc_feature (1)..(144): Functional Homolog Of Ceres SEEDLINE ID no. ME02927
MPVPLAPYPTPPVPFTPPNGAQSQLVCTGCRNLLMYPADATSVCCAVCSTVTAVPAPGTEMAQLVCGGCHTLLMYIRGATSVQCSCCHTVNLAMEGTNQVAHVNCGNCRMLLMYQYGARSVKCAVCNFVTSVGASPGAEHKPSS

SEQ ID NO: 3703 - protein, 110 aa, Arabidopsis thaliana
  misc_feature (1)..(110): useful for making plants with increased salt and oxidative stress resistance as described in USSN 12/922,143
  misc_feature (1)..(110): Public GI ID no.12322448
  misc_feature (1)..(110): Bit score of 200.3 for HMM based on sequences of FIGURE 14 of USSN 12/922,143.
  misc_feature (76)..(100): Pfam Name: zf-LSD1 Pfam Description: LSD1 zinc finger
  misc_feature (1)..(110): Functional Homolog Of Ceres SEEDLINE ID no. ME02927
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEGLHAY

SEQ ID NO: 3704 - DNA, 684 bp, Panicum virgatum
  misc_feature (1)..(684): useful for making plants with increased salt and oxidative stress resistance as described in USSN 12/922,143
  misc_feature (1)..(684): Ceres CLONE ID no.1962626
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
tattaggtagctgtaaattcacatactgaagtgtcctttgtcctgcaattttcaggggcccaaagccagcttgtctgcaccgggtgccggaatcttctcatgtatccagctggtgcgacgtctgtctgctgtgcagtttgcagcaccgtcaccgccgtgccggctccaggaactgagatggcacagttagtttgcggaggatgccacactctcctgatgtacatacgtggggcgacaagtgtacaatgttcttgctgccacactgttaaccttgctatggaagcgaatcaagtcgcgcatgtaaattgcgggaactgccgtatgctgcttatgtaccagtatggtgctagatctgtgaaatgtgcagtctgcaattttgtgacatcagttggggcctcacctggtgcagagcagaagcccagcagctgatgttcctgaaaatactgagatcacatatgaaggcagcttctgaaaaggatgctttgagtgcacatgtatagagttcttccctgaagcaatttttccccctcctttatctctcttcttcccatccattctgcattccttcgatggacctggcgagcccgcggaatagagttttgagaaataactagtgctcnnnttcgtcgacttgtctgtaaaactgaatgagacatatacataaacctatggtgttttctgtgt

SEQ ID NO: 3705 - protein, 109 aa, Panicum virgatum
  misc_feature (1)..(109): useful for making plants with increased salt and oxidative stress resistance as described in USSN 12/922,143
  misc_feature (1)..(109): Ceres CLONE ID no.1962626
  misc_feature (1)..(109): Bit score of 249.6 for HMM based on sequences of FIGURE 14 of USSN 12/922,143.
  misc_feature (70)..(94): Pfam Name: zf-LSD1 Pfam Description: LSD1 zinc finger
  misc_feature (1)..(109): Functional Homolog Of Ceres SEEDLINE ID no. ME02927
MYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGAEQKPSS

SEQ ID NO: 3706 - DNA, 566 bp, Zea mays
  misc_feature (1)..(566): useful for making plants with increased salt and oxidative stress resistance as described in USSN 12/922,143
  misc_feature (1)..(566): Ceres CLONE ID no.348573
  misc_feature (2)..(2): w is a or t/u
  misc_feature (101)..(101): r is g or a
awtcaaaagcacgagacccgtccttgaggggcacgtcctagatcggtggcgcctgcctctcgccgccgatacggtgcctctcgcggtctcgctccccctcrcaggtcttttggtttttttagttcctccctttgcttcttggaggtgtttgttgccgtctcacccgcagttcttgagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagt

SEQ ID NO: 3707 - protein, 129 aa, Zea mays
  misc_feature (1)..(129): useful for making plants with increased salt and oxidative stress resistance as described in USSN 12/922,143
  misc_feature (1)..(129): Ceres CLONE ID no.348573
  misc_feature (1)..(129): Bit score of 174.4 for HMM based on sequences of FIGURE 14 of USSN 12/922,143.
  misc_feature (84)..(108): Pfam Name: zf-LSD1 Pfam Description: LSD1 zinc finger
  misc_feature (1)..(129): Functional Homolog Of Ceres SEEDLINE ID no. ME02927
MQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTASS

SEQ ID NO: 3708 - DNA, 432 bp, Sorghum bicolor
  misc_feature (1)..(432): useful for making plants with increased salt and oxidative stress resistance as described in USSN 12/922,143
  misc_feature (1)..(432): Ceres ANNOT ID no.6117859
atgccggttccccttgccccgtatccgactcctccggtgccattcacgccgcctaatggggcccaaagccagcttgtctgcaccgggtgccggaatctcctcatgtatccagctggtgcgacgtctgtctgctgtgccgtttgcagcaccgtcactgccgtgccggctccaggaactgagatggcacagttagtttgtggaggatgccacactctcctgatgtacatacgtggtgcgactagtgtacaatgttcttgctgccacaccgttaacctggctatggaagcaaatcaagttgcgcatgtaaactgcgggaactgccgtatgctgctcatgtaccagtatggagctaggtctgtgaaatgcgcagtctgcaattttgtgacatcagttggggcctcacctggtgcagagcagaagcccagcagctga

SEQ ID NO: 3709 - protein, 143 aa, Sorghum bicolor
  misc_feature (1)..(143): useful for making plants with increased salt and oxidative stress resistance as described in USSN 12/922,143
  misc_feature (1)..(143): Ceres ANNOT ID no.6117859
  misc_feature (1)..(143): Bit score of 394.9 for HMM based on sequences of FIGURE 14 of USSN 12/922,143.
  misc_feature (104)..(128): Pfam Name: zf-LSD1 Pfam Description: LSD1 zinc finger
  misc_feature (1)..(143): Functional Homolog Of Ceres SEEDLINE ID no. ME02927
MPVPLAPYPTPPVPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGAEQKPSS

SEQ ID NO: 3710 - DNA, 1039 bp, Arabidopsis thaliana
  misc_feature (1)..(1039): useful for making plants with increased salt and oxidative stress resistance as described in USSN 12/922,143
  misc_feature (1)..(1039): Ceres SEEDLINE ID no.ME03047
  misc_feature (1)..(1039): Inplanta Sequence
cttacgcgtcatgtaaaaaaaaaagaagcgtaaattacgaaaaacagagagataaatccgggcattgagattttggagatagagagagagaaaaatcgaaatctattgtctatctcctcaatttggattggattttctgcatatcatcgctctagatttcgcgggttttggattcgattccttacccttctccaatcgaagtttttgggtttgaattggatttgggtttcgttccaaaatcagctctttttgttaatcagcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaagtaatcaagaatgagtgagatcttaaagatcaaatccaaattcttcctctattcctgcgtttggtttgtgcatattacatacgcggaaaaactgtatgttatatatctcttgactcctttttaacccaagagaaaaagcttatcagaatctcttgttactgcattattggggtttattcaaagttgaagacacaaggtttttgcccaaaaaaaaaaaaaaaaa

SEQ ID NO: 3711 - protein, 184 aa, Arabidopsis thaliana; identical to SEQ ID NO: 3656
  misc_feature (1)..(184): useful for making plants with increased salt and oxidative stress resistance as described in USSN 12/922,143
  misc_feature (1)..(184): Ceres SEEDLINE ID no.ME03047
  misc_feature (1)..(184): Bit score of 391.3 for HMM based on sequences of FIGURE 11 of USSN 12/922,143.
  misc_feature (95)..(119): Pfam Name: zf-LSD1 Pfam Description: LSD1 zinc finger

SEQ ID NO: 3712 - DNA, 513 bp, Triticum aestivum
  misc_feature (1)..(513): useful for making plants with increased salt and oxidative stress resistance as described in USSN 12/922,143
  misc_feature (1)..(513): Ceres CLONE ID no.1324588
ttccttcaccgcgtctcctcccagacaaaatcccatccggaatcaacttctctccctccgatcctcttcctcccccttccctgccgcctccgccggcgagaatcgctgtcgcgcccgtcgccacgacctaggagccctccttcacgggcggacctcttcccggagccaccggagggcggggacgggcggccagtctcgtccagagccggtatgcagagccagatcgtgtgccaccgttgccggagggtgctggcctacccgtcaggggcgcccagcgtgtgctgcgccatgtgccgagccatcaccgccgtgccacccccagcgccagcagtggaaatggctcagcttatatgtggtggttgccgaactttgctgatgtacacccgtaatgcagacactgtgagatgctcatgttgcagtactgtcaatcttgtcagaccagtcaataatatagcccacgtgaactgtggtcggtgccggacaactttgatgtatccacatggagcaccttct

SEQ ID NO: 3713 - protein, 101 aa, Triticum aestivum
  misc_feature (1)..(101): useful for making plants with increased salt and oxidative stress resistance as described in USSN 12/922,143
  misc_feature (1)..(101): Ceres CLONE ID no.1324588
  misc_feature (1)..(101): Bit score of 103.8 for HMM based on sequences of FIGURE 11 of USSN 12/922,143.
  misc_feature (48)..(72): Pfam Name: zf-LSD1 Pfam Description: LSD1 zinc finger
  misc_feature (1)..(101): Functional Homolog Of Ceres SEEDLINE ID no. ME03047
MQSQIVCHRCRRVLAYPSGAPSVCCAMCRAITAVPPPAPAVEMAQLICGGCRTLLMYTRNADTVRCSCCSTVNLVRPVNNIAHVNCGRCRTTLMYPHGAPS

SEQ ID NO: 3714 - protein, 197 aa, Oryza sativa subsp. indica
  misc_feature (1)..(197): useful for making plants with increased salt and oxidative stress resistance as described in USSN 12/922,143
  misc_feature (1)..(197): Public GI ID no.125560035
  misc_feature (1)..(197): Bit score of 177.6 for HMM based on sequences of FIGURE 11 of USSN 12/922,143.
  misc_feature (135)..(159): Pfam Name: zf-LSD1 Pfam Description: LSD1 zinc finger
  misc_feature (1)..(197): Functional Homolog Of Ceres SEEDLINE ID no. ME03047
MGAIHVSPIRGSIPFDKCTDLDHAAPANLQSDLCKTATAIRSRPPDSYRHMQDQLICSGCRRVVQYRRGVAGVCCPGCNTLTAVNPSAVADMSELICSGCPTLLFYNRGASNIRCPSCNRLNSTRSANQIAHLTCGQCRTTLMHPPGASTVQCATCRYVNHVRDARPQTVLVENPKTLDDKGKLVSNVVVGVTSWKR

SEQ ID NO: 3715 - protein, 210 aa, Oryza sativa subsp. japonica
  misc_feature (1)..(210): useful for making plants with increased salt and oxidative stress resistance as described in USSN 12/922,143
  misc_feature (1)..(210): Public GI ID no.125602083
  misc_feature (1)..(210): Bit score of 177.6 for HMM based on sequences of FIGURE 11 of USSN 12/922,143.
  misc_feature (148)..(172): Pfam Name: zf-LSD1 Pfam Description: LSD1 zinc finger
  misc_feature (1)..(210): Functional Homolog Of Ceres SEEDLINE ID no. ME03047
MMPEVSNKDVIISICVSDGYILSFVIEGRTDTDLDHASPANLQSDLCKTATAIRSRPPDSYRHMQDQLICSGCRRVVQYRRGVAGVCCPGCNTLTAVNPSAVADMSELICSGCPTLLFYNRGASNIRCPSCNRLNSTRSANQIAHLTCGQCRTTLMHPPGASTVQCATCRYVNHVRDARPQTVLVENPKTLDDKGKLVSNVVVGVTSWKR

SEQ ID NO: 3716 - protein, 147 aa, Oryza sativa subsp. japonica
  misc_feature (1)..(147): useful for making plants with increased salt and oxidative stress resistance as described in USSN 12/922,143
  misc_feature (1)..(147): Public GI ID no.115474647
  misc_feature (1)..(147): Bit score of 177.6 for HMM based on sequences of FIGURE 11 of USSN 12/922,143.
  misc_feature (85)..(109): Pfam Name: zf-LSD1 Pfam Description: LSD1 zinc finger
  misc_feature (1)..(147): Functional Homolog Of Ceres SEEDLINE ID no. ME03047
MQDQLICSGCRRVVQYRRGVAGVCCPGCNTLTAVNPSAVADMSELICSGCPTLLFYNRGASNIRCPSCNRLNSTRSANQIAHLTCGQCRTTLMHPPGASTVQCATCRYVNHVRDARPQTVLVENPKTLDDKGKLVSNVVVGVTSWKR

SEQ ID NO: 3717 - DNA, 1850 bp, Panicum virgatum
  misc_feature (1)..(1850): useful for making plants with increased salt and oxidative stress resistance as described in USSN 12/922,143
  misc_feature (1)..(1850): Ceres CLONE ID no.1909223
acaaccctcctccatctcatctctctctctctctcctccagctagcttctcactctccagagtccagaacgcgtgcagttcgaagctaagctaggcgtgcgtccaggtccatccttctctagttgcgttcgaccacatccttccttctcgggcttcttgccttggtaaatcaatgttctttccttgggttcttgagccactacggatcagatagattgcatgcttgcttgggtttagcagccaagacgatttcttgatgcgcaagcgcaaggccttaccatggggggcaaggtctgggtttgatctataggcttgccacagcatgcacattgcctggcctgatcgaccggctcctgtgatcatgcatatagaggttcagacatctcaggttggatcatgcacagccacacggcacctttctgttgaatctgccggcaaaatgtgcgatcgccagcacaagcccttcatttgtcttccaacagataaaacttggcttctcaaatgccttgtgtttttgtttctaactcttctttaatggaaaggcagagcacgtgccattgtccctaaaaaaaatttgccttgtactatgcgtagtagcctctggaaatatggattggaatttcaaacttggaatgaagctagtagtatgattctaaccaaaccaagttccaattgcaggtatgcaggaccagctgatctgcagcggctgcaagcgtgttcttcagtaccgcaggggagccgccggcgtctgctgcccaggctgcaacactttcaccgccgccaaccagtcaggaccggacatgtctgaactcgtctgcggcggctgcttcaccatgctcgtgcacaaccgcggcgccgccaacattcgctgcccgcactgcggcagggtcaactcaacaagatcagagaaccagattggtcacctgtcatgcgggcattgccggactactctggcgtacccaccgggagcctcgacggtcggatgcccaacttgtcgctgcgtcaatcctgtcaggaacaacaactctggtggctctgcacggcctgcaccatcggtacgttctcctggcttttccaagtttcagtggtcactgcaatgttctgcaatagggcaaaatctaataggcgatactgcttgcatcaagaaacgtatggagccatcgagcaatcaatggccgcaacgcaaccatccttttttttgttgcgtcaaccagcaataaggttgtcctccccaaaagatcacaacattggtaggttcaggttgctccatggtttcagaggaatcagttccttggtaggcaagtagcaatgattagcacacctcgatgcttagatttttcgcttgaaatcctctggaccatgcatgtctagtatcaggatgaaagcgctggtccattggggtttgagcaaacagtctgaatctagctagactgatgtcaaatgttcgacggtgatgacacgtacgggctttattcgctgaactttcatgttcctacttgcaggatgctcggccccagacggttcttgtggagaatcctaagacgctggatgaaaagggcaaactggtgagcaatgtcgccgttggtgtcacctcatggaaaagatgaccaagaactcctccgcggcatcatcccaaggatctactgataaacccttggtgatggacatgtaaaactatcataatcaaactaatgtgaaatcaagtgtgttttgaagcttgatataagaaaaaaaatgtaacagttgagaagcaaaagatctgaagatgtaaatatgctagccggccgtgtgtgcgctagcctatgtactccaagccaaaaaggaatggaaaggagcgaagcattgtgttc

SEQ ID NO: 3718 - protein, 179 aa, Panicum virgatum
  misc_feature (1)..(179): useful for making plants with increased salt and oxidative stress resistance as described in USSN 12/922,143
  misc_feature (1)..(179): Ceres CLONE ID no.1909223
  misc_feature (1)..(179): Bit score of 117.2 for HMM based on sequences of FIGURE 11 of USSN 12/922,143.
  misc_feature (84)..(108): Pfam Name: zf-LSD1 Pfam Description: LSD1 zinc finger
  misc_feature (1)..(179): Functional Homolog Of Ceres SEEDLINE ID no. ME03047
MQDQLICSGCKRVLQYRRGAAGVCCPGCNTFTAANQSGPDMSELVCGGCFTMLVHNRGAANIRCPHCGRVNSTRSENQIGHLSCGHCRTTLAYPPGASTVGCPTCRCVNPVRNNNSGGSARPAPSVRSPGFSKFQWSLQCSAIGQNLIGDTACIKKRMEPSSNQWPQRNHPFFCCVNQQ

SEQ ID NO: 3719 - protein, 136 aa, Zea mays
  misc_feature (1)..(136): useful for making plants with increased salt and oxidative stress resistance as described in USSN 12/922,143
  misc_feature (1)..(136): CERES CLONE ID no.101114546
  misc_feature (1)..(136): Bit score of 79.2 for HMM based on sequences of FIGURE 11 of USSN 12/922,143.
  misc_feature (62)..(86): Pfam Name: zf-LSD1 Pfam Description: LSD1 zinc finger
  misc_feature (1)..(136): Functional Homolog Of Ceres SEEDLINE ID no. ME03047
MQSQIVCNGCRTVLLYPRGAPSVCCAVCHAVSNVPPPAGKSSSQNRLWAFKKVSSSIAHVNCGQCQIVLMYPYGAPSVKCAICNFITNVGGVTPRETFATCTTRINWKLIRHLVNFCANKSTAECNRCCRKPNDSR

SEQ ID NO: 3720 - DNA, 964 bp, Brassica napus
  misc_feature (1)..(964): useful for making plants with increased salt and oxidative stress resistance as described in USSN 12/922,143
  misc_feature (1)..(964): Ceres CLONE ID no.1064300
attttggattggcctctttacatatctgctctttagagttttccggttctgaaatcggatcccctcttccccatcttcccaatcggagctttttggctttgaattggatttgggtttcgaaaagccatctccttttcttcttcgcatcatcccctttggagaaatcagatatgcaggaccagctggtgtgtcatggctgtagaaacacattgatgtatcccagaggagcaaccaatgtccgttgtgcgttatgtcacattgtcaacatggtcccccttcatcctcatcctcctcctcctcctcctcctcatcatgctcatgcagggatggacatggctcacattgtatgtggtggttgtcgaactatgcttatgtacacgcgtggggctagtagtgtaagatgctcgtgttgtcagactgtgaaccttgtcccaggacccccaccgtccaatcaggttgcgcatatcaactgtgggaactgccggacgacactcatgtacccttacggtgcatcatctgttaaatgcgctgtttgccagtttgttactaacgttaacatgagcaatggaagggtgcctctcgcaagtaaccggccaaatggaacagctgctcccgggacaatgccctctacatccacttcaacaccaccgtctcagacacaaactgtcgtcgtagagaacccaatgtcagttaatgaaagtggaaagttggtgagcaacgttgtggttggagtgacaacaggccaaaaataacttttaaagaatcatttgatctgaaagatcaaaattggttccgtctatccctgcttctggtttgtgcatattacatactgttgatgaacactttttttttgttgttaaaaaaaaagttgatgaacataaaggttttttggttcagtaatctgtcattcctgtttgtagactccattgaccatttgtggcattgttaatgtatgtattactat

SEQ ID NO: 3721 - protein, 193 aa, Brassica napus
  misc_feature (1)..(193): useful for making plants with increased salt and oxidative stress resistance as described in USSN 12/922,143
  misc_feature (1)..(193): Ceres CLONE ID no.1064300
  misc_feature (1)..(193): Bit score of 398.8 for HMM based on sequences of FIGURE 11 of USSN 12/922,143.
  misc_feature (101)..(125): Pfam Name: zf-LSD1 Pfam Description: LSD1 zinc finger
  misc_feature (1)..(193): Functional Homolog Of Ceres SEEDLINE ID no. ME03047
MQDQLVCHGCRNTLMYPRGATNVRCALCHIVNMVPLHPHPPPPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNRPNGTAAPGTMPSTSTSTPPSQTQTVVVENPMSVNESGKLVSNVVVGVTTGQK

SEQ ID NO: 3722 - DNA, 995 bp, Brassica napus
  misc_feature (1)..(995): useful for making plants with increased salt and oxidative stress resistance as described in USSN 12/922,143
  misc_feature (1)..(995): Ceres CLONE ID no.1123331
aatttggattggcctctttgcatatctgctctttagagttggccggttctgcaatcggatcccttcttcccccatcttccaatcgaagcttttggctttgaattggattttgggtttcaaaaagccacctccttttcttcttcttatcatccatccctttggagaaatcagatatgcaggaccagctggtgtgtcatggatgtagaaacacattgatgtatcccagaggagctaccaatgtccgttgtgcgttatgtcacattgtcaacatggttcctcttcatcctcatcctcctcctcctcatcatgctcatgcagggatggacatggctcacattgtatgtggtggttgtcggactatgcttatgtatactcgtggggctagtagtgtcagatgctcgtgttgtcagactgtcaaccttgtcccaggacccccaccgtccaatcaggttgcgcatatcaactgcgggaactgccggacgacactcatgtacccttacggtgcatcatctgttaaatgcgctgtttgccagtttgttactaacgttaacatgagcaatggaagggtgcctctcgcaagtaaccggccaaatggaacagcttctcccgggacaatgccctctacatccacttcaacaccaccgtctcagacacaaactgttgtagtagagaacccaatgtccgttaacgaaagtggaaagttggtgagcaacgttgtggttggagtgacaacaggccaaaaataacttttaaagaatgatttgatctgaaagatcaaaattggtttcatctatccctgcgtctggtttgtgcatattacatactgttgatgaacactttttttttttgttaaaaaaaaagttgatgaacacaaaggttttttggttcagtaatgtggcaatcctgtttgtagactccattgaccatttgtggcattgttaatgtatgtattactataatctgatacaccagccaaacattaagatttgagtttg

SEQ ID NO: 3723 - protein, 190 aa, Brassica napus
  misc_feature (1)..(190): useful for making plants with increased salt and oxidative stress resistance as described in USSN 12/922,143
  misc_feature (1)..(190): Ceres CLONE ID no.1123331
  misc_feature (1)..(190): Bit score of 398.7 for HMM based on sequences of FIGURE 11 of USSN 12/922,143.
  misc_feature (98)..(122): Pfam Name: zf-LSD1 Pfam Description: LSD1 zinc finger
  misc_feature (1)..(190): Functional Homolog Of Ceres SEEDLINE ID no. ME03047
MQDQLVCHGCRNTLMYPRGATNVRCALCHIVNMVPLHPHPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNRPNGTASPGTMPSTSTSTPPSQTQTVVVENPMSVNESGKLVSNVVVGVTTGQK

SEQ ID NO: 3724 - DNA, 961 bp, Brassica napus
  misc_feature (1)..(961): useful for making plants with increased salt and oxidative stress resistance as described in USSN 12/922,143
  misc_feature (1)..(961): Ceres CLONE ID no.1069051
aaattttccttgaatttgtaatcccagcagcactgtactcttcaatttcatacaaaaactcatgatttgatgatggatgcaggagctttttggctttgaattggatttgggtttcgaaaagccatctccttttcttcttcgcatcatcccctttggagaaatcagatatgcaggaccagctggtgtgtcatggctgtagaaacacattgatgtatcccagaggagcaaccaatgtccgttgtgcgttatgtcacattgtcaacatggtcccccttcatcctcatcctcctcctcctcctcctcctcatcatgctcatgcagggatggacatggctcacattgtatgtggtggttgtcgaactatgcttatgtacacgcgtggggctagtagtgtaaaatgctcgtgttgtcagactgtgaaccttgtcccaggacccccaccgtccaatcaggttgcgcatatcaactgtgggaactgccggacgacactcatgtacccttacggtgcatcatctgttaaatgcgctgtttgccagtttgttactaacgttaacatgagcaatggaagggtgcctctcgcaagtaaccggccaaatggaacagctgctcccgggacaatgccctctacatccacttcaacaccaccgtctcagacacaaactgtcgtcgtagagaacccaatgtcagttaatgaaagtggaaagttggtgagcaacgttgtggttggagtgacaacaggccaaaaataacttttaaagaatcatttgatctgaaagatcaaaattggttccgtctatccctgcttctggtttgtgcatattacatactgttgatgaacactttttttttgttgttaaaaaaaaagttgatgaacataaaggttttttggttcagtaatctgtcattcctgtttgtagactccattgaccatttgtggcattgttaatgtatgtattactat

SEQ ID NO: 3725 - protein, 193 aa, Brassica napus
  misc_feature (1)..(193): useful for making plants with increased salt and oxidative stress resistance as described in USSN 12/922,143
  misc_feature (1)..(193): Ceres CLONE ID no.1069051
  misc_feature (1)..(193): Bit score of 396.0 for HMM based on sequences of FIGURE 11 of USSN 12/922,143.
  misc_feature (101)..(125): Pfam Name: zf-LSD1 Pfam Description: LSD1 zinc finger
  misc_feature (1)..(193): Functional Homolog Of Ceres SEEDLINE ID no. ME03047
MQDQLVCHGCRNTLMYPRGATNVRCALCHIVNMVPLHPHPPPPPPPHHAHAGMDMAHIVCGGCRTMLMYTRGASSVKCSCCQTVNLVPGPPPSNQVAHINCGNCRTTLMYPYGASSVKCAVCQFVTNVNMSNGRVPLASNRPNGTAAPGTMPSTSTSTPPSQTQTVVVENPMSVNESGKLVSNVVVGVTTGQK

SEQ ID NO: 3726 - DNA, 1121 bp, Brassica napus
  misc_feature (1)..(1121): useful for making plants with increased salt and oxidative stress resistance as described in USSN 12/922,143
  misc_feature (1)..(1121): Ceres CLONE ID no.968078
aatcttattgtccatatctctcagtttggattggcgtctctctgcatatagctcttcgcgggttttgcaatcgagatccctcttccaactccaatcgctagaaccaatctttttcttgaattttgtaatctggacactgttcgtctgattcatatgatgataatggatgcagaagctttttggctttgaattggatttcgggtttcgttttcaaagccagctcctttgtcttcctcggagagagatcagagatgcaggaccagctcgtgtgccatggctgtagaaatacattgctctatcctagaggagctaccaacgttcgctgtgccttatgtaacactatcaacatggtccctcttcatcctcctcctcctcctcctcatcatcatgctcatgcagggatggacatggctcacattgtatgtggtggttgtcgcacaatgcttatgtatactcgtggggcaagcagcgttagatgctcttgctgtcagactgtcaaccttgtccctgcaaccccacccaccaatcagcctgcgcatatcaactgtgggaactgtcgaacaaccctcatgtatccttacggtgcaccatccgttagatgcgctgtttgccagttcgttactaacgttaatatgggcaatggaagggtgcctttcccaactaaccagccgaatggaacagcctcctctcccgggtcaatgccctctacatccactcagtcaacaccaccgtctcagacccaaaccgtcgtcgtagaaaaccccatgtctgttaatgaaagtggaaagttggtgagcaatgttgtggttggagtgacaacagacaagaagaaataacccacgagaaaaaaaaatgattgcagtctctatccctgcgtctgggtttgtgcatattacatacgcggacaagtgactgtttatgttataagttataactccttttttaaccccccccccccccaaaaaaaggcttctcagaatctcttgtttggttttttttttccttctttcaaagttgatgaacacaaaggtttttggtcctacaatctgccattcctatttgtagactttgtaaacttcattgccccctttgtggcattgttaatgtatgtattactatac

SEQ ID NO: 3727 - protein, 194 aa, Brassica napus
  misc_feature (1)..(194): useful for making plants with increased salt and oxidative stress resistance as described in USSN 12/922,143
  misc_feature (1)..(194): Ceres CLONE ID no.968078
  misc_feature (1)..(194): Bit score of 393.3 for HMM based on sequences of FIGURE 11 of USSN 12/922,143.
  misc_feature (99)..(123): Pfam Name: zf-LSD1 Pfam Description: LSD1 zinc finger
  misc_feature (1)..(194): Functional Homolog Of Ceres SEEDLINE ID no. ME03047
MQDQLVCHGCRNTLLYPRGATNVRCALCNTINMVPLHPPPPPPHHHAHAGMDMAHIVCGGCRTMLMYTRGASSVRCSCCQTVNLVPATPPTNQPAHINCGNCRTTLMYPYGAPSVRCAVCQFVTNVNMGNGRVPFPTNQPNGTASSPGSMPSTSTQSTPPSQTQTVVVENPMSVNESGKLVSNVVVGVTTDKKK

SEQ ID NO: 3728 - DNA, 1005 bp, Brassica napus
  misc_feature (1)..(1005): useful for making plants with increased salt and oxidative stress resistance as described in USSN 12/922,143
  misc_feature (1)..(1005): Ceres CLONE ID no.949032
aatttggattggcctctttacatatctgctctttagagttttccggttctgaaatcggatcccctcttccccatcttcccaatcggagctttttggctttgaattggatttgggtttcgaaaagccatctccttttcttcttcgcatcatcccctttggagaaatcagatatgcaggaccagctggtgtgtcatggctgtagaaatacattgatgtatcccagaggagcaaccaatgtccgttgtgcgttatgtcacattgtcaacatggtcccccttcatcctcatcctcctcctcctcctcctcctcatcatgctcatgcagggatggacatggctcacattgtatgtggtggttgtcgaactatgcttatgtacacgcgtggggctagtagtgtaagatgctcgtgttgtcagactgtgaaccttgtcccaggacccccaccgtccaatcaggttgcgcatatcaactgtgggaactgccggacgacactcatgtacccttacggtgcatcatctgttaaatgcgctgtttgccagtttgttactaacgttaacatgagcaatggaagggtgcctctcgcaagtaaccggccaaatggaacagctgctcccgggacaatgccctctacatccactcagtcaacaccaccgtctcagacacaaactgtcgtcgtagagaacccaatgtccgttaatgaaagtggaaagttggtgagcaacgttgtggttggagtgacaacaggccaaaaataacttttaaagaatcatttgatctgaaagatcaaaattggttccgtctatccctgcttctggtttgtgcatattacatactgttgatgaacactttttttttgttgttaaaaaaaaagttgatgaacataaaggttttttggttcagtaatctgtcattcctgtttgtagactccattgaccatttgtggcattgttaatgtatgtattactataatctgatacaccagccaaacattaagatttgagtttg

SEQ ID NO: 3729 - protein, 194 aa, Brassica napus
  misc_feature (1)..(194): useful for making plants with increased salt and oxidative stress resistance as described in USSN 12/922,143
  misc_feature (1)..(194): Ceres CLONE ID no.949032
  misc_feature (1)..(194): Bit score of 394.6 for HMM based on sequences of FIGURE 11 of USSN 12/922,143.
  misc_feature (101)..(125): Pfam Name: zf-LSD1 Pfam Description: LSD1 zinc finger
  misc_feature (1)..(194): Functional Homolog Of Ceres SEEDLINE ID no. ME03047
MQDQLVCHGCRNTLMYPRGATNVRCALCHIVNMVPLHPHPPPPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNRPNGTAAPGTMPSTSTQSTPPSQTQTVVVENPMSVNESGKLVSNVVVGVTTGQK

SEQ ID NO: 3730 - protein, 193 aa, Brassica oleracea
  misc_feature (1)..(193): useful for making plants with increased salt and oxidative stress resistance as described in USSN 12/922,143
  misc_feature (1)..(193): Public GI ID no.17981380
  misc_feature (1)..(193): Bit score of 389.1 for HMM based on sequences of FIGURE 11 of USSN 12/922,143.
  misc_feature (98)..(122): Pfam Name: zf-LSD1 Pfam Description: LSD1 zinc finger
  misc_feature (1)..(193): Functional Homolog Of Ceres SEEDLINE ID no. ME03047
MQDQLMCHGCRNTLLYPRGATNVRCALCNTINMVPLHPPPPPPHHAHAGMDMAHIVCGGCRTMLMYTRGASSVRCSCCQTVNLVPATPPTNQPAHVNCGNCRTTLMYPYGAPSVRCAVCQFVTNVNMGNGRVPFPTNQPNGTASSPGPMPSTSTQSTPPSQTQTVVVENPMSVNESGKLVSNVVVGVTTDKKK

SEQ ID NO: 3731 - DNA, 1219 bp, Glycine max
  misc_feature (1)..(1219): useful for making plants with increased salt and oxidative stress resistance as described in USSN 12/922,143
  misc_feature (1)..(1219): Ceres CLONE ID no.613904
aaaacgtagactaatagtcgctgaagaaatttccgaaagtgtgtgtgggatgagaagatgatgaggaaacattggtagaagaaattgaagagagagagagagagagggttggattggttttcttcttccttttctctaaagagaatctaatctcaatcctcaatacagatttcttcattcctctctcagtcttttctgttttccccctttgacatcctcgttttcgccgaaacaaaaacaactaagatttttttgtttgttttgtttttcttctccttgttgttatttgactcggttgtctgaatcggttgttgcagcagggtcgggagccacagctatgcagagccaagttgtgtgcaatggttgtaggagccttctgctttacccaagaggggcaaccaatgtttgttgtgcattgtgcaacacaattacctctgttcctccccctgggatggaaatgtctcaactttattgtggagggtgtaggacattgctaatgtacacacgtggagctacaagtgtgagatgttcctgctgtcacactgtaaaccttgttccaccagcatctaatcaagtagctcatgtccattgtgggaactgccggacaacactcatgtatccttatggagctccatcagtcaaatgtgctctttgtcactttattactaatgtcagtacgaacaatggaaggcttccgatccctgtccatagacccaatgggacaaccaatgctggaacattacctactacttcaacatcaatgccccaatctcaaagtcaaacagtagtggtagaaaatccaatgtctgttgattcaagtgggaaattggtgagcaatgttgttgttggggttacaacagataagaaataacgccatcacatatagaaggtacagttcacgtcgtgacgcattaccacagttgctgtcacaggaagatattgtttgtgtatatgaatatatatgatattgcagcctgcaattgttgaattgaaattgatatttttccaatataagagctggacgaatatcatgtacgtatgtatgaatgtatatgaggtggacaagtcgtgaaaagggcttaaaacctgttttgtgtgattaccaaagcctactttgttgtttccttggtagccatacccaaatcaattagttcattcacattatatgtttgacttgtaagtcctaaactagtaaatggtatttctttcatgtcttgtg

SEQ ID NO: 3732 - protein, 177 aa, Glycine max
  misc_feature (1)..(177): useful for making plants with increased salt and oxidative stress resistance as described in USSN 12/922,143
  misc_feature (1)..(177): Ceres CLONE ID no.613904
  misc_feature (1)..(177): Bit score of 402.5 for HMM based on sequences of FIGURE 11 of USSN 12/922,143.
  misc_feature (85)..(109): Pfam Name: zf-LSD1 Pfam Description: LSD1 zinc finger
  misc_feature (1)..(177): Functional Homolog Of Ceres SEEDLINE ID no. ME03047
MQSQVVCNGCRSLLLYPRGATNVCCALCNTITSVPPPGMEMSQLYCGGCRTLLMYTRGATSVRCSCCHTVNLVPPASNQVAHVHCGNCRTTLMYPYGAPSVKCALCHFITNVSTNNGRLPIPVHRPNGTTNAGTLPTTSTSMPQSQSQTVVVENPMSVDSSGKLVSNVVVGVTTDKK

SEQ ID NO: 3733 - DNA, 927 bp, Glycine max
  misc_feature (1)..(927): useful for making plants with increased salt and oxidative stress resistance as described in USSN 12/922,143
  misc_feature (1)..(927): Ceres CLONE ID no.1609278
aaaatattggtatagccgcgagcgaggtttcgtttcgttcagttcacacattctaatctctatcgattcctcttccattttctcaattcactacaccccagtttatgggaagccaacttgtgtgtaatgggtgtaggaacatcttggtttaccctagaggagcaaccaatgtttgctgtgcattgtgcaacaccgttacctctgttcctcctcctggaatggacatgtcacaactttattgtggaggctgtacgacattgctaatgtacacacgtggtgctacaagtgtgagatgttcctgctgtcacactattaaccttgtaccagtactagaatctaatcaagtcattcattgtacgaactgccggacaacactcatgtatccttatggagcttcctcagtaaaatgtgcaatttgtcgctatattactaatgtcagtatgacgaatggaaggcttccaattcctgtacagagaccaaatggaacagccaactctggaacagtatcttctacttcatcgtcaatgcctcattctcagagccaaactgtcgtagtagaaaatcccatgtctgttgattcgagtgggaaattggtgagcaatgttgttgtgggcgttacaacagagaagaaatgatacttgtcacattatcatgttatacaagtgtaaagagaacattatttgattcatcagctgctggtgctcaaagatattgttcgtatatgtgactttgcagcatagaagttaaaaatatttttgttctaaacgacatttagactgatttaatttacgtatatgaatacgaggacaagtggaaagggcacaaaacttgtcatttgtgcaattgcctaggtcctctttttgctgtagttggatcacagggtttttcacatctcgaattacaagtcgtagatgcacatttgtttcc

SEQ ID NO: 3734 - protein, 176 aa, Glycine max
  misc_feature (1)..(176): useful for making plants with increased salt and oxidative stress resistance as described in USSN 12/922,143
  misc_feature (1)..(176): Ceres CLONE ID no.1609278
  misc_feature (1)..(176): Bit score of 364.7 for HMM based on sequences of FIGURE 11 of USSN 12/922,143.
  misc_feature (46)..(70): Pfam Name: zf-LSD1 Pfam Description: LSD1 zinc finger
  misc_feature (1)..(176): Functional Homolog Of Ceres SEEDLINE ID no. ME03047
MGSQLVCNGCRNILVYPRGATNVCCALCNTVTSVPPPGMDMSQLYCGGCTTLLMYTRGATSVRCSCCHTINLVPVLESNQVIHCTNCRTTLMYPYGASSVKCAICRYITNVSMTNGRLPIPVQRPNGTANSGTVSSTSSSMPHSQSQTVVVENPMSVDSSGKLVSNVVVGVTTEKK

SEQ ID NO: 3735 - DNA, 933 bp, Glycine max
  misc_feature (1)..(933): useful for making plants with increased salt and oxidative stress resistance as described in USSN 12/922,143
  misc_feature (1)..(933): Ceres CLONE ID no.513085
aaaatcaaaatattgaaaagccgcgagggaggtttcgtttcgtttcgttcagttcacacattctattctctatcgattcctcttccctttttctcaatccactacaccacagttatgaggagccaacttgtgtgtaatgggtgtaggagcatcttggtttaccctagaggagcaaccaatgtttgctgtgcgttgtgcaacaccattacctctgttcctcctcctggaatggacatgtcacaactctattgtggaggctgtacgacattgctaatgtacacacgtggtgctacaagtgtgagatgttcctgctgtcacactattaaccttgtaccagaatctaatcaagtcattcattgtgcgaactgccggacaacactcatgtatccttatggagcttcctcagtcaaatgtgcaatttgttgctatattactaatatcagtatgaccaatggaaggctttcaattcctgtacagagaccaaatggaacagccaactctggaacagtatcttcaacttcatcgtcaatgccttattctcagagccaaactgtcgtagtagaaaatcctatgtctgttgattcgagtgggaaattggtgaggaatgtcgttgtgggcgttacaacagataagaaatgatacttgccacatgaaaatgttacacaagtgtaaagggaacatcatttgactcgtcaactgctggtgcttgaaaatattgttcgtgtatatgaaattgcagcttataagttaaagatatttttgttctaaatgagatttagactgatttaatttacatatatgtatacgaggaccagtggaaagggcacacaacttgtcatttattgaattgccaaggtcctctttttgctgcagttgtatcacagggtttttcgcatctcgaattacaagtcctagatgcacatttgattcctc

SEQ ID NO: 3736 - protein, 174 aa, Glycine max
  misc_feature (1)..(174): useful for making plants with increased salt and oxidative stress resistance as described in USSN 12/922,143
  misc_feature (1)..(174): Ceres CLONE ID no.513085
  misc_feature (1)..(174): Bit score of 355.4 for HMM based on sequences of FIGURE 11 of USSN 12/922,143.
  misc_feature (46)..(70): Pfam Name: zf-LSD1 Pfam Description: LSD1 zinc finger
  misc_feature (1)..(174): Functional Homolog Of Ceres SEEDLINE ID no. ME03047
MRSQLVCNGCRSILVYPRGATNVCCALCNTITSVPPPGMDMSQLYCGGCTTLLMYTRGATSVRCSCCHTINLVPESNQVIHCANCRTTLMYPYGASSVKCAICCYITNISMTNGRLSIPVQRPNGTANSGTVSSTSSSMPYSQSQTVVVENPMSVDSSGKLVRNVVVGVTTDKK

SEQ ID NO: 3737 - DNA, 936 bp, Gossypium hirsutum
  misc_feature (1)..(936): useful for making plants with increased salt and oxidative stress resistance as described in USSN 12/922,143
  misc_feature (1)..(936): Ceres CLONE ID no.1854266
aaaaaggaaaagaaaagggagcatattttcgaatttcgcggatctcatcgcatcgtattttgcaaaaatatcacagcatctaatttccttttgaataacatattaataatttatttttcttatattcaattcctccgccttcttcaaggaattttaactctcaattcgatagctcatcaaagaattggaattggttcctagttgaaggtggtgaaatcggatatgcatagccagcttatctgtactgggtgtcggagcattcttctttatcctagaggtgctaccagtgtttgctgtgcattatgcaatacaattactccccctgggatggaaatggctcaactcatatgtggaggttgtcgaacattgctaatgtatacacgtggagcagcaagtataagatgctcttgctgtcacaccattaatgttgcaccagcatccaaccagatttctcacatcacttgcgggcactgccgtacaactttaatgtatccatatggagctccatcagtcaaatgtgctgtctgtcaatatgttactaatgttggtatgggcaatgtaagggttccccttcccgtaaacagacctaatgggaaagctgccacagggtctatggctacgccatctgcttcgccaagccaaactgttgttgttgagaaccccatgtctgttgacgagagtgggaaattggtgagcaatgtcgtggttggcataacaactggcaaaaaatgaataatccagtgtggtacttgagtttgattgttgaggaattgattgtgtatatcaagttgaaactggcaaaaccattagcattgtattcgaagggataatgtgtgatgtacatctattagtgtacgaattgatggagatggaaagtctcatttatatgatttttaaagtgaaattaataataccgaatgtgtactttcatcttac

SEQ ID NO: 3738 - protein, 169 aa, Gossypium hirsutum
  misc_feature (1)..(169): useful for making plants with increased salt and oxidative stress resistance as described in USSN 12/922,143
  misc_feature (1)..(169): Ceres CLONE ID no.1854266
  misc_feature (1)..(169): Bit score of 349.8 for HMM based on sequences of FIGURE 11 of USSN 12/922,143.
  misc_feature (81)..(105): Pfam Name: zf-LSD1 Pfam Description: LSD1 zinc finger
  misc_feature (1)..(169): Functional Homolog Of Ceres SEEDLINE ID no. ME03047
MHSQLICTGCRSILLYPRGATSVCCALCNTITPPGMEMAQLICGGCRTLLMYTRGAASIRCSCCHTINVAPASNQISHITCGHCRTTLMYPYGAPSVKCAVCQYVTNVGMGNVRVPLPVNRPNGKAATGSMATPSASPSQTVVVENPMSVDESGKLVSNVVVGITTGKK

SEQ ID NO: 3739 - protein, 169 aa, Gossypium hirsutum
  misc_feature (1)..(169): useful for making plants with increased salt and oxidative stress resistance as described in USSN 12/922,143
  misc_feature (1)..(169): CERES CLONE ID no.100010372
  misc_feature (1)..(169): Bit score of 342.7 for HMM based on sequences of FIGURE 11 of USSN 12/922,143.
  misc_feature (81)..(105): Pfam Name: zf-LSD1 Pfam Description: LSD1 zinc finger
  misc_feature (1)..(169): Functional Homolog Of Ceres SEEDLINE ID no. ME03047
MQSQLICSGCRSILLYPRGATSVCCSLCNTITPPVMEMAQLICGGCRTLLMYTRGAASIRCSCCHTINVAPASNQISHITCGHCRTTLMYPYGAPSVKCAVCQYVTNVGMGNVRVPLPVNRPNGKAATGSMATQSASPSQTVVVENPMSVDESGKLLSNVVVGITTGKQ

SEQ ID NO: 3740 - DNA, 843 bp, Gossypium hirsutum
  misc_feature (1)..(843): useful for making plants with increased salt and oxidative stress resistance as described in USSN 12/922,143
  misc_feature (1)..(843): Ceres CLONE ID no.1932709
attgaagagaggaaaaacgtaaatttacaggattcctaatttacgcggatctcatcatatttgtaaatttcccccttttcagaacatttttcttttcccctgatttcaacctatccgccttcttcaaggagctttaagtctcaagtcgtttgctccttgaaagatcggaattggtttcttgttgaaggaggtgaattcggatatgcagagcgaggtcgtttgtagtcggtgtaggaacattcttctttatcctagaggggctacaaatgtgtgctgtgcattgtgcaatacaattacccaagtccctcctcctggaatggaaatggctcaactcgtatgtggagggtgtcgaacattgctaatgtatacatgtggagcaacaagtgtaagatgctcttgctgtaacatcattaaccatgtgacagcatccaacccgatggctcacatcaactgcgggcactgccgtacaacactgatgtatccatatggagctccatcagtcaaatgtgctgtctgtcattatgttactaatgttggtacgggtaatgtaaggtgtccacttccggcaagcagaccgaatgccacagggactatgccatctacttcaacaagccaaacagtagtagttgagaatcccatgtcagttgatgagagtggcaaattggtgagcaatgtggtggttggcataacaacagacaaaaaatgatccaatgctgctttttttcttttctttgttctttttttggatttcattggaggagaatgcaaacaaacatggttatgaatgcagcgccattagtggtgtatattatattgaaaatggaaatcataaacactttgttc

SEQ ID NO: 3741 - protein, 167 aa, Gossypium hirsutum
  misc_feature (1)..(167): useful for making plants with increased salt and oxidative stress resistance as described in USSN 12/922,143
  misc_feature (1)..(167): Ceres CLONE ID no.1932709
  misc_feature (1)..(167): Bit score of 376.6 for HMM based on sequences of FIGURE 11 of USSN 12/922,143.
  misc_feature (84)..(108): Pfam Name: zf-LSD1 Pfam Description: LSD1 zinc finger
  misc_feature (1)..(167): Functional Homolog Of Ceres SEEDLINE ID no. ME03047
MQSEVVCSRCRNILLYPRGATNVCCALCNTITQVPPPGMEMAQLVCGGCRTLLMYTCGATSVRCSCCNIINHVTASNPMAHINCGHCRTTLMYPYGAPSVKCAVCHYVTNVGTGNVRCPLPASRPNATGTMPSTSTSQTVVVENPMSVDESGKLVSNVVVGITTDKK

SEQ ID NO: 3742 - DNA, 525 bp, Populus balsamifera subsp. trichocarpa
  misc_feature (1)..(525): useful for making plants with increased salt and oxidative stress resistance as described in USSN 12/922,143
  misc_feature (1)..(525): Ceres ANNOT ID no.1494788
atgcaaagccaggtggtgtgtagagggtgtgcaagtgtattgttatatccaagtggagcttctaacgtttgttgtgctttatgtagtactgttacttccattccttctcctgggatggacatggctcaactcatatgtagaggttgcaggtcattgctaatgtatccacatggggcaacaactgtgagatgctcctgctgccacgtagtgaacattgcaccaggatataaccaggccgctcatgtcaactgtgggaactgccggactgctcttatgtatccaaatggatctccatctgtcaagtgtcctgtctgtcactatgttactaatgttagtatggctaacatgagaattccgcttccagcaaacagacctaatggtataggtggaacagcaccatctacttcaatgccattgccccattctcagactcaaactgtcgttgtggaaaaccccatgtctgttgatgaaagtggcaaattggtcagcaatgttgttgtcggtgtcactacagaaaaaaaataa

SEQ ID NO: 3743 - protein, 174 aa, Populus balsamifera subsp. trichocarpa
  misc_feature (1)..(174): useful for making plants with increased salt and oxidative stress resistance as described in USSN 12/922,143
  misc_feature (1)..(174): Ceres ANNOT ID no.1494788
  misc_feature (1)..(174): Bit score of 394.6 for HMM based on sequences of FIGURE 11 of USSN 12/922,143.
  misc_feature (46)..(70): Pfam Name: zf-LSD1 Pfam Description: LSD1 zinc finger
  misc_feature (1)..(174): Functional Homolog Of Ceres SEEDLINE ID no. ME03047
MQSQVVCRGCASVLLYPSGASNVCCALCSTVTSIPSPGMDMAQLICRGCRSLLMYPHGATTVRCSCCHVVNIAPGYNQAAHVNCGNCRTALMYPNGSPSVKCPVCHYVTNVSMANMRIPLPANRPNGIGGTAPSTSMPLPHSQTQTVVVENPMSVDESGKLVSNVVVGVTTEKK

SEQ ID NO: 3744 - protein, 172 aa, Oryza sativa subsp. japonica
  misc_feature (1)..(172): useful for making plants with increased salt and oxidative stress resistance as described in USSN 12/922,143
  misc_feature (1)..(172): Public GI ID no.115489526
  misc_feature (1)..(172): Bit score of 381.7 for HMM based on sequences of FIGURE 11 of USSN 12/922,143.
  misc_feature (85)..(109): Pfam Name: zf-LSD1 Pfam Description: LSD1 zinc finger
  misc_feature (1)..(172): Functional Homolog Of Ceres SEEDLINE ID no. ME03047
MQSQIVCHGCRNILLYPRGAPSVCCAVCHAVSSTAPSPGMDIAHLICGGCRTLLMYTRNATSVRCSCCDTVNLVRPVSSIAHLNCGQCQTVLMYPYGAPSVKCAICNFITNTGMNTMRHLPPNGTSYTAPSTSAPTTQSQNVTVVVENPMTVDAKGKLVSNVVVGVTTGGKK

SEQ ID NO: 3745 - protein, 186 aa, Oryza sativa subsp. japonica
  misc_feature (1)..(186): useful for making plants with increased salt and oxidative stress resistance as described in USSN 12/922,143
  misc_feature (1)..(186): Public GI ID no.115454273
  misc_feature (1)..(186): Bit score of 339.7 for HMM based on sequences of FIGURE 11 of USSN 12/922,143.
  misc_feature (86)..(110): Pfam Name: zf-LSD1 Pfam Description: LSD1 zinc finger
  misc_feature (1)..(186): Functional Homolog Of Ceres SEEDLINE ID no. ME03047
MQSQIVCHGCRSVLRYPSGAPSVCCALCQAITTVPPPAPVMEMAHLICGGCRTLLMYTRNADTVRCSCCSTVNLVRPVNNIAHVSCGQCRTTLMYPYGAPSVKCAICHYITNTGMNTVAPTPSPMPTSSGSSYNAPPSGSSYNAPPPTSAPTSRPQNVTVVVENPMTVDEKGKLVSNVVVGVTTGK

SEQ ID NO: 3746 - DNA, 1142 bp, Triticum aestivum
  misc_feature (1)..(1142): useful for making plants with increased salt and oxidative stress resistance as described in USSN 12/922,143
  misc_feature (1)..(1142): Ceres CLONE ID no.579413
gtcaataagtttttctccgccattttccccgtcctccgcgagaagcgcctcgaggtccccgtgtgcggctagctagatcggtggcgcctcccctccctcctcccccgcggaaggcgctcgcccccttcattcccggaaccgattctcgcaagggattcctcgctgctcggctcttcttgaggcatgcagagccagatcgtgtgccatgggtgcaggagcgttctactctaccccagaggggcccccagcgtgtgctgcgccgtgtgccacgccgtcaccagcgcgccgcctccaggaatggagatggctcagcttatatgcgtcggctgtcgaactttattgatgtatactcgcaatgcaactactgtcagatgctcatgttgtgatacagtcaaccttgccagaccagcaccgccagtgaatagtatagctcatgtgaactgtggccagtgccagacggtgttaatgtatccatacggagcatcttctgtcaaatgtgctatctgcaattttattacgaacatcggaatgaacaccgtgagacctttgccacctacaatgcatgcaccaaacggaatttcatatagtgtcccatcgacctctgcgccatccgctcaatcgcagaatgtaacggtggtcgtcgaaaacccaatgacagtagatgacaagggaaaattggtgagcaacgtcgtagtcggggttacgtccggcgggaaaaagtagcaaaacatgtcagcgcttgtaccaagtgatgccctgttctgtgtcttataatctggagttgggaacactttgtattatactcgtgtctggtgatcgaccgatcggtcgcatagaagaaaaccccgaagcgcgtaaacggactgcgccaacaaaaaaagagagtgcgggtgtggataatacggaaaaaaactgtattttgcttaccccctagattcttttgtatgtaaaatgtgggcactgtcagacctcactgcgtgatcaaatcctctctgtcctgtcctgtgtcctgtcctggaggggcctctcgttctggatgaataacagcaaataactttgcatatggctggccccacctgtcaatgattggtaattaaacgactgtaattattgtgatgaataattctttgaaggctgtatat

SEQ ID NO: 3747 - protein, 179 aa, Triticum aestivum
  misc_feature (1)..(179): useful for making plants with increased salt and oxidative stress resistance as described in USSN 12/922,143
  misc_feature (1)..(179): Ceres CLONE ID no.579413
  misc_feature (1)..(179): Bit score of 386.7 for HMM based on sequences of FIGURE 11 of USSN 12/922,143.
  misc_feature (87)..(111): Pfam Name: zf-LSD1 Pfam Description: LSD1 zinc finger
  misc_feature (1)..(179): Functional Homolog Of Ceres SEEDLINE ID no. ME03047
MQSQIVCHGCRSVLLYPRGAPSVCCAVCHAVTSAPPPGMEMAQLICVGCRTLLMYTRNATTVRCSCCDTVNLARPAPPVNSIAHVNCGQCQTVLMYPYGASSVKCAICNFITNIGMNTVRPLPPTMHAPNGISYSVPSTSAPSAQSQNVTVVVENPMTVDDKGKLVSNVVVGVTSGGKK

SEQ ID NO: 3748 - DNA, 1040 bp, Panicum virgatum
  misc_feature (1)..(1040): useful for making plants with increased salt and oxidative stress resistance as described in USSN 12/922,143
  misc_feature (1)..(1040): Ceres CLONE ID no.1874905
gccccagacaaatccaatccggaaccgactcccccctcgcttcgccggggagaggagggacgagcgacgccgcgcccgtccgcgtccgcgtccgtctgcccctcccgcgccgaccacttcccggagcgcggagacgggcgggcggtcatcccgctcaaaaacgccgcaggtatgcagagccagatcgtgtgccacgcgtgccggaccgttctgctctacccgcggggggcgcccagcgtctgctgcgcggtgtgccaggccgtcaccaccgtgccgccaccaggactagagatggctcagcttatatgtggtggttgtcgaactttgctgatgtatactcgaagtgcagacaccgtaaggtgttcatgttgcaatacagtcaatcttgttagaccagtgaataatatagctcatgttaactgcggccactgccagacaactttgatgtatccatatggagcacattcagtaaaatgtgccatatgcaatcatatcactaccactggagtaaatacggtggcacccacaccgtctgcaaggccagcatcaaatggatcttcatatagtacctcatctacttctgctcctaaatctcagccccagaatgtaactgttgttgttgagaaccctatgacagtagatgataagggaaaactagtgagcaacgttgtagttggagtcacaactgggaaaaactgatgtgctatctacatcattgttgtgtgttctatatcagaagctaggaaatattatgggtcacagtgctatcgagtggctggttgcatggtcgcccttgaccaaagatgcaccaaatgtttcttgtatcttgcaaggaaaccatgaaggtcaaaagctgtgttttgaatctattgattcttttgtgtgtataagagctcttttagacttcagtgtgtgatcagatagtagaggtgactgatagtatagtttcattatacatgcatatgtacacactttgtttgttagtttgtgctgtcttgttcataattttttgctggtatacacgcgctatgctcgtttcg

SEQ ID NO: 3749 - protein, 175 aa, Panicum virgatum
  misc_feature (1)..(175): useful for making plants with increased salt and oxidative stress resistance as described in USSN 12/922,143
  misc_feature (1)..(175): Ceres CLONE ID no.1874905
  misc_feature (1)..(175): Bit score of 375.1 for HMM based on sequences of FIGURE 11 of USSN 12/922,143.
  misc_feature (84)..(108): Pfam Name: zf-LSD1 Pfam Description: LSD1 zinc finger
  misc_feature (1)..(175): Functional Homolog Of Ceres SEEDLINE ID no. ME03047
MQSQIVCHACRTVLLYPRGAPSVCCAVCQAVTTVPPPGLEMAQLICGGCRTLLMYTRSADTVRCSCCNTVNLVRPVNNIAHVNCGHCQTTLMYPYGAHSVKCAICNHITTTGVNTVAPTPSARPASNGSSYSTSSTSAPKSQPQNVTVVVENPMTVDDKGKLVSNVVVGVTTGKN

SEQ ID NO: 3750 - DNA, 1000 bp, Zea mays
  misc_feature (1)..(1000): useful for making plants with increased salt and oxidative stress resistance as described in USSN 12/922,143
  misc_feature (1)..(1000): Ceres CLONE ID no.895962
accgcagcgtctcgactggtcccctccttcctcttctcttcctcttcctctcacatcccggacaaatccaatccgaaatcatctccccctcgcctcgcctagaagaggaaggaagaacagagataagcgacaacgcgtccctcctcgccttcctcccgcctcgagctcttcccggagcaaccggagccacagacgtcaggacagcctagcgcgttccacgccggtatgcagaaccagatcatgtgccatgcttgccggacccttctgctctacccgcgtggcgcgtccagcgtctgctgcgcggtttgccaggccatcaccaccgtgccgccaccaggattggagatggctcagcttatatgtggtggctgtcgaactttgctgatgtatactcgcagtgcagacaccgtaaggtgttcatgttgcaacacagtgaaccttgttagaccagtgaataatatagctcatgtgaactgcggccagtgccggacaactttgatgtatccatacggcgcaccttcagtaaaatgtgccgtatgcaattatgtcacagctactggagtaaatactgtggcacccaccccatctgcgaggccaacatcagatgggtcttcatatagtggctcatctacttctgctcctaaatctcaatctcagaatgtaactgttgttgttgagaaccctatgacagttgatgacaagggaaaacttgtcagcagcgttgtagttggagtcacagctgggaaagagtgattttattgacacttcgtacatcattgttgtgttttctatacacgaagttggaaaataccatgtagcatccaatgatgggttgcttggacttccttgaagaacagagatacaccacgaaatatttgtaggaccttcctaatgaaaccatggtcggacgttgtgtattgattcttttgtgtgtataatatgagctccgttagacttgtgtaatcagatatttgggggaaatacagcatagtttcgctgt

SEQ ID NO: 3751 - protein, 175 aa, Zea mays
  misc_feature (1)..(175): useful for making plants with increased salt and oxidative stress resistance as described in USSN 12/922,143
  misc_feature (1)..(175): Ceres CLONE ID no.895962
  misc_feature (1)..(175): Bit score of 362.4 for HMM based on sequences of FIGURE 11 of USSN 12/922,143.
  misc_feature (84)..(108): Pfam Name: zf-LSD1 Pfam Description: LSD1 zinc finger
  misc_feature (1)..(175): Functional Homolog Of Ceres SEEDLINE ID no. ME03047
MQNQIMCHACRTLLLYPRGASSVCCAVCQAITTVPPPGLEMAQLICGGCRTLLMYTRSADTVRCSCCNTVNLVRPVNNIAHVNCGQCRTTLMYPYGAPSVKCAVCNYVTATGVNTVAPTPSARPTSDGSSYSGSSTSAPKSQSQNVTVVVENPMTVDDKGKLVSSVVVGVTAGKE

SEQ ID NO: 3752 - DNA, 471 bp, Populus balsamifera subsp. trichocarpa
  misc_feature (1)..(471): useful for making plants with increased salt and oxidative stress resistance as described in USSN 12/922,143
  misc_feature (1)..(471): Ceres ANNOT ID no.1467173
atgcagagccaggtggtgtgtagagggtgtagaagtttattgttatatccaagtggagctactaatgtttgttgtgctttatgtagtaccgttacctctattcctgctcctgggatggacttggctcaactcatatgtcgaggttgcaggacattgctaatgtatgcacggggggcaacaactgtgagatgctcctgctgccacatagtgaactttgcaccaggacctaaccaggttgctcatgtcaactgtgggaactgccagactacacttatgtatccgaatggtgctccatctgtcaagtgtgcggtctgtcactatgttactaacattagtacggctaatgtgagagttccgcttccagcaaacagacctagtggtataggtggaacaatgccgtctacttcaacaactcaaactgtcgttgtggaaaaccctatgtctgttgatgaaagtggcaaattggtataa

SEQ ID NO: 3753 - protein, 156 aa, Populus balsamifera subsp. trichocarpa
  misc_feature (1)..(156): useful for making plants with increased salt and oxidative stress resistance as described in USSN 12/922,143
  misc_feature (1)..(156): Ceres ANNOT ID no.1467173
  misc_feature (1)..(156): Bit score of 318.6 for HMM based on sequences of FIGURE 11 of USSN 12/922,143.
  misc_feature (84)..(108): Pfam Name: zf-LSD1 Pfam Description: LSD1 zinc finger
  misc_feature (1)..(156): Functional Homolog Of Ceres SEEDLINE ID no. ME03047
MQSQVVCRGCRSLLLYPSGATNVCCALCSTVTSIPAPGMDLAQLICRGCRTLLMYARGATTVRCSCCHIVNFAPGPNQVAHVNCGNCQTTLMYPNGAPSVKCAVCHYVTNISTANVRVPLPANRPSGIGGTMPSTSTTQTVVVENPMSVDESGKLV

SEQ ID NO: 3754 - DNA, 1059 bp, Zea mays
  misc_feature (1)..(1059): useful for making plants with increased salt and oxidative stress resistance as described in USSN 12/922,143
  misc_feature (1)..(1059): Ceres CLONE ID no.1447813
ctcaacctctcgtccggccgtgttgacctgaccgaataaccacccgtctgccgctgtgccgcaccccgcacgagacccgtccttgaggggcacgtcctagatcggtggcgcctgcctctcgccgccgatacggtgcctctcgcggtctcgctccccctcgcaggtcttttggtttttttagttcctccctttgcttcttggaggtgtttgttgccgtctcacccgcagttcttgagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaagtgacggcatatcacaacccgtatagctttgtccaaactatctaaaaagggtttaagaatacataccttgtatcatactgctgtttggcgatcggctgctcgacggaggaatccccctccctggagagcgtagtggcaaggcagcgctgctttcgccactgcgatcgtgctagaacgagccaaaaaaaaaaacgaagtgcgggtgtgcatactcagagtatatctgtagcttgttaccccttgattcttttgtatgtaatatgggctctgcctgactttcactgtgtg

SEQ ID NO: 3755 - protein, 178 aa, Zea mays
  misc_feature (1)..(178): useful for making plants with increased salt and oxidative stress resistance as described in USSN 12/922,143
  misc_feature (1)..(178): Ceres CLONE ID no.1447813
  misc_feature (1)..(178): Bit score of 346.7 for HMM based on sequences of FIGURE 11 of USSN 12/922,143.
  misc_feature (84)..(108): Pfam Name: zf-LSD1 Pfam Description: LSD1 zinc finger
  misc_feature (1)..(178): Functional Homolog Of Ceres SEEDLINE ID no. ME03047
MQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 3756 - DNA, 1632 bp, Zea mays
  misc_feature (1)..(1632): useful for making plants with increased salt and oxidative stress resistance as described in USSN 12/922,143
  misc_feature (1)..(1632): Ceres CLONE ID no.382659
gaccgaataaccacccgtctgccgctgtgccgcacggcccgcaccccgcacgagacccgtccttgaggggcacgtcctagatcggtggcgccttcctctcgccgccgatacggtgcctctcgcggtctcgctccccctcgcaggtcttttggtttttttagttcctccctttgcttcttggaggtgtttgttgccgtctcacccgcagttcttgaggtacgcacgcagtaatccggcttctttctatgttccgatgtcttgctggttggatgaggagggtacgacgctctgtggagagatctaatcgcgctggtaaactggggcgatcggtgtgggggaatcggatagcgtggatgggatttgggattggaagagaagctggaggatgccttttttctggatgacggtgataatcgtggacgagctaagctcattgagtgtctggctgatgtgggattgggtggcatatgctggattgctaactgttccatctggtgcaccaagaattggactgcactggggttgggattgggattgggatgggattgctttgcctttgattgtgtatatgcttattatgtgctcatccgctgtggctttggccggaactttgcagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactacctgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtaggggttacgagcggcgggaaaaagtgacggcatatcacaaccgtgtgtagctttgtccaaactatctaaaaagggtttaagaatacataccttgtatcatactgctgtttggcgatcggctgctcgacggaggaatccccctccctggagagcgtagtggcaaagcagcgaggctttcgccactgcgaacgagccaaaaaaaaacgaagtgcgggtgtgcatactcagagtatatctgtagcttgttaccccttgattcttttgtatgtaatatgggctctgcctgactttcactgtgtgatcaaatttccaagcccgtgggcgctgttgctgcgtgccttgttattagtgaataacaaacattgcaaatggctcttgaaatacagtgtgtgtgtgttttaatctctctgcatttatgttaatcagcaggtgccaccatttgctgttccagactgataatgcagagtttgtatccacgttctttggagaaaacatttgaggcgc

SEQ ID NO: 3757 - protein, 178 aa, Zea mays
  misc_feature (1)..(178): useful for making plants with increased salt and oxidative stress resistance as described in USSN 12/922,143
  misc_feature (1)..(178): Ceres CLONE ID no.382659
  misc_feature (1)..(178): Bit score of 347.4 for HMM based on sequences of FIGURE 11 of USSN 12/922,143.
  misc_feature (84)..(108): Pfam Name: zf-LSD1 Pfam Description: LSD1 zinc finger
  misc_feature (1)..(178): Functional Homolog Of Ceres SEEDLINE ID no. ME03047
MQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALPASSGTSYIIPSISVPTNQPRNVTVVVENPMTVDDKGKLVSNVVVGVTSGGKK

SEQ ID NO: 3758 - protein, 199 aa, Oryza sativa subsp. japonica
  misc_feature (1)..(199): useful for making plants with increased salt and oxidative stress resistance as described in USSN 12/922,143
  misc_feature (1)..(199): Public GI ID no.125580039
  misc_feature (1)..(199): Bit score of 375.5 for HMM based on sequences of FIGURE 11 of USSN 12/922,143.
  misc_feature (112)..(136): Pfam Name: zf-LSD1 Pfam Description: LSD1 zinc finger
  misc_feature (1)..(199): Functional Homolog Of Ceres SEEDLINE ID no. ME03047
MQSQIVCHGCRNILLYPRGAPSVCCAVCHAVSSTAPSPGCKHWPEFAGSAEGLGQHDFIRIGGFTGMDIAHLICGGCRTLLMYTRNATSVRCSCCDTVNLVRPVSSIAHLNCGQCQTVLMYPYGAPSVKCAICNFITNTGMNTMRHLPPNGTSYTAPSTSAPTTQSQNVTVVVENPMTVDAKGKLVSNVVVGVTTGGKK

SEQ ID NO: 3759 - protein, 207 aa, Zea mays
  misc_feature (1)..(207): useful for making plants with increased salt and oxidative stress resistance as described in USSN 12/922,143
  misc_feature (1)..(207): CERES CLONE ID no.100870568
  misc_feature (1)..(207): Bit score of 319.5 for HMM based on sequences of FIGURE 11 of USSN 12/922,143.
  misc_feature (99)..(123): Pfam Name: zf-LSD1 Pfam Description: LSD1 zinc finger
  misc_feature (1)..(207): Functional Homolog Of Ceres SEEDLINE ID no. ME03047
  misc_feature (162)..(162): Xaa is any aa, unknown or other
  misc_feature (166)..(166): Xaa is any aa, unknown or other
  misc_feature (172)..(172): Xaa is any aa, unknown or other
  misc_feature (173)..(173): Xaa is any aa, unknown or other
  misc_feature (175)..(175): Xaa is any aa, unknown or other
  misc_feature (181)..(181): Xaa is any aa, unknown or other
  misc_feature (184)..(184): Xaa is any aa, unknown or other
  misc_feature (185)..(185): Xaa is any aa, unknown or other
  misc_feature (189)..(189): Xaa is any aa, unknown or other
  misc_feature (190)..(190): Xaa is any aa, unknown or other
  misc_feature (195)..(195): Xaa is any aa, unknown or other
  misc_feature (197)..(197): Xaa is any aa, unknown or other
  misc_feature (198)..(198): Xaa is any aa, unknown or other
  misc_feature (199)..(199): Xaa is any aa, unknown or other
MRRVRRSVERSNRADMQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRXVTVXVENPMXXDXKGKLVXNVXXGVTXXGEKVXAXXXPYSFVQTF

SEQ ID NO: 3760 - DNA, 756 bp, Populus balsamifera subsp. trichocarpa
  misc_feature (1)..(756): useful for making plants with increased salt and oxidative stress resistance as described in USSN 12/922,143
  misc_feature (1)..(756): Ceres ANNOT ID no.1441897
atgagaattcataccgttgacagagaggaagaggaagatagacagagagagatgcaaagccaggtggtgtgtagagggtgtgcaagtgtattgttatatccaagtggagcttctaacgtttgttgtgctttatgtagtactgttacttccattccttctcctggagatggttgttttgaagaattgttgatcgaaaagagtttcgtcgaagttgttgcacttaatgtagtttgccacagtgtggcggacaaattggattgtttctgcatggtggagtgccatctaagatccgccatggatttgagaataggaatgcataatcctgggatggacatggctcaactcatatgtagaggttgcaggtcattgctaatgtatccacatggggcaacaactgtgagatgctcctgctgccacgtagtgaacattgcaccaggatataaccaggccgctcatgtcaactgtgggaactgccggactgctcttatgtatccaaatggatctccatctgtcaagtgtcctgtctgtcactatgttactaatgttagtatggctaacatgagaattccgcttccagcaaacagacctaatggtataggtggaacagcaccatctacttcaatgccattgccccattctcagactcaaactgtcgttgtggaaaaccccatgtctgttgatgaaagtggcaaattgggacaatatgcgtatttgtacttctggaaccctagattcttgaagataaattctgtataa

SEQ ID NO: 3761 - protein, 234 aa, Populus balsamifera subsp. trichocarpa
  misc_feature (1)..(234): useful for making plants with increased salt and oxidative stress resistance as described in USSN 12/922,143
  misc_feature (1)..(234): Ceres ANNOT ID no.1441897
  misc_feature (1)..(234): Bit score of 325.7 for HMM based on sequences of FIGURE 11 of USSN 12/922,143.
  misc_feature (100)..(124): Pfam Name: zf-LSD1 Pfam Description: LSD1 zinc finger
  misc_feature (1)..(234): Functional Homolog Of Ceres SEEDLINE ID no. ME03047
MQSQVVCRGCASVLLYPSGASNVCCALCSTVTSIPSPGDGCFEELLIEKSFVEVVALNVVCHSVADKLDCFCMVECHLRSAMDLRIGMHNPGMDMAQLICRGCRSLLMYPHGATTVRCSCCHVVNIAPGYNQAAHVNCGNCRTALMYPNGSPSVKCPVCHYVTNVSMANMRIPLPANRPNGIGGTAPSTSMPLPHSQTQTVVVENPMSVDESGKLGQYAYLYFWNPRFLKINSV

SEQ ID NO: 3762 - protein, 154 aa, Arabidopsis thaliana; identical to SEQ ID NO: 3644
  misc_feature (1)..(154): useful for making plants with increased salt and oxidative stress resistance as described in USSN 12/922,143
  misc_feature (1)..(154): Public GI ID no.18398482
  misc_feature (1)..(154): Bit score of 155.7 for HMM based on sequences of FIGURE 11 of USSN 12/922,143.
  misc_feature (114)..(138): Pfam Name: zf-LSD1 Pfam Description: LSD1 zinc finger
  misc_feature (1)..(154): Functional Homolog Of Ceres SEEDLINE ID no. ME03047

SEQ ID NO: 3763 - DNA, 1220 bp, Arabidopsis thaliana
  misc_feature (1)..(1220): useful for making plants with increased salt and oxidative stress resistance as described in USSN 12/922,143
  misc_feature (1)..(1220): Ceres CLONE ID no.26652
  misc_feature (1168)..(1168): k is g or t/u
aaacacacacatatacacccaaacgttatgtaactgcaaaaaaaatatcgaaacgagattctacaattagtctctagtcaaagagcttcatggcaatggtgtgaccccaaagttagtcttcacatgtttcttaagtttcaaacattgaatttttttccttttataaatagttaagacttatcttcattttctaaaatagtcaagatttatattcctcttaaaaaataatttatttccttcctaagaagaattattagatttattttctttgctagtatagattgatgaaagtgaggaaatgggagaagaaatgaagaacacaggatgtgtcttcttcttctaagtcactaacaaaatcaacaaagaggagaagccattattatataatagagagattgagagaagagatttatccaaaaaaatattgcaattcttcttggagtgaataatgccagtccctcttgcaccatatccaacacctccggcaccggcactggctccgtcgtacaacactcctccggcaaatggaagtacaagtgggcagagccagttagtgtgttcaggttgcagaaaccttctgatgtatcccgtcggagcaacctccgtctgttgcgccgtctgtaacgccgtcacggccgttcctccgcccggaacggagatggcacagttggtatgtggaggatgtcatacactcttaatgtacattcgtggagctacaagtgttcaatgttcttgttgtcacactgttaatctcgccctcgaagcaaaccaagtagcgcatgtgaattgcggaaactgcatgatgctactaatgtatcaatatggagcaagatcagtgaaatgtgccgtttgtaactttgtcacatctgttgggggttcaacgagcacgactgattcgaagtttaacaattaaaacttggatctatctacctatcaatacatattgagttatgagcaatatagaggaagcatcaaatctttttcactctctcttcgatcaagaatccggcagtgatgagtttgaaaccattttcggaagtaaatgaaatatgtaattcgtcgaaatttctgactttggtctctttgtccgtttgtatagagctatctctcttctttggtttttgttttgttctcttaagaaaaatttgattccccagtttgtaagagkgattcagaaatcaaagctagactttttatgcatgaaaaaaatagattgtttt

SEQ ID NO: 3764 - protein, 154 aa, Arabidopsis thaliana
  misc_feature (1)..(154): useful for making plants with increased salt and oxidative stress resistance as described in USSN 12/922,143
  misc_feature (1)..(154): Ceres CLONE ID no.26652
  misc_feature (1)..(154): Bit score of 154.2 for HMM based on sequences of FIGURE 11 of USSN 12/922,143.
  misc_feature (114)..(138): Pfam Name: zf-LSD1 Pfam Description: LSD1 zinc finger
  misc_feature (1)..(154): Functional Homolog Of Ceres SEEDLINE ID no. ME03047
  misc_feature (147)..(147): Xaa is any aa, unknown or other
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSXTDSKFNN

SEQ ID NO: 3765 - DNA, 528 bp, Sorghum bicolor
  misc_feature (1)..(528): useful for making plants with increased salt and oxidative stress resistance as described in USSN 12/922,143
  misc_feature (1)..(528): Ceres ANNOT ID no.6033586
atgcagagccagatcgtgtgccatgcttgccggaccgttctactctacccgcgaggcgcgtccagcgtctgctgcgccgtttgccaggccatcaccaccgtgccgccaccaggactggagatggctcagcttatatgtggtggttgtcgaactttgctgatgtatactcgcagtgcagacaccgtaaggtgttcatgttgcaacacagtcaatcttgttagaccagtgaataatatagctcatgtgaactgcggccagtgccggacaactttgatgtatccgtatggcgcaccttcagtaaaatgtgccatatgcaattatgtcacgactaccggagtaaatactgtggcacccactccatctgcgaggccaacatcaaatgagtcttcatatattggctcatctacttctgctcctaaatctcaacctcagaatgtaactgttgttgttgagaaccctatgacagttgacgacaagggaaaacttgtcagcagcgttgtagttggagtcacagctgggaaagtgtga

SEQ ID NO: 3766 - protein, 175 aa, Sorghum bicolor
  misc_feature (1)..(175): useful for making plants with increased salt and oxidative stress resistance as described in USSN 12/922,143
  misc_feature (1)..(175): Ceres ANNOT ID no.6033586
  misc_feature (1)..(175): Bit score of 361.7 for HMM based on sequences of FIGURE 11 of USSN 12/922,143.
  misc_feature (84)..(108): Pfam Name: zf-LSD1 Pfam Description: LSD1 zinc finger
  misc_feature (1)..(175): Functional Homolog Of Ceres SEEDLINE ID no. ME03047
MQSQIVCHACRTVLLYPRGASSVCCAVCQAITTVPPPGLEMAQLICGGCRTLLMYTRSADTVRCSCCNTVNLVRPVNNIAHVNCGQCRTTLMYPYGAPSVKCAICNYVTTTGVNTVAPTPSARPTSNESSYIGSSTSAPKSQPQNVTVVVENPMTVDDKGKLVSSVVVGVTAGKV

SEQ ID NO: 3767 - DNA, 534 bp, Sorghum bicolor
  misc_feature (1)..(534): useful for making plants with increased salt and oxidative stress resistance as described in USSN 12/922,143
  misc_feature (1)..(534): Ceres ANNOT ID no.6074827
atgcagagccagatcgtgtgccacgggtgcaggaccgttctgctctacccaagaggtgctccgagcgtgtgttgcgcggtatgccatgcagtcaccaatgtgccgcctccagcaatagagatggctcgacttatatgtggtggttgccagacattattgatgtatactcgcagtgcaacaactgtaagatgctcatgttgtgacacagtcaatcttgtcagaccagtgagtagcatagctcatgtgaactgtggccagtgccaaacagtgttgatgtatccatatggagcaccgtctgtcaaatgtgctatttgcaacttcattacaaatgttggcggggtgactccggtgagacctttgccacctgcactacctgcatcaagtggaaattcatatagcatcccgtcaacttctgtgccaatgaatcaatcgcagaatgtaactgttgttgttgaaaacccaatgacagtagatgacaagggaaaattggtgagcaatgttgtagtaggggttacaagtggtgggaaaaagtaa

SEQ ID NO: 3768 - protein, 177 aa, Sorghum bicolor
  misc_feature (1)..(177): useful for making plants with increased salt and oxidative stress resistance as described in USSN 12/922,143
  misc_feature (1)..(177): Ceres ANNOT ID no.6074827
  misc_feature (1)..(177): Bit score of 358.9 for HMM based on sequences of FIGURE 11 of USSN 12/922,143.
  misc_feature (84)..(108): Pfam Name: zf-LSD1 Pfam Description: LSD1 zinc finger
  misc_feature (1)..(177): Functional Homolog Of Ceres SEEDLINE ID no. ME03047
MQSQIVCHGCRTVLLYPRGAPSVCCAVCHAVTNVPPPAIEMARLICGGCQTLLMYTRSATTVRCSCCDTVNLVRPVSSIAHVNCGQCQTVLMYPYGAPSVKCAICNFITNVGGVTPVRPLPPALPASSGNSYSIPSTSVPMNQSQNVTVVVENPMTVDDKGKLVSNVVVGVTSGGKK

SEQ ID NO: 3769 - DNA, 441 bp, Sorghum bicolor
  misc_feature (1)..(441): useful for making plants with increased salt and oxidative stress resistance as described in USSN 12/922,143
  misc_feature (1)..(441): Ceres ANNOT ID no.6027418
atgcatagccagttggtctgcggcggctgcaagcgtcttctccagtaccgcaggggagccaccggcgtctgctgcccaacctgcaacactttcacagccgccaacccatcaggaccggagatgtctgaactcgtctgtggcggctgcttcaccatgctggtgcactcccgcagcgccaccaacatacgctgccctcactgtagtaggctcaactccacaagatcaggaaaccaaatgggtcacctgtcatgcgggcaatgccggacaactctggcatacccaccgggagcgacgacagtcgggtgcccaacatgccgcaacattaatccagtcagggatgctcggccccagacggttctggtggagaatcctaagacactggatgaaaagggcaaactggtgagcaatgtcgccgttggtgtcacctcatggaaaagatga

SEQ ID NO: 3770 - protein, 146 aa, Sorghum bicolor
  misc_feature (1)..(146): useful for making plants with increased salt and oxidative stress resistance as described in USSN 12/922,143
  misc_feature (1)..(146): Ceres ANNOT ID no.6027418
  misc_feature (1)..(146): Bit score of 158.0 for HMM based on sequences of FIGURE 11 of USSN 12/922,143.
  misc_feature (7)..(31): Pfam Name: zf-LSD1 Pfam Description: LSD1 zinc finger
  misc_feature (1)..(146): Functional Homolog Of Ceres SEEDLINE ID no. ME03047
MHSQLVCGGCKRLLQYRRGATGVCCPTCNTFTAANPSGPEMSELVCGGCFTMLVHSRSATNIRCPHCSRLNSTRSGNQMGHLSCGQCRTTLAYPPGATTVGCPTCRNINPVRDARPQTVLVENPKTLDEKGKLVSNVAVGVTSWKR

SEQ ID NO: 3771 - DNA, 1300 bp, Arabidopsis thaliana
  misc_feature (1)..(1300): useful for making plants with increased salt and oxidative stress resistance as described in USSN 12/922,143
  misc_feature (1)..(1300): Ceres SEEDLINE ID no.ME03280
aaaaaattactaaccatataagtctcagtactctctgttctgcaaacttcatacacaaaaccaacattaagagatggcgagtcactacagaaacacaagcgctattgcttatctattgctttgtctcttcattacatctgccactgcacattccttcatacgacaaatcactgatgacctcaaaacaaatctgcagcaggaaggtaggagcagaaccaatccaaaaccctggacgtgggacattacttacaagaaaataaggagatctcatcacgtgattataaagtatcagcttcaaacgcagtgaaaggtttgagagatcgtcctccatcgtcttactctctcaagatggagtctttcaacacgctccttaagtcaacttacacggagaaatatgtatctcgtcccttttcagttggtggatacaactggacacttgttgtgttcccaaatgggaacaagaaggatagtggttcagggtacctttctctttacgtagccatagacaactcaactctcggacaacaagagatttacgcagatctaaggttttacatctttaacaagaatgagaggaagtacttcactatccaagataccgatgtgtggaagtttagtgtcttcaaaacgatgtggggattctctcaggtcctccccattgatacattcaaagatccgacaaaaggatatctctacgatggagatcactgcgagtttggtgttgatgtaaccatgccttctctctacgaaaaatcggaacttttctctgtcacagagaattttctaaatccgagattcacctggaccattcggggattctctacgctgctaaaaaacagttacctatcagaagtgttctccatcggaggaagaagttggaatatacaaatcaatccaagtggtcttggcacgggagagggaaaagctttgtcgatgtatcttggccttaatgtgaatgagatattcagaccatatgagaagatttatgttcgagccaagcttcgagctcttaaccaactcaatctcagtaacatcgaaagggaactcgatatttggtacaatggtccgggatatggagaatatagctggggtttccctgagtttatctatttcccttatctcacagattcatcaaagggtttcgttaagaacgatgtgttgatggttcaagttgaaatggaggccatttcttcaaccaagtacttcccgagttagattttctctaagcaaagaacttgtacctacctaccatgtgtttgatttgttatcaaatactaataagaatttgattatgcatttc

SEQ ID NO: 3772 - DNA, 1314 bp, Arabidopsis thaliana
  misc_feature (1)..(1314): useful for making plants with increased salt and oxidative stress resistance as described in USSN 12/922,143
  misc_feature (1)..(1314): Ceres SEEDLINE ID no.ME03280
  misc_feature (1)..(1314): Inplanta Sequence
aaaaaattactaaccatataagtctcagtactctctgttctgcaaacttcatacacaaaaccaacattaagagatggcgagtcactacagaaacacaagcgctattgcttatctattgctttgtctcttcattacatctgccactgcacattccttcatacgacaaatcactgatgacctcaaaacaaatctgcagcaggaggtaggagcaaaaccaatccaaaacctggacgtgggacattacttacaagaaaataaggagatctcatcacgtgattataaagtatcagcttcaaacgcagtgaaaggtttgagagatcgtcctccatcgtcttactctctcaagatggagtctttcaacacgctccttaagtcaacttacacggagaaatatgtatctcgtcccttttcagttggtggatacaactggacacttgttgtgttcccaaatgggaacaagaaggatagtggttcagggtacctttctctttacgtagccatagacaactcaactctcggacaacaagagatttacgcagatctaaggttttacatctttaacaagaatgagaggaagtacttcactatccaagataccgatgtgtggaagtttagtgtcttcaaaacgatgtggggattctctcaggtcctccccattgatacattcaaagatccgacaaaaggatatctctacgatggagatcactgcgagtttggtgttgatgtaaccatgccttctctctacgaaaaatcggaacttttctctgtcacagagaattttctaaatccgagattcacctggaccattcggggattctctacgctgctaaaaaacagttacctatcagaagtgttctccatcggaggaagaagttggaatatacaaatcaatccaagtggtcttggcacgggagagggaaaagctttgtcgatgtatcttggccttaatgtgaatgagatattcagaccatatgagaagatttatgttcgagccaagcttcgagctcttaaccaactcaatctcagtaacatcgaaagggaactcgatatttggtacaatggtccgggatatggagaatatagctggggtttccctgagtttatctatttcccttatctcacagattcatcaaagggtttcgttaagaacgatgtgttgatggttcaagttgaaatggaggccatttcttcaaccaagtacttcccgagttagattttctctaagcaaagaacttgtacctacctccatgtgtttgatttgttatcaaatactaataagaatttgattatgcatttcaaaaaaaaaaaaaaaaa

SEQ ID NO: 3773 - protein, 379 aa, Arabidopsis thaliana
  misc_feature (1)..(379): useful for making plants with increased salt and oxidative stress resistance as described in USSN 12/922,143
  misc_feature (1)..(379): Ceres SEEDLINE ID no.ME03280
  misc_feature (1)..(379): Bit score of 875.2 for HMM based on sequences of FIGURE 10 of USSN 12/922,143.
  misc_feature (245)..(370): Pfam Name: MATH Pfam Description: MATH domain
MASHYRNTSAIAYLLLCLFITSATAHSFIRQITDDLKTNLQQEVGAKPIQNLDVGHYLQENKEISSRDYKVSASNAVKGLRDRPPSSYSLKMESFNTLLKSTYTEKYVSRPFSVGGYNWTLVVFPNGNKKDSGSGYLSLYVAIDNSTLGQQEIYADLRFYIFNKNERKYFTIQDTDVWKFSVFKTMWGFSQVLPIDTFKDPTKGYLYDGDHCEFGVDVTMPSLYEKSELFSVTENFLNPRFTWTIRGFSTLLKNSYLSEVFSIGGRSWNIQINPSGLGTGEGKALSMYLGLNVNEIFRPYEKIYVRAKLRALNQLNLSNIERELDIWYNGPGYGEYSWGFPEFIYFPYLTDSSKGFVKNDVLMVQVEMEAISSTKYFPS

SEQ ID NO: 3774 - DNA, 1815 bp, Glycine max
  misc_feature (1)..(1815): useful for making plants with increased salt and oxidative stress resistance as described in USSN 12/922,143
  misc_feature (1)..(1815): Ceres CLONE ID no.528125
gagcaatagcaacacagcaatagcttctggtgatctcgttttctcacattgctctcttccccctttctctctcctctttctctctcttccattgcttctccataagcaacgccacgcgaggtcaattgcgccatcgccatgactgtgatgactcctgctcccattgaccagcagcaggaggacgaggagatgcttgtcccgcacacggatttggctgagaataatcaccaacccatggaagttgtggctcaacctgatgctgccaacactgtggagagtcagcctgtcgaggatccttcaacatcaaggttcacatggaaaattgacaacttttctaggatgaatacaaagaagctctattcagaaatatttgttgttggtggttataaatggcgtgtacttattttcccaaaagggaacaatgtggactatttgtccatgtatttggatgttgcagattcagctagtttaccctatggctggagtagatatgcacagtttagcttggcagttgttaatcaaatccataataaatactctgtgagaaaagacacacagcaccaattcaatgcgcgggaaagtgattggggtttcacatctttcatgccgcttggtgaattgtatgatcctagtagagggtatcttgtgaatgatactcttgtagttgaagccgaggtttttgttcgtagaattgttgattactggacttatgattcaaaaaaggagactggctatgttggacttaagaaccagggagctacatgttatatgaattctctactccaaactttgtaccatattccttattttcgaaaggctgtataccacatgccaacaacagagaatgacatgccctctggaagcatccctttggctttgcaaagtttattctacaagctccagtatagtgacaccagtgttgcaacaaaggagctcactaaatcttttggatgggatacatatgattctttcatgcagcatgatgttcaagaactgaacagagtcctctgtgaaaaacttgaagacaagatgaagggaactgttgttgagggaactatacagaagctatttgaagggcatcatatgaattatatcgaatgcatcaatgtggactataaatcaactagaaaggagtcattttatgaccttcagcttgatgtgaagggctgtcctgatgtttatgcttcctttgacaagtatgttgaagttgaacgtcttgaaggggataacaaatatcatgcggaacaatatggtttgcaggatgctaagaagggtgtcctgttcattgatttccctcctgttcttcagcttcaactgaaaagatttgaatatgactttatgcgggatactatggtcaagattaatgaccgctatgagtttcccttgcaacttgaccttgatcgtgagaatggaaaatatttatcacctgatgctgataggaatgtccgcaatctttacacacttcatagcgttttggttcatagtggtggtgtgcatggtggacattattatgcttttatcaggccgactctatctgagcagtggtataaatttgatgatgagagggtgactaaagaagacactaaacgggccattagaggaaaaaaaaagcaatatggtggtgaggaagagttaccacagacaaatcctggatttaacaacactccttttaaattcaccaaatattcaaatgcttatatgctggtgtatatacgtgaagctgacaaggacaaagtaatatgcaatgtggatgagaaagacattgctgaacatttaagggagaggttgaagaaagaacaagaagaaaaagagcac

SEQ ID NO: 3775 - protein, 559 aa, Glycine max
  misc_feature (1)..(559): useful for making plants with increased salt and oxidative stress resistance as described in USSN 12/922,143
  misc_feature (1)..(559): Ceres CLONE ID no.528125
  misc_feature (1)..(559): Bit score of 1221.4 for HMM based on sequences of FIGURE 10 of USSN 12/922,143.
  misc_feature (62)..(182): Pfam Name: MATH Pfam Description: MATH domain
  misc_feature (1)..(559): Functional Homolog Of Ceres SEEDLINE ID no. ME03280
MTVMTPAPIDQQQEDEEMLVPHTDLAENNHQPMEVVAQPDAANTVESQPVEDPSTSRFTWKIDNFSRMNTKKLYSEIFVVGGYKWRVLIFPKGNNVDYLSMYLDVADSASLPYGWSRYAQFSLAVVNQIHNKYSVRKDTQHQFNARESDWGFTSFMPLGELYDPSRGYLVNDTLVVEAEVFVRRIVDYWTYDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCPDVYASFDKYVEVERLEGDNKYHAEQYGLQDAKKGVLFIDFPPVLQLQLKRFEYDFMRDTMVKINDRYEFPLQLDLDRENGKYLSPDADRNVRNLYTLHSVLVHSGGVHGGHYYAFIRPTLSEQWYKFDDERVTKEDTKRAIRGKKKQYGGEEELPQTNPGFNNTPFKFTKYSNAYMLVYIREADKDKVICNVDEKDIAEHLRERLKKEQEEKEH

SEQ ID NO: 3776 - DNA, 1559 bp, Gossypium hirsutum
  misc_feature (1)..(1559): useful for making plants with increased salt and oxidative stress resistance as described in USSN 12/922,143
  misc_feature (1)..(1559): Ceres CLONE ID no.1894772
actgtaataaaatcaccaaataaaatcaacccaaaaaatagagaaaaaatctttctccgagtttcgcctttctcgttcctcttgttttcgtaagcttgtttacctctcaatttcatagctatgactgttatggcccctgcccctatcgatcaacaagaagatgaggaaatgctcgtcccacagtctgatttgaccgacaatcaccagcccatggaagttgtagcgcaacccgaagctgcaaatactgtggaaaatcaaccagttgaggatcctccttcatcaagattcacttggaggattgaaaacttctctaggttaaacgctaagaagcattattctgaagtcttcgttgtcggtggttataaatggcgaatactgctatttccaaagggaaacaatgtggatcatttgtctatgtatttggatgttgctgactcagcaagcttaccctatgggtggagtagatatgcccagttcagtttggcagtagttaatcaaattcataataaatattctatcagaaaagacacacagcaccagttcaatgcacgagaaagtgattggggttttacatcctttatgcccctcggcgagttatatgatccttgcagagggtatcttgtgaatgacactttgattgttgaagcagaggtggttgtccgcaggattgttgattactggacatatgactcaaagaaggaaactggttatgttggacttaaaaatcaaggagcaacatgttacatgaattctctgcttcaaactctgtatcacattccttacttcaggaaggcagtgtatcatatgcctacaactgagaatgatatgccatcaggaagcatccctcttgctctgcagagtttattttacaaactccagtacagtgacagcagtgttgcaacaaaagagctgaccaaatcttttggatgggacacacatgattctttcatgcagcacgatgttcaagaacttaatagagttctgtgtgaaaaacttgaagataaaatgaagggaactgttgtggaaggcaccatacaacagttgtttgaggggcaccatatgaattacattgagtgcattaatgtggattataaatctacaaggaaggagtcattttatgatcttcagcttgatgttaaaggctgtcatgatgtatatgcttcttttgacaagtatgtagaagttgaacgccttgaaggtgataataaatatcatgccgaacaatatggcttgcaggatgctaagaagggtgtcttgtttattgacttccctccggtccttcagcttcagcttaagcgatttgaatatgattttatgcgggacactatggtcaagattaatgatcgctatgagttccctttgcaacttgaccttgaccgagatggtggaaaatacttatcaccagatgctgataggagagtccgcaatctttacacgcttcacagtgtcctcgttcacagtggtggggtgcatggtggacattattatgcatttatcaggccgactctttctgatcaatggtatggatcatattaatgcattcaatcctttgcagcagc

SEQ ID NO: 3777 - protein, 471 aa, Gossypium hirsutum
  misc_feature (1)..(471): useful for making plants with increased salt and oxidative stress resistance as described in USSN 12/922,143
  misc_feature (1)..(471): Ceres CLONE ID no.1894772
  misc_feature (1)..(471): Bit score of 1224.1 for HMM based on sequences of FIGURE 10 of USSN 12/922,143.
  misc_feature (60)..(180): Pfam Name: MATH Pfam Description: MATH domain
  misc_feature (1)..(471): Functional Homolog Of Ceres SEEDLINE ID no. ME03280
MTVMAPAPIDQQEDEEMLVPQSDLTDNHQPMEVVAQPEAANTVENQPVEDPPSSRFTWRIENFSRLNAKKHYSEVFVVGGYKWRILLFPKGNNVDHLSMYLDVADSASLPYGWSRYAQFSLAVVNQIHNKYSIRKDTQHQFNARESDWGFTSFMPLGELYDPCRGYLVNDTLIVEAEVVVRRIVDYWTYDSKKETGYVGLKNQGATCYMNSLLQTLYHIPYFRKAVYHMPTTENDMPSGSIPLALQSLFYKLQYSDSSVATKELTKSFGWDTHDSFMQHDVQELNRVLCEKLEDKMKGTVVEGTIQQLFEGHHMNYIECINVDYKSTRKESFYDLQLDVKGCHDVYASFDKYVEVERLEGDNKYHAEQYGLQDAKKGVLFIDFPPVLQLQLKRFEYDFMRDTMVKINDRYEFPLQLDLDRDGGKYLSPDADRRVRNLYTLHSVLVHSGGVHGGHYYAFIRPTLSDQWYGSY

SEQ ID NO: 3778 - DNA, 1296 bp, Arabidopsis thaliana
  misc_feature (1)..(1296): useful for making plants with increased salt and oxidative stress resistance as described in USSN 12/922,143
  misc_feature (1)..(1296): Ceres CLONE ID no.40420
aaaaattactaaccatataagtctcagtactctctgttctgcaaacttcatacacaaaaccaacattaagagatggcgagtcactacagaaacacaagcgctattgcttatctattgctttgtctcttcattacatctgccactgcacattccttcatacgacaaatcactgatgacctcaaaacaaatctgcagcaggaggtaggagcagaaccaatccaaaacctggacgtgggacattacttacaagaaaataaggagatctcatcacgtgattataaagtatcagcttcaaacgcagtgaaaggtttgagagatcgtcctccatcgtcttactctctcaagatggagtctttcaacacgctccttaagtcaacttacacggagaaatatgtatctcgtcccttttcagttggtggatacaactggacacttgttgtgttcccaaatgggaacaagaaggatagtggttcagggtacctttctctttacgtagccatagacaactcaactctcggacaacaagagatttacgcagatctaaggttttacatctttaacaagaatgagaggaagtacttcactatccaagataccgatgtgtggaagtttagtgtcttcaaaacgatgtggggattctctcaggtcctccccattgatacattcaaagatccgacaaaaggatatctctacgatggagatcactgcgagtttggtgttgatgtaaccatgccttctctctacgaaaaatcggaacttttctctgtcacagagaattttctaaatccgagattcacctggaccattcggggattctctacgctgctaaaaaacagttacctatcagaagtgttctccatcggaggaagaagttggaatatacaaatcaatccaagtggtcttggcacgggagagggaaaagctttgtcgatgtatcttggccttaatgtgaatgagatattcagaccatatgagaagatttatgttcgagccaagcttcgagctcttaaccaactcaatctcagtaacatcgaaagggaactcgatatttggtacaatggtccgggatatggagaatatagctggggtttccctgagtttatctatttcccttatctcacagattcatcaaagggtttcgttaagaacgatgtgttgatggttcaagttgaaatggaggccatttcttcaaccaagtacttcccgagttagattttctctaagcaaagaacttgtacctacctccatgtgtttgatttgttatcaaatactaataagaatttgattatgcatttc

SEQ ID NO: 3779 - protein, 379 aa, Arabidopsis thaliana
  misc_feature (1)..(379): useful for making plants with increased salt and oxidative stress resistance as described in USSN 12/922,143
  misc_feature (1)..(379): Ceres CLONE ID no.40420
  misc_feature (1)..(379): Bit score of 873.6 for HMM based on sequences of FIGURE 10 of USSN 12/922,143.
  misc_feature (245)..(370): Pfam Name: MATH Pfam Description: MATH domain
  misc_feature (1)..(379): Functional Homolog Of Ceres SEEDLINE ID no. ME03280
MASHYRNTSAIAYLLLCLFITSATAHSFIRQITDDLKTNLQQEVGAEPIQNLDVGHYLQENKEISSRDYKVSASNAVKGLRDRPPSSYSLKMESFNTLLKSTYTEKYVSRPFSVGGYNWTLVVFPNGNKKDSGSGYLSLYVAIDNSTLGQQEIYADLRFYIFNKNERKYFTIQDTDVWKFSVFKTMWGFSQVLPIDTFKDPTKGYLYDGDHCEFGVDVTMPSLYEKSELFSVTENFLNPRFTWTIRGFSTLLKNSYLSEVFSIGGRSWNIQINPSGLGTGEGKALSMYLGLNVNEIFRPYEKIYVRAKLRALNQLNLSNIERELDIWYNGPGYGEYSWGFPEFIYFPYLTDSSKGFVKNDVLMVQVEMEAISSTKYFPS

SEQ ID NO: 3780 - DNA, 1335 bp, Arabidopsis thaliana
  misc_feature (1)..(1335): useful for making plants with increased salt and oxidative stress resistance as described in USSN 12/922,143
  misc_feature (1)..(1335): Ceres CLONE ID no.116206
aaaagcattattaactaagcatgtatctcccactaaggcacaaattactaaccatataagtctcagtactctctgttctgcaaacttcatacacaaaaccaacattaagagatggcgagtcactacagaaacacaagcgctattgcttatctattgctttgtctcttcattacatctgccactgcacattccttcatacgacaaatcactgatgacctcaaaacaaatctgcagcaggaggtaggagcagaaccaatccaaaacctggacgtgggacattacttacaagaaaataaggagatctcatcacgtgattataaagtatcagcttcaaacgcagtgaaaggtttgagagatcgtcctccatcgtcttactctctcaagatggagtctttcaacacgctccttaagtcaacttacacggagaaatatgtatctcgtcccttttcagttggtggatacaactggacacttgttgtgttcccaaatgggaacaagaaggatagtggttcagggtacctttctctttacgtagccatagacaactcaactctcggacaacaagagatttacgcagatctaaggttttacatctttaacaagaatgagaggaagtacttcactatccaagataccgatgtgtggaagtttagtgtcttcaaaacgatgtggggattctctcaggtcctccccattgatacattcaaagatccgacaaaaggatatctctacgatggagatcactgcgagtttggtgttgatgtaaccatgccttctctctacgaaaaatcggaacttttctctgtcacagagaattttctaaatccgagattcacctggaccattcggggattctctacgctgctaaaaaacagttacctatcagaagtgttctccatcggaggaagaagttggaatatacaaatcaatccaagtggtcttggcacgggagagggaaaagctttgtcgatgtatcttggccttaatgtgaatgagatattcagaccatatgagaagatttatgttcgagccaagcttcgagctcttaaccaactcaatctcagtaacatcgaaagtgaactcgatatttggtacaatggtccgggatatggagaatatagctggggtttccctgagtttatctatttcccttatctcacagattcatcaaagggtttcgttaagaacgatgtgttgatggttcaagttgaaatggaggccatttcttcaaccaagtacttcccgagttagattttctctaagcaaagaacttgtacctacctccatgtgtttgatttgttatcaaatactaataagaatttgattatgcatttc

SEQ ID NO: 3781 - protein, 379 aa, Arabidopsis thaliana
  misc_feature (1)..(379): useful for making plants with increased salt and oxidative stress resistance as described in USSN 12/922,143
  misc_feature (1)..(379): Ceres CLONE ID no.116206
  misc_feature (1)..(379): Bit score of 868.0 for HMM based on sequences of FIGURE 10 of USSN 12/922,143.
  misc_feature (245)..(370): Pfam Name: MATH Pfam Description: MATH domain
  misc_feature (1)..(379): Functional Homolog Of Ceres SEEDLINE ID no. ME03280
MASHYRNTSAIAYLLLCLFITSATAHSFIRQITDDLKTNLQQEVGAEPIQNLDVGHYLQENKEISSRDYKVSASNAVKGLRDRPPSSYSLKMESFNTLLKSTYTEKYVSRPFSVGGYNWTLVVFPNGNKKDSGSGYLSLYVAIDNSTLGQQEIYADLRFYIFNKNERKYFTIQDTDVWKFSVFKTMWGFSQVLPIDTFKDPTKGYLYDGDHCEFGVDVTMPSLYEKSELFSVTENFLNPRFTWTIRGFSTLLKNSYLSEVFSIGGRSWNIQINPSGLGTGEGKALSMYLGLNVNEIFRPYEKIYVRAKLRALNQLNLSNIESELDIWYNGPGYGEYSWGFPEFIYFPYLTDSSKGFVKNDVLMVQVEMEAISSTKYFPS

SEQ ID NO: 3782 - DNA, 1264 bp, Brassica napus
  misc_feature (1)..(1264): useful for making plants with increased salt and oxidative stress resistance as described in USSN 12/922,143
  misc_feature (1)..(1264): Ceres CLONE ID no.1083320
acacacctctttcacaacaaaaccttaaaagatgataagtcactacagaaacaccatttctgttgtttatctcttggtttgtatcttcattacatcttcttctgcaagttccttcctacgacaattcacagatgacttcaacacaaatcttcagcaggagaatggagcaggaccaaatccaaacgtgggtggagcagatcacttacatcaacatcaagagatctcatcacgtgatcacaaagtctcagtttcaagtacggtgaatggtctgagagatcgtcctccatcttcatactctctcaagatggagtctttcaacaagctccttaactcaccttacacagagagataccaatctcgtccttttacagttggtggatacaactggacacttatggtgtatcccaatgggaacaagaaggatagtggttcagggtacctttcactttacgtagccatagacaattcaactctcgtcgctggacagcaagaggtttacgcagatctcagattttacgtattcaacaacaacgagaggaagtactttactatccaagataccaatgtgtggcgttttaatgtcttcaaaacgatgtggggattctctcaagtgctccctgttgctacattcaaagacccggcaaacggatacctctacgatggagaccactgcgagtttggtgttgatgtgaccattcccactacgtatcaaatatcagaacttttctctattgctgacaacttctataaccccaagttcacctggaccattaggggattctccacgctgttcaaagatacttactactcagatctgttctccattggagggagaacttggactatacaagtgaatccaagtggtcgtggcacgggagcaggaaaagccttgtccatgtatcttaaccttgatgtgaatgagaagttcagaccctacgagaagatttatgttcgaggcaagcttcgagttcttaaccaacgtggactcaataacatcgaaaggcaactggatatctggtaccagggtccaggttatggagaatacagctggggttaccatgagtttatctctttctccgatctcagagattcagctaagggttttgttgtgaacgacgtgttgatggttcaggccgaactcgaggacatttcttcaaccaagtacttacctaactagattgtctctagccaaggaacatgttgaacctccatgtttttgctttctcatcagccatctaaaaatgataacctctttttgcgtttc

SEQ ID NO: 3783 - protein, 381 aa, Brassica napus
  misc_feature (1)..(381): useful for making plants with increased salt and oxidative stress resistance as described in USSN 12/922,143
  misc_feature (1)..(381): Ceres CLONE ID no.1083320
  misc_feature (1)..(381): Bit score of 896.2 for HMM based on sequences of FIGURE 10 of USSN 12/922,143.
  misc_feature (247)..(372): Pfam Name: MATH Pfam Description: MATH domain
  misc_feature (1)..(381): Functional Homolog Of Ceres SEEDLINE ID no. ME03280
MISHYRNTISVVYLLVCIFITSSSASSFLRQFTDDFNTNLQQENGAGPNPNVGGADHLHQHQEISSRDHKVSVSSTVNGLRDRPPSSYSLKMESFNKLLNSPYTERYQSRPFTVGGYNWTLMVYPNGNKKDSGSGYLSLYVAIDNSTLVAGQQEVYADLRFYVFNNNERKYFTIQDTNVWRFNVFKTMWGFSQVLPVATFKDPANGYLYDGDHCEFGVDVTIPTTYQISELFSIADNFYNPKFTWTIRGFSTLFKDTYYSDLFSIGGRTWTIQVNPSGRGTGAGKALSMYLNLDVNEKFRPYEKIYVRGKLRVLNQRGLNNIERQLDIWYQGPGYGEYSWGYHEFISFSDLRDSAKGFVVNDVLMVQAELEDISSTKYLPN

SEQ ID NO: 3784 - protein, 363 aa, Arabidopsis thaliana
  misc_feature (1)..(363): useful for making plants with increased salt and oxidative stress resistance as described in USSN 12/922,143
  misc_feature (1)..(363): Public GI ID no.15231115
  misc_feature (1)..(363): Bit score of 447.4 for HMM based on sequences of FIGURE 10 of USSN 12/922,143.
  misc_feature (228)..(348): Pfam Name: MATH Pfam Description: MATH domain
  misc_feature (1)..(363): Functional Homolog Of Ceres SEEDLINE ID no. ME03280
MMSYHYINTLCIVISLLSCLFITSSFAGPVPNQENGSQKIFPTQISSRDSKVSLSSTVKGLRERPPSSYSLKMESFNTLMKSVYTERYESRPFRVGRYNWTLVVYPKGNKNDNGTGHISLYVVLDNSTLTSQSEEVHVDLRFYVFNKKETKYFTIQDTDVWRFSAIKRMWGFSKVLPLITFNNLKNGYLYDVDHCEFGVDVIIPPFYEKSEVFSVTKSFPSPRFTWYIQGYSTLPTDYLSEEFIIGGKSWNLRIFKNGFGAFEGKNLSLYLNLGPQELLKAKPYDKVYVRAKLRVPNQFGSQSNLVLERPLDNWFSPQTIGWGYADFMPLSDLRNSSKGFLVNDMLVVQVAMEEISSTNYLPK

SEQ ID NO: 3785 - protein, 375 aa, Arabidopsis thaliana
  misc_feature (1)..(375): useful for making plants with increased salt and oxidative stress resistance as described in USSN 12/922,143
  misc_feature (1)..(375): Public GI ID no.15231117
  misc_feature (1)..(375): Bit score of 438.6 for HMM based on sequences of FIGURE 10 of USSN 12/922,143.
  misc_feature (249)..(366): Pfam Name: MATH Pfam Description: MATH domain
  misc_feature (1)..(375): Functional Homolog Of Ceres SEEDLINE ID no. ME03280
MTSLYRNTSSFVYLLFCLFITSSSAGSFIRQFSDDFNTIQQQKGKDGPTPNLEKGNYLHKHNEISSSLDYKVSASNIVKGLTEVPPSSYSFKIESYNSFLKIPYLGFESRPFAAGGYNWVLKVHPNGLTWDGTSGYVSLYVLLHESTPITADQVVYADLRFYIFNNNEKKYFTVQDTNVWKFTAPKRLLGFPKVMSADQFEDLRNGYIYDNHCEFGVDVTVASHYQKSESLFVTEKFDNPIFTYALLRFSTLLKESYQSDVFSIGGRSMYLQVFPNGRNLSKGKAMSLYLNINDKFKPFEMIYVRAKLRVLNQRKLNNVEIQVSNWYTSWFYYSGDFQIIPLADLRDSSKGFVVNDMLKVEVQLEGISSTKWYPS

SEQ ID NO: 3786 - protein, 382 aa, Arabidopsis thaliana
  misc_feature (1)..(382): useful for making plants with increased salt and oxidative stress resistance as described in USSN 12/922,143
  misc_feature (1)..(382): Public GI ID no.9294554
  misc_feature (1)..(382): Bit score of 409.9 for HMM based on sequences of FIGURE 10 of USSN 12/922,143.
  misc_feature (247)..(367): Pfam Name: MATH Pfam Description: MATH domain
  misc_feature (1)..(382): Functional Homolog Of Ceres SEEDLINE ID no. ME03280
MDQINREDEKVCLVHVNLPLISTLVAEGDENTRKTLSCQNLTIFSPRPVPNQENGSQKIFPTQISSRDSKVSLSSTVKGLRERPPSSYSLKMESFNTLMKSVYTERYESRPFRVGRYNWTLVVYPKGNKNDNGTGHISLYVVLDNSTLTSQSEEVHVDLRFYVFNKKETKYFTIQDTDVWRFSAIKRMWGFSKVLPLITFNNLKNGYLYDVDHCEFGVDVIIPPFYEKSEVFSVTKSFPSPRFTWYIQGYSTLPTDYLSEEFIIGGKSWNLRIFKNGFGAFEGKNLSLYLNLGPQELLKAKPYDKVYVRAKLRVPNQFGSQSNLVLERPLDNWFSPQTIGWGYADFMPLSDLRNSSKGFLVNDMLVVQVAMEEISSTNYLPK

SEQ ID NO: 3787 - DNA, 1280 bp, Brassica napus
  misc_feature (1)..(1280): useful for making plants with increased salt and oxidative stress resistance as described in USSN 12/922,143
  misc_feature (1)..(1280): Ceres CLONE ID no.1122866
actccatccacagagaaaagatgaagtatcactacagaaacaccatctctatctctgtagcatatctctttctttgtcttttcatcacttacgtgtcttcacaatccttgatacgacaaatcaccgatgacgtcaatacgaatctaaaagaagatgtgccttacgtacaaaaacatcaagagatctcatcgcgtcattataatgtctctcattcaaagacggttacgggtatgagaaatcgtcgtccatcgacttactcttacaagattgagacaaacgtcgtagacaaatttgaaactcgccctttcatggttggtggatacaattggattctccatgtgtaccttaatgggaacacaaaggatggtggtgctggttacgtttcgctttacgtagaaatagacaagtcaggtttcgtagattctgcacatcaagaggtttacgcggatctcaggttttacatcttcaacaggaacgagaggaagtactttaccatccaagatacggatgtatggcgattcgatgctttcaacacgatgtggggattctctaaggtcctccccgttgatacctttaaagacccgaaaaatggttacctttacaatggagaacactgtgagtttggtgttgatgtgatcgttcctactccctttgaagaatcagaaactttctctatcagtagtagttctgataaatacacctggacgattcagaaattctccacgttgtccaaagatttgtactcacctgtgatctctcttggaggaaaaaaatggaatatattagtggttccagctggttctggctcgggaagaggaaaatacgtttcaatgtttcttcaactttctacaaatcaacgaagaggatatgaatacatttatgttcgagtcaagtttcgagttattaaccaaatcaggaattggtatggaagaacctattcttggggtatcgtggaccttatctctttcgatgatctcagagattcgtcaaagggtttccttgtaaatgacgcgttgatcgttgaagtccaattggaggctatttctactaccaagtacttcccttagttaactaaaggaacattcagctctatatctttgcgttattaccaaccattttgtgtttttcttttcgggtgttatcaaccacacaattataataagaatccatgtcaaaccaagaaaaaaatattcataaaaatatgtaatgttttatttaatgaattttgtaatgttttacttaagcttttcatgtcagtaataaaactcttttatattgtg

SEQ ID NO: 3788 - protein, 348 aa, Brassica napus
  misc_feature (1)..(348): useful for making plants with increased salt and oxidative stress resistance as described in USSN 12/922,143
  misc_feature (1)..(348): Ceres CLONE ID no.1122866
  misc_feature (1)..(348): Bit score of 404.9 for HMM based on sequences of FIGURE 10 of USSN 12/922,143.
  misc_feature (230)..(340): Pfam Name: MATH Pfam Description: MATH domain
  misc_feature (1)..(348): Functional Homolog Of Ceres SEEDLINE ID no. ME03280
MKYHYRNTISISVAYLFLCLFITYVSSQSLIRQITDDVNTNLKEDVPYVQKHQEISSRHYNVSHSKTVTGMRNRRPSTYSYKIETNVVDKFETRPFMVGGYNWILHVYLNGNTKDGGAGYVSLYVEIDKSGFVDSAHQEVYADLRFYIFNRNERKYFTIQDTDVWRFDAFNTMWGFSKVLPVDTFKDPKNGYLYNGEHCEFGVDVIVPTPFEESETFSISSSSDKYTWTIQKFSTLSKDLYSPVISLGGKKWNILVVPAGSGSGRGKYVSMFLQLSTNQRRGYEYIYVRVKFRVINQIRNWYGRTYSWGIVDLISFDDLRDSSKGFLVNDALIVEVQLEAISTTKYFP

SEQ ID NO: 3789 - protein, 370 aa, Arabidopsis thaliana
  misc_feature (1)..(370): useful for making plants with increased salt and oxidative stress resistance as described in USSN 12/922,143
  misc_feature (1)..(370): Public GI ID no.15232931
  misc_feature (1)..(370): Bit score of 210.5 for HMM based on sequences of FIGURE 10 of USSN 12/922,143.
  misc_feature (243)..(361): Pfam Name: MATH Pfam Description: MATH domain
  misc_feature (1)..(370): Functional Homolog Of Ceres SEEDLINE ID no. ME03280
MSEKGLIKKEDHMFQEEKRKTNYGAIGLACFISCFFAFQFMKIVTTQPSTTTTSSIAVIDSPMSSHKLSDRREIWRVIPPSTYCLKIESFIKFATSPNAEKYESRPFESGGYNWTLIVYPKGNIKEGAPLNYVSMYVQIDNSTLLNSPKEVYAEVKFFIYNRKEDKYLTYQETDAKRFFLFKPYWGYGNVRPYTDVANPNAGWLFDGDNVLFGVDVFVTEVFNKWEVFSFTKSLHDRLYKWTLPNFSSLEKQYYVSDKFVIGGRSWALKVYPSGDGEGQGNSLSLYVVAVDVKPYDKIYLKAKLRIINQRDSKHMEKKVESWSDQANSWGFQKFVPFADLKDTSKGLLVNDTLKMEIEFEDFSNTKYFPS

SEQ ID NO: 3790 - protein, 595 aa, Arabidopsis thaliana
  misc_feature (1)..(595): useful for making plants with increased salt and oxidative stress resistance as described in USSN 12/922,143
  misc_feature (1)..(595): Public GI ID no.15233264
  misc_feature (1)..(595): Bit score of 223.5 for HMM based on sequences of FIGURE 10 of USSN 12/922,143.
  misc_feature (465)..(584): Pfam Name: MATH Pfam Description: MATH domain
  misc_feature (1)..(595): Functional Homolog Of Ceres SEEDLINE ID no. ME03280
MGSTVLDANPSTLREHPPSSYSIKFENIAELDDGKYESSLFAAGGYNWRLVIYPKGNAKDEGSGFISMYVEIDSTNLLSSPLTGVFAYLVFFVYNKKTDKYFTIKDQCEFGVDVLVAPSLTKWEVVSFNQKILDPKFSWSLKKFKELKEELYNSDKFLVGGRQWFLKVHPKGVKARDNSLSIYVYLSESETLNAEEKIYTRVHLRVLDPFGSIHQAGQCNFWRTNTNKNQGYGWPTFASLDKVREKYLDNEGSLNIEIEFAVVSSTKYSPILILSSLASGSMMCSSVSSTTLRSWRERTPNSYSLKLQNISQVEKSTLFSDGKYQSRLFSSGGYNWRMIIYPKGNRKDDGSGFISMYVEIDSTSLLTTPTTEVFADLRFFVFNKKENKYYTIQHVESKLFNAFRTIWGLAQVLPVDTFTDPKNGYIFEGDQCEFGVDVIVAAPPTNWEIHTLHEALSQPKFFWTVKNFSELNNNVYTSGNFSMRERKWVLKLYPKGDVKGDRKWLSLYLYLDQSETLKESEKIFVQAQLRVLDPRGSNHVTHKISSWYTSSNTAWGYRKFVSLAEIPKAYLDKDTLKVQIDVEVVSEAEFSPSMI

SEQ ID NO: 3791 - protein, 312 aa, Arabidopsis thaliana
  misc_feature (1)..(312): useful for making plants with increased salt and oxidative stress resistance as described in USSN 12/922,143
  misc_feature (1)..(312): Public GI ID no.9279767
  misc_feature (1)..(312): Bit score of 197.5 for HMM based on sequences of FIGURE 10 of USSN 12/922,143.
  misc_feature (182)..(301): Pfam Name: MATH Pfam Description: MATH domain
  misc_feature (1)..(312): Functional Homolog Of Ceres SEEDLINE ID no. ME03280
MMCSSVSSTTLRSWRERTPNSYSLKLQNISQVEKSTLFSDGKYQSRLFSSGGYNWRMIIYPKGNRKDDGSGFISMYVEIDSTSLLTTPTTEVFADLRFFVFNKKENKYYTIQQSKLFNAFRTIWGLAQVLPVDTFTDPKNGYIFEGDQCEFGVDVIVAAPPTNWEIHTLHEALSQPKFFWTVKNFSELNNNVYTSGNFSMRERKWVLKLYPKGDVKGDRKWLSLYLYLDQSETLKESEKIFVQAQLRVLDPRGSNHVTHKISSWYTSSNTAWGYRKFVSLAEIPKAYLDKDTLKVQIDVEVVSEAEFSPSMI

SEQ ID NO: 3792 - DNA, 1287 bp, Brassica napus
  misc_feature (1)..(1287): useful for making plants with increased salt and oxidative stress resistance as described in USSN 12/922,143
  misc_feature (1)..(1287): Ceres CLONE ID no.1037358
aattcgcacgagaccattacctagaacatcctaatcgaaaaaggaagaaaatacatatttagaaataaaagtttaaaccaaaatgtttctaaaagaaaaaaagaaaagtcaatttgaatggagcagttttgctgttctcttgtttcttttgtgctgtctttgcaaccattccactaaatccactagctactacacaatccaccaacgcagtgccttgtaatactcacggttcaagggtcgctaaggcttatggtgtagacgctaacctctcggccgagcaaagattcatgcgggaccgtccaccaagttcttactgcgtgcggatcgaagggtgcagcgaactaatcactaaaagtccaaacgtacaaaagtacgagacccgtcctttcagtgtaggcggattcaactggacttttatcatcgaaccgtttgggagcacgactaacttagggacatggatatctgcatatgttgcaatagatcctaaaggtctagttggcgaaaaccgcgaggtttatgcagatctaagatttttggcatacagcaagactttcgatcaatactggacatctatggatacggacatcaggcgtttccatcaatccaggacaacttggggaaatccaaatttcatccgacatgttaacttcatagctaaagatagagagtacattttcgacaatgaccaatgtgtgtttggtgtagacatctcggtgtttcctttttttaacaaatgggaggtcttgtcgatcgataagacggtctatgggcctaactcgtggaagcttctgaaattctcaacattgaccagagatttttacgtatctgacgaattctccattggaggaaaaacatgggcatttaaggtgtatccaaacggttatggcacaggagaaggaaactcgttgtccctttatctgacactaactgaaaaccagaccttgaaaccttacgaaaaggtttatgtccgagccaagctgcgagttcttgaccaaaaacaatcaagacatcttgaaaaaccaattctatcctggttcaacgccacaggagaaagttctgggttggagcggtttgtgtctttgactgatcttcaaaatccagccaaaggtttcatcgtgaatgattctctgtccgtacaagttcaattcgaggctgtctcatcaactaattactattctagcaatgccgctcaaatcagtagtttctaaatgtctacattgtcgaatctttaaataacaggctttgcatgtatacaaagcgaataataataaaaacttgacacgcttc

SEQ ID NO: 3793 - protein, 306 aa, Brassica napus
  misc_feature (1)..(306): useful for making plants with increased salt and oxidative stress resistance as described in USSN 12/922,143
  misc_feature (1)..(306): Ceres CLONE ID no.1037358
  misc_feature (1)..(306): Bit score of 116.2 for HMM based on sequences of FIGURE 10 of USSN 12/922,143.
  misc_feature (167)..(289): Pfam Name: MATH Pfam Description: MATH domain
  misc_feature (1)..(306): Functional Homolog Of Ceres SEEDLINE ID no. ME03280
MRDRPPSSYCVRIEGCSELITKSPNVQKYETRPFSVGGFNWTFIIEPFGSTTNLGTWISAYVAIDPKGLVGENREVYADLRFLAYSKTFDQYWTSMDTDIRRFHQSRTTWGNPNFIRHVNFIAKDREYIFDNDQCVFGVDISVFPFFNKWEVLSIDKTVYGPNSWKLLKFSTLTRDFYVSDEFSIGGKTWAFKVYPNGYGTGEGNSLSLYLTLTENQTLKPYEKVYVRAKLRVLDQKQSRHLEKPILSWFNATGESSGLERFVSLTDLQNPAKGFIVNDSLSVQVQFEAVSSTNYYSSNAAQISSF

SEQ ID NO: 3794 - protein, 396 aa, Arabidopsis thaliana
  misc_feature (1)..(396): useful for making plants with increased salt and oxidative stress resistance as described in USSN 12/922,143
  misc_feature (1)..(396): Public GI ID no.18406229
  misc_feature (1)..(396): Bit score of 169.3 for HMM based on sequences of FIGURE 10 of USSN 12/922,143.
  misc_feature (258)..(375): Pfam Name: MATH Pfam Description: MATH domain
  misc_feature (1)..(396): Functional Homolog Of Ceres SEEDLINE ID no. ME03280
MYSEEKKSRNYGSIFVYCFFCFVLIVEVARFAKPYINLQNLIETEAVVEEGFMAVGNSGNLPCGSSKPSSASVRAHDEQKLSQAVTTDTRTRPPNSYCVKFQSFVTMAKQVKENGGKYESRPFSVGGYNWTLLIYPVIYIPTDSGGYVSIYVRVDNSSLITNPKDVYAEITFLAYKSSTDKYQISQETEAQRFHLFKQQWGLLQFLPIYYFENPAYGYFFEGESVVFGVDINIVKPFENWEVFSNEQNIRDPIFEWRLTKFSTRFLDSYTSDSFSSGGRNWALKVYPNGVGNATGNSLSLYLLSDQSNDKGYVEAKLRVIDQIQSNNFEKKVAAWPNATENGWGFDRFLSFADIKNTSKGFLVNDTLKLEVQILSFSKTDYYSHQSSLNVLTGDST

SEQ ID NO: 3795 - protein, 365 aa, Arabidopsis thaliana
  misc_feature (1)..(365): useful for making plants with increased salt and oxidative stress resistance as described in USSN 12/922,143
  misc_feature (1)..(365): Public GI ID no.15226599
  misc_feature (1)..(365): Bit score of 152.6 for HMM based on sequences of FIGURE 10 of USSN 12/922,143.
  misc_feature (257)..(355): Pfam Name: MATH Pfam Description: MATH domain
  misc_feature (1)..(365): Functional Homolog Of Ceres SEEDLINE ID no. ME03280
MMCHGRKVKMRDNEMSQIRQSLIPTGTEVSAGDGERRRCKTPEGQREKVVSDNDFVEEDCVLSKGGELLFGFDITQLLGQQNWQGDSTIVNNLREHPPSSYSLKINKLSQLTFDKYESHRFLSGGYNWRLVIYPKGNEKDKGSGFISMYVEFDNTKVSSTSPMEVFAYIIFFVYNKKENKYFTIQDVEVKRFNALRTVWGLSQVLSLETFNDLENGYTFEGEQCEFGVDVMVASPITKWEVVSFDEKLDILKFSWSVKDFSVLKEEFYVSERFSMGGRLWDLQMYPKGDPRRDKKWLSIFLRLSGSETLTVDEKIYVIAHLRVLDPLGNWFRDRNKGWGYLEFLSFSKLRKSYLDLEDTFFPLNL

SEQ ID NO: 3796 - DNA, 966 bp, Populus balsamifera subsp. trichocarpa
  misc_feature (1)..(966): useful for making plants with increased salt and oxidative stress resistance as described in USSN 12/922,143
  misc_feature (1)..(966): Ceres ANNOT ID no.1447141
atggccccagaaccagtcatggaagttaaaattcctcctagagatgatctagctgaaattacaaggtcaacgagggatcttcctccggctcactacacatttaagatcgaaaacttctccctacttgcaaatgcaaagatagacaacttcgaatcaggtgacttcgaagttggcagctacaaatggagattacgtctctatcctaacggaaacaagaaaaacaatggggatggacacatatctctatatttggcattttccaattcaaatgcactcccttttggctgggaggtcaacgtgaacttcagattgtttgtttataaccaaatccaagacaaatacttgactatccaatatgctaaaggaagggtaagacgctttcatggaatgaaaacagaattgggttttgaccaattaatccctctgactattttcaatgacgagtcaaagggatatctaattgatgatcgttgcatatttggagctgagatttttgttattaaacctactggcaaaggtgaatgcttgaccttggttaaccaacctgtcagcgacacttttacctggaaaattcagaacttttcagcactggatcaagaatcttacaagtcccaagttttttcttttggagggtacaaatgggctttgctggtttatccgaaagggaattcaacagagaaaggaaaaagcttgtctatctacttaaaaatggaggattttgaaactcttccatgtggacgaacaacgtatgctgaatacatgctgcgtgtgaaagaccaacttttcggaaaacatatcgaaaaaaaagcctattcccatttttcttattcaatcaaggactggggtcacctaaactttatgtctctcgatgacgtcaacgcccttccaaagggatttctagttaatgatactttggctgttgaggtacaaattcatgtgataacggtggtcaaggaattctcctga

SEQ ID NO: 3797 - protein, 321 aa, Populus balsamifera subsp. trichocarpa
  misc_feature (1)..(321): useful for making plants with increased salt and oxidative stress resistance as described in USSN 12/922,143
  misc_feature (1)..(321): Ceres ANNOT ID no.1447141
  misc_feature (1)..(321): Bit score of 670.5 for HMM based on sequences of FIGURE 10 of USSN 12/922,143.
  misc_feature (191)..(313): Pfam Name: MATH Pfam Description: MATH domain
  misc_feature (1)..(321): Functional Homolog Of Ceres SEEDLINE ID no. ME03280
MAPEPVMEVKIPPRDDLAEITRSTRDLPPAHYTFKIENFSLLANAKIDNFESGDFEVGSYKWRLRLYPNGNKKNNGDGHISLYLAFSNSNALPFGWEVNVNFRLFVYNQIQDKYLTIQYAKGRVRRFHGMKTELGFDQLIPLTIFNDESKGYLIDDRCIFGAEIFVIKPTGKGECLTLVNQPVSDTFTWKIQNFSALDQESYKSQVFSFGGYKWALLVYPKGNSTEKGKSLSIYLKMEDFETLPCGRTTYAEYMLRVKDQLFGKHIEKKAYSHFSYSIKDWGHLNFMSLDDVNALPKGFLVNDTLAVEVQIHVITVVKEFS

SEQ ID NO: 3798 - DNA, 975 bp, Populus balsamifera subsp. trichocarpa
  misc_feature (1)..(975): useful for making plants with increased salt and oxidative stress resistance as described in USSN 12/922,143
  misc_feature (1)..(975): Ceres ANNOT ID no.1485633
atggaaggaatgacggaagttaatgatcaagcagaaaatacaaggtcaataagggatcttccacctgctcactacgcatttaagatcgaaaacttctccctgctttcaaatacgaaggtagacagcgtcgaatcaggtgacttcgaagttgacagttacaaatggagattatgcctccatcctaatggaaacaagaaaagcaatggggatggacacatatctctatatttagcattttccaaatcgaatgccccccctcttggttgggaagttaacgtggacttcaagctgtttgtttataaccaaatccatgacaagtacttgaccatccaaaatgctaatgggagggtgagacgctttcatggaatgaaaacagaaatgggttttgaccaattacttccactgactcttttcaatgatgagtcaaagggatatctaatcgatgactgttgcacatttggagctgagatttttgttataaaacatactagcaaaggtgaatgcttgtccctgatgaagcaaccttcccacagctctttcacctggagcattcaaaaattttcagcactagatcaagaatcttgcaagtcccaagtgtttgctactggagggcacaaatggacactgctggtttatcccaaagggaattcaacatttaaaggcaaaagcttgtctatcttcttaaccttggaggattctgaaactcttccatctggacgaacaatgtatgcagaattcacgctgcgcgtgagggaccaacttttcggaaaacacgtcgaaaaaactgctaattgccatttttctaattcaatcaacgattggggtcactttaacttcatgtctctcgatgagctcaatactcttgcaaagggatttctagttaataatactttggttgttgaggcacaaattcatgtgcttacggtggtcaaggaactctccgggagctgtgcttttatgcattccaagacctaa

SEQ ID NO: 3799 - protein, 324 aa, Populus balsamifera subsp. trichocarpa
  misc_feature (1)..(324): useful for making plants with increased salt and oxidative stress resistance as described in USSN 12/922,143
  misc_feature (1)..(324): Ceres ANNOT ID no.1485633
  misc_feature (1)..(324): Bit score of 445.9 for HMM based on sequences of FIGURE 10 of USSN 12/922,143.
  misc_feature (184)..(306): Pfam Name: MATH Pfam Description: MATH domain
  misc_feature (1)..(324): Functional Homolog Of Ceres SEEDLINE ID no. ME03280
MEGMTEVNDQAENTRSIRDLPPAHYAFKIENFSLLSNTKVDSVESGDFEVDSYKWRLCLHPNGNKKSNGDGHISLYLAFSKSNAPPLGWEVNVDFKLFVYNQIHDKYLTIQNANGRVRRFHGMKTEMGFDQLLPLTLFNDESKGYLIDDCCTFGAEIFVIKHTSKGECLSLMKQPSHSSFTWSIQKFSALDQESCKSQVFATGGHKWTLLVYPKGNSTFKGKSLSIFLTLEDSETLPSGRTMYAEFTLRVRDQLFGKHVEKTANCHFSNSINDWGHFNFMSLDELNTLAKGFLVNNTLVVEAQIHVLTVVKELSGSCAFMHSKT

SEQ ID NO: 3800 - protein, 309 aa, Arabidopsis thaliana
  misc_feature (1)..(309): useful for making plants with increased salt and oxidative stress resistance as described in USSN 12/922,143
  misc_feature (1)..(309): Public GI ID no.21537273
  misc_feature (1)..(309): Bit score of 177.9 for HMM based on sequences of FIGURE 10 of USSN 12/922,143.
  misc_feature (26)..(153): Pfam Name: MATH Pfam Description: MATH domain
  misc_feature (1)..(309): Functional Homolog Of Ceres SEEDLINE ID no. ME03280
MASSGDYDEIIKSISDAPPTHYMVKIESFSLLTKHAIERYETESFEAGGYKWKLVLYPNGNKSKNTKDHVSVYLALADSSSLSPGWEVYAVFRLYLLDQNKDNYLILQGNERRFHSVKREWGFDKFIPTGTFSDSSNGYLMEDTCMFGADVFVSKERRSGRGECLSMIKDATSSKHVWKIENFSKLDKESYDSNAFFAGDRKWKIEFYPTGTKQGTGTHLSIYLTLVDPETISDGTKIFVEFTIRIFDQLQGRHIAGKVTKWFSRSSSEHGWVKYVSMVYFTQPNSGLLLKDVCLVEADVCVHGITSAI

SEQ ID NO: 3801 - protein, 309 aa, Arabidopsis thaliana
  misc_feature (1)..(309): useful for making plants with increased salt and oxidative stress resistance as described in USSN 12/922,143
  misc_feature (1)..(309): Public GI ID no.18401489
  misc_feature (1)..(309): Bit score of 174.2 for HMM based on sequences of FIGURE 10 of USSN 12/922,143.
  misc_feature (26)..(153): Pfam Name: MATH Pfam Description: MATH domain
  misc_feature (1)..(309): Functional Homolog Of Ceres SEEDLINE ID no. ME03280
MASSGDYDEIIKSISDAPPTHYMVKIESFSLLTKHAIERYETESFEAGGYKWKLVLYPNGNKSKNTKDHVSVYLSLADSSSLSPGWEVYAVFRLYLLDQNKDNYLILQGNERRFHSVKREWGFDKFIPTGTFSDASNGYLMEDTCMFGADVFVSKERRSGRGECLSMIKDATSSKHVWKIENFSKLDKESYDSNAFFAGDRKWKIEFYPTGTKQGTGTHLSIYLTLVDPETISDGTKIFVEFTIRIFDQLQGRHIAGKVTKWFSRSSSEHGWVKYVSMVYFTQPNSGLLLKDVCLVEADVCVHGITSAI

SEQ ID NO: 3802 - protein, 304 aa, Arabidopsis thaliana
  misc_feature (1)..(304): useful for making plants with increased salt and oxidative stress resistance as described in USSN 12/922,143
  misc_feature (1)..(304): Public GI ID no.11994555
  misc_feature (1)..(304): Bit score of 164.4 for HMM based on sequences of FIGURE 10 of USSN 12/922,143.
  misc_feature (21)..(148): Pfam Name: MATH Pfam Description: MATH domain
  misc_feature (1)..(304): Functional Homolog Of Ceres SEEDLINE ID no. ME03280
MLAEIIKSISDAPPTHYMVKIESFSLLTKHAIERYETESFEAGGYKWKLVLYPNGNKSKNTKDHVSVYLSLADSSSLSPGWEVYAVFRLYLLDQNKDNYLILQGNERRFHSVKREWGFDKFIPTGTFSDASNGYLMEDTCMFGADVFVSKERRSGRGECLSMIKDATSSKHVWKIENFSKLDKESYDSNAFFAGDRKWKIEFYPTGTKQGTGTHLSIYLTLVDPETISDGTKIFVEFTIRIFDQLQGRHIAGKVTKWFSRSSSEHGWVKYVSMVYFTQPNSGLLLKDVCLVEADVCVHGITSAI

SEQ ID NO: 3803 - DNA, 1195 bp, Populus balsamifera subsp. trichocarpa
  misc_feature (1)..(1195): useful for making plants with increased salt and oxidative stress resistance as described in USSN 12/922,143
  misc_feature (1)..(1195): Ceres ANNOT ID no.1459922
atggaagaaagaagctaccatccccagcttccagttccagcccttgttcctgatgcaacctttcaatctgctactgaggtaataagatcaaaaaggagcatccccccagcggactacactcttaaaatcgattccttttctttactgtcacaaatattctcaaagccagatgcacagagttaccaatctgacagctttgaggctggtggttacgagtggagattatctctgtacccctcaggggacagtatcagaaacgggaatggttacatctctttctacataattctggcagatcccgataacatgcctgctggttttgaaataaatgtcagctttaaattgttcgtatatgatcattttcaagacgagtatttgaccattcaagacatcaatggaagagtgagacgctttaacaaagtcaagatcgaacatggttttaccaaattcatttccctcgggacattcaaggaaccatctaatggatatttgctgaacgactcatgtgtatttggtgctgagatttttgtcataagaaatacaaataagggagatcgactgttactcgtacaagaacctgctcatcgttttcacacttggaagattcacaacttctccaagctcgacaaaaaaatattttctcatcaattttctgccggcggaagaaaatggcagatagggctttatcctagaggcaatcaatccctggacggagaacagaacttatctctgtacatattcctgacggattgtttcgtatttccaaaatatttcatgttgtctccttcatacatcctgacattgatgggaagatacggtctcaaagtccatcccaaggaacgaaaaatatatgctgaatgcaaaatccgtttattggatcagaaacgtggtcaacatatggaacgcgaagagaaaatgggaggaattgagcctcctcgtcgtcgtggggagttggtgagggtgttggaggaggaggaggaggaactgaaactggtaaggttctgcgctggcgctggtttggacctgcttggctgtgagtctgggattggttgtggaggggatgcagcccgcgtcattgcagatcacaccattcatgtcattcataacaatccaccggtagtgagcatgaacctatttggactccttgacgataccacagggagccctgatgatgacaatttgaatcagcgcctca

SEQ ID NO: 3804 - protein, 398 aa, Populus balsamifera subsp. trichocarpa
  misc_feature (1)..(398): useful for making plants with increased salt and oxidative stress resistance as described in USSN 12/922,143
  misc_feature (1)..(398): Ceres ANNOT ID no.1459922
  misc_feature (1)..(398): Bit score of 113.9 for HMM based on sequences of FIGURE 10 of USSN 12/922,143.
  misc_feature (46)..(177): Pfam Name: MATH Pfam Description: MATH domain
  misc_feature (1)..(398): Functional Homolog Of Ceres SEEDLINE ID no. ME03280
MEERSYHPQLPVPALVPDATFQSATEVIRSKRSIPPADYTLKIDSFSLLSQIFSKPDAQSYQSDSFEAGGYEWRLSLYPSGDSIRNGNGYISFYIILADPDNMPAGFEINVSFKLFVYDHFQDEYLTIQDINGRVRRFNKVKIEHGFTKFISLGTFKEPSNGYLLNDSCVFGAEIFVIRNTNKGDRLLLVQEPAHRFHTWKIHNFSKLDKKIFSHQFSAGGRKWQIGLYPRGNQSLDGEQNLSLYIFLTDCFVFPKYFMLSPSYILTLMGRYGLKVHPKERKIYAECKIRLLDQKRGQHMEREEKMGGIEPPRRRGELVRVLEEEEEELKLVRFCAGAGLDLLGCESGIGCGGDAARVIADHTIHVIHNNPPVVSMNLFGLLDDTTGSPDDDNLNQRL

SEQ ID NO: 3805 - protein, 1116 aa, Oryza sativa subsp. japonica
  misc_feature (1)..(1116): useful for making plants with increased salt and oxidative stress resistance as described in USSN 12/922,143
  misc_feature (1)..(1116): Public GI ID no.34395211
  misc_feature (1)..(1116): Bit score of 849.8 for HMM based on sequences of FIGURE 10 of USSN 12/922,143.
  misc_feature (84)..(204): Pfam Name: MATH Pfam Description: MATH domain
  misc_feature (1)..(1116): Functional Homolog Of Ceres SEEDLINE ID no. ME03280
MRVAWWTRAGGWSAAVGLRVGFFVRVVMWNQQQQQEEEEVLVPRQELPNGTQPMEAVVVPSEPAATVENQQIEDPPISRFTWTIENLSRVSTKKLYSEIFVVGGYKWRILIFPRGNNVEYLSMYLDVADSAVLPYGWTRYAQFSLSVVNQMHNKFTIRKETQHQFSARESDWGFTSFMPLGDLYNPSRGYLVNDTCIVEAEVAVCKVVDYWSYDSKKETGYVGLKNQVDSACQAVYHMPTTENDMPSGSIPLALQSLFYKLQYNDSSVSTKELTKSFGWDMHDSFMQHDVQELNRVLSEKLEDKMKKGILLWQVIVLSHHGHYVQTCPFDLIGVHSNADLQLDVKGCQDVYASFDKYVEVERLEGDNKYHAEQYGLQDAKKGVLFIDFPPVLQLQLKRFEYDFMRDTMVKINDRYEFPIQLDLDRDDGKYLSPDADRNVRNLYTLHSVLVHSGGVHGGHYYAFIRPTLSDQWFKFDDERVTKEDAKRALEEQYGGEEELPQTNPGLNNTPFKFTKYSNAYMLVYIRESDKDKIICNVDEKDIAEHLRIRLEKDREEKERRKKEKAEAHLYTIIKVARDDDLTTQIGKDIYFDLVDHDKVPSFRIQKQMPFTQFKEEVAKEFGIPTQFQRFWLWAKRQNHTYRPNRPLTPQEETHTVGQLKEAANKAHNAELKLFLEVELGLDLKPLPLPDKTREDILLFFKLYDPEKEQLRLFVKASGKPQDILPKLRKMAGFSQDEEIELYEEIKFEPNVMCEYIDNRLLFRACQLEDGDIVCFQKSPKPDTADQYRYPDVPSFLVYIRNRQVVHFRSLEKPKEDDFCLEMSKAFTYDEVVEKVAQKLGVDDPTKIRLTSHNCYSQQPKPQPIKYRGVERLLDMLIHYNQTSDILYYEVLDIPLPELQALKTLKVTYHHGTKDEVSVHSIRLPKNSTVGDVLNDIKSKVELSHPNAELRLLEVFYHKIYKIFAPNEKIENINDQYWTLRAEEVPEEEKNLGPFDRLIHVYHFTKDTQNQTQVQNFGEPFFMVIREDETLSSIKERIQKKLKVPDEDFSKWKFAYISLGRPDYFEDSDTVASRFQRNMYGAWEQYLGLEHPDTAPRKTHNANQNRHSFERPVKIYN

SEQ ID NO: 3806 - DNA, 3330 bp, Populus balsamifera subsp. trichocarpa
  misc_feature (1)..(3330): useful for making plants with increased salt and oxidative stress resistance as described in USSN 12/922,143
  misc_feature (1)..(3330): Ceres ANNOT ID no.1510886
atgactctcatgactcctcctccgttaaatcaacaagaagacgacgagatgttggtcccacaaactgaatttgctgatggacctcagccaatggaagtagcacaagccgaaactgcaacagcagttgatgcacagtcggtggatgatccaccatctgctaggtttacatggacgattgataatttttcgaggctaaatgctaagaagctctactctgatgtttttgttgttggaggctacaagtggcggatattgatttttccaaagggtaacaatgtggatcatttatccatgtatctagatgttgctgattcagcaactttgccatatggctggagtcgatatgcgcagtttagcttgactgttatcaatcaacttcatcaaaagtactcaattcggaaagacacgcagcaccagttcaatgcacgtgagagtgattggggattcacttcattcatgcctcttggggaattgtatgaccctgggagagggtatcttgtaaatgacacgtgtgtggttgaagctgatgttgctgttcgtaaggtcattgattactggtcacatgattcgaagaaggagaccggttatgttggtctaaagaaccaaggagctacatgctacatgaactctctccttcagacgctgtatcatattccttatttcagaaaggctgtatatcatatgccaacaactgagaatgatatcccatcagggagcattcctctggctttgcagagtttgttttataaacttcaatacagtgacactagcgtagctacaaaagagttgacaaagtcttttggctgggatacatatgactctttcatgcagcatgatgtccaagaacttaatagggttctgtgtgaaaagcttgaagataaaatgaagggaactgttgtggagggcactatacaacagctatttgaagggcaccatatgaattatattgaatgcatcaatgttgactataagtcgacaagaaaggagtcattttatgatcttcagcttgatgtcaaaggctgtcgggatgtttatgcttcttttgataagtatgtggaggtggaacgtcttgaaggtgacaataaatatcatgctgaacaacatggattacaggatgctagaaagggtgtcctattcattgacttccccccagttctccaacttcaacttaaaaggttcgagtatgattttatgcgggatacaatggtgaagataaatgatcgctatgagttccctttgcaacttgatcttgatagagagaatgggaaatatttatcaccagaggctgaccgcagtgtccgcaatctatacacccttcacagtgttttggttcacagtggtggtgtgcatggtggacactactatgcttatatcagaccaactctctcagatcagtggttcaaatttgatgatgagcgggtgaccaaagaggatatcaaaagggcattagaggagcagtatggtggtgaggaagagttaccacagacaaatcctggcttcaacaactctcccttcaagtttacaaagtactcaaatgcttatatgcttgtgtatattcgtgaaagtgacaaggaaaaaataatctgtaatgtggacgagaaggacattgcagagcacctcaggataagattgaagaaagaacaggaggaaaaggagcaaaagagaaaggaaaaagcggaggcgcacttgtacaccataataaaggttgcacgcagtgaggatctacttgaacagattggcaaggatgtatattttgatcttgtggaccatgacaaagtacgaagtttccgtatccagaaacagataaccttcaaccttttcaaggaagaagttgctaaagaatttggtataccagtgcaacttcaacgtttttggctgtgggcaaagcgacaaaatcatacataccgtccaaatcggccactgactcctcaggaggaagcacagtctgttggacaattgagagaggtttctaataaggcaaataacgcggagctaaagctgtttctggaagcagaaattggacaggatttgcgacctgttcctccacctgagaagactaaagatgatatccttcttttctttaaactttatgatccatcgaaggaggaactccggtattcccacggtagcggcaagccgttggagatcctgacgaaactaaatgaaatcgctggctttgctcctgaccaggagattgaactttacgaggaaataaagtttgaacctaatgtcatgtgcgaacacattgacaagaggctcacttttcgttctagtcagcttgaagatggagatattgtttgctatcagaaaccccctccaatgggaagtgacgaacagtgccgctaccctgatgtgccttccttccttgagtacatgcacaatcgccaggttgttcgttttcgatctttggagaaatcgaaagaggatgaattctgtcttgattcaaagctccacacttatgatgatgttgcggaaagagtagctcaccatcttggcttggatgacccatccaaaattaggcttacatctcataactgttactcccagcaacctaaaccccagcccatcaaattccgaggagtggatcatttgtctgatatgctggtgcactacaatcagacatctgatattctatactatgaagtattagacatccctctaccagaattgcaaggccttaaaacattaaaagttgcttttcatcatgctactaaggatgaggtagtgattcataccattagattgccaaaacagagcactgtaggtgatgtcattaatgaccttaaggcaaaggtggagctgtctcatcctagtgctgaacttagattgcttgaggttttctatcacaagatctacaagatctttccacacaatgaaaaaatcgagaacattaatgatcaatactggacactacgtgcagaggaggttcctgaagaagagaaaaaccttgctcctcacgatcgcttgattcatgtctatcatttcatgaaagacacaactcaaaaccaggtggttcagaattttggagaaccatttttcctggtcattcacgagggtgagactttgactgaagtcaaaatgcgcatacagaaaaaattgcaggttcccgatgaagaattttcaaagtggaagtttgcttttttgtctctaggtcgccctgagtaccttcaagattcagacatcgtgtccagccgttttcagagaagggatgtttatggtgcttgggagcagtatcttggattggagcattctgacaatgctcctaaaaggtcatatgctgctaatcagaatcgtcatacatttgagaagccggtaaaaatctacaactag

SEQ ID NO: 3807 - protein, 1093 aa, Populus balsamifera subsp. trichocarpa
  misc_feature (1)..(1093): useful for making plants with increased salt and oxidative stress resistance as described in USSN 12/922,143
  misc_feature (1)..(1093): Ceres ANNOT ID no.1510886
  misc_feature (1)..(1093): Bit score of 1046.6 for HMM based on sequences of FIGURE 10 of USSN 12/922,143.
  misc_feature (43)..(163): Pfam Name: MATH Pfam Description: MATH domain
  misc_feature (1)..(1093): Functional Homolog Of Ceres SEEDLINE ID no. ME03280
MLVPQTEFADGPQPMEVAQAETATAVDAQSVDDPPSARFTWTIDNFSRLNAKKLYSDVFVVGGYKWRILIFPKGNNVDHLSMYLDVADSATLPYGWSRYAQFSLTVINQLHQKYSIRKDTQHQFNARESDWGFTSFMPLGELYDPGRGYLVNDTCVVEADVAVRKVIDYWSHDSKKETGYVGLKNQGATCYMNSLLQTLYHIPYFRKAVYHMPTTENDIPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEQHGLQDARKGVLFIDFPPVLQLQLKRFEYDFMRDTMVKINDRYEFPLQLDLDRENGKYLSPEADRSVRNLYTLHSVLVHSGGVHGGHYYAYIRPTLSDQWFKFDDERVTKEDIKRALEEQYGGEEELPQTNPGFNNSPFKFTKYSNAYMLVYIRESDKEKIICNVDEKDIAEHLRIRLKKEQEEKEQKRKEKAEAHLYTIIKVARSEDLLEQIGKDVYFDLVDHDKVRSFRIQKQITFNLFKEEVAKEFGIPVQLQRFWLWAKRQNHTYRPNRPLTPQEEAQSVGQLREVSNKANNAELKLFLEAEIGQDLRPVPPPEKTKDDILLFFKLYDPSKEELRYSHGSGKPLEILTKLNEIAGFAPDQEIELYEEIKFEPNVMCEHIDKRLTFRSSQLEDGDIVCYQKPPPMGSDEQCRYPDVPSFLEYMHNRQVVRFRSLEKSKEDEFCLDSKLHTYDDVAERVAHHLGLDDPSKIRLTSHNCYSQQPKPQPIKFRGVDHLSDMLVHYNQTSDILYYEVLDIPLPELQGLKTLKVAFHHATKDEVVIHTIRLPKQSTVGDVINDLKAKVELSHPSAELRLLEVFYHKIYKIFPHNEKIENINDQYWTLRAEEVPEEEKNLAPHDRLIHVYHFMKDTTQNQVVQNFGEPFFLVIHEGETLTEVKMRIQKKLQVPDEEFSKWKFAFLSLGRPEYLQDSDIVSSRFQRRDVYGAWEQYLGLEHSDNAPKRSYAANQNRHTFEKPVKIYN

SEQ ID NO: 3808 - DNA, 3711 bp, Populus balsamifera subsp. trichocarpa
  misc_feature (1)..(3711): useful for making plants with increased salt and oxidative stress resistance as described in USSN 12/922,143
  misc_feature (1)..(3711): Ceres ANNOT ID no.1518676
atgcaacaagaagacgatgagatgttggtcccacacactgaatttactgagggacctcagcctatggaagtagcacaagcagaaacagcgacggcagttgatgcacagtcagtggatgatccaccatcagctaggtttacatggacaattgataatttttcgaggtttaatactaagaagctttactccgatgtttttgttgttggaggctacaagtggcggatactggtttttccaaaggggaacaatgtggatcatttatccatgtatttagatgttgcagattcaactaatttgccatatgggtggagtcgatatgcgcagtttagcttgactgtcatcaatcaacttcaccaaaaatattcaattcggaaagacacgcagcaccagttcaatgcacgtgagagtgattggggcttcacttcatttatgccacttggggaattgtatgaccctgggagagggtatcttgtaaatgactcatgcatagttgaagctgatgttgctgttcgtagggttattgattactggtcacatgattcaaaaaaggagaccggttatgttggtctcaagaaccaaggagctacatgctacatgaactctctccttcaaacgctgtatcatattccttattttagaaaggctgtatatcatatgccaacaactgagaatgatatcccatcagggagcattccactggcgttgcagagtttgttttataaacttcaatacagtgacactagtgtagcaacaaaagagttgacaaagtctttcggctgggatacatatgactctttcatgcagcatgatgtccaagaacttaatagggttctttctgaaaagcttgaagataaaatgaagatttttgttacagaggataatagtaaattatccgagattcatcttgtggacctcatggaattttatatatatatatatataattgtagatcttcagcttgatgtcaaaggctgtcgggatgtttatgcttcttttgataagtatgtggaggtggaacgtcttgaaggtgacaataaatatcatgctgaacaacatggattacaggatgctaggaagggtgtcctattcattgacttcccccctgttctccaacttcaacttaaaaggtttgagtatgattttatgcgggatacgatggtgaagataaatgatcgctatgagttccctttgcaacttgatctggatagagagaatggaaaatatttatcacctgaggccgactgcagtgtccgcaatctctacacccttcacagtgttttggttcacagtggcggcgtgcatggtggacactactatgcttatatcagaccaactctatcagatcagtggttcaaatttgatgatgagcgggtaaccaaagaggatgtgaaaagggcattagaggagcagtatggtggtgaggaagagttaccacagacaaatcctggctttaacaactctcccttcaagtttacaaaatactcgaatgcttatatgcttgtgtatatacgtgaaagtgacaaggaaaaagtaatctgtaatgtggatgagaaggatattgcagagcacctcaggataagactgaagaaagaacaggaagagaaagagcaaaagagaaaggaaaaagctgaggcccacttgtacactatcataaaggttgcacgtagtgaggatctacttgaacagattggcaaagatgtatattttgatctcgtggatcatgacaaagttcgtagtttccgtatccagaaacaaataacctttaaccttttcaaggaagaagttgctaaagaatttggtattccagtgcaatttcaacgtttttggctgtgggcaaaacgacaaaatcatacataccgtccaaatcggccactgactcctcaggaggaatcacaatctgttggacaattgagagaggtttctaataaggcaaataatgcagagctgaagttgtttctggaagtagaagttgggcaggattcgcgacctgttcctccacctgagaagactaaagaggatatccttcttttctttaaactttatgatccatcaaaagagaaactccggtatgttgggaggctgtttgtgaagggcagtggtaaaccattggagatcctgacaaaattaaatgaaatggctggctttgctcctgaccaggagattgaactttatgaggaaataaaatttgaacctaatgtcatgtgtgaacacattgacaagaggctcacttttcgttctagccagcttgaagatggagatattgtttgctttcagaaaccccctcaaatgggaagcaatgaacagtgccgctaccctgatgtgccttcattcctcgagtatatgcacaatcgccaggtatgccatgttttcattctgcttgctggctgcttggcatgtggtgtaatggcacattttcaaaccatagttgtcagacttggcacgaaaagaggccgggtaactggttctaccaggcagtctcaggagttgaatacagcatcagcaaagaatctgaatgaagaagacctaaattggcatagaaaacctaactcgactagatacagtgatgagaaatcaaatggagatgaacttgaatgcttaaccaagttagtattggtcttgacctggtttcactgggatacctggtctgggtcgctaaaaaccctgccaggtcacctgggtttttctggtgaatgtcttggacagttaaaatggaaacccagatgggtccatggctcgagtctctgggttgttcgatttcgatctttggagaaatcaaaagaggatgaattttgtcttgagctatcaaagctccacacttatgatgatgttgtggaaagagtagctaaccatcttggcttggatgacccatccaaaattaggcttacatcccataactgttactcccagcaacctaaacctcaacccatcaagtaccggggagtggatcatttatctgatatgctggtgcactacaatcagacatctgatattctatactatgaagtattggacatccctcttccagaactgcaaggccttaaaacattaaaggttgcatttcatcatgctaccaaggatgaggtagtgattcataccatcagattgccaaaacagagcactgtaggtgatgtcatcaatgaccttaagacaaaggtggagctgtctcatcccagtgctgaacttagattgcttgaggttttctatcacaagatctacaagtatgcaacctcatcttttcagatctttccacataatgaaaaaatcgagaacattaatgatcaatactggacactacgtgcagaggagatacctgaagaagagaaaaaccttggtcctcatgatcgtttgattcatgtatatcatttcatgaaagacacaactcaaaaccaggtggttcagaattttggagaaccatttttcctggtcattcatgagggcgaggctttagctgacgtcaaaatgcgtgtacagagaaaattgcaggttcctgatgaagaattttcaaagtggaagtttgcatttttgtcactaggtcgccccgagtaccttcaagactcagacattgtgtccaatcgttttcagagaagggacatttatggtgcctgggagcaatatcttggactcgagcattctgacaatgctcccaaaaggtcatatgctgctaatcagaatcgtcatacatttgagaagccggtaaaaatctacaattag

SEQ ID NO: 3809 - protein, 1215 aa, Populus balsamifera subsp. trichocarpa
  misc_feature (1)..(1215): useful for making plants with increased salt and oxidative stress resistance as described in USSN 12/922,143
  misc_feature (1)..(1215): Ceres ANNOT ID no.1518676
  misc_feature (1)..(1215): Bit score of 879.2 for HMM based on sequences of FIGURE 10 of USSN 12/922,143.
  misc_feature (29)..(149): Pfam Name: MATH Pfam Description: MATH domain
  misc_feature (1)..(1215): Functional Homolog Of Ceres SEEDLINE ID no. ME03280
MEVAQAETATAVDAQSVDDPPSARFTWTIDNFSRFNTKKLYSDVFVVGGYKWRILVFPKGNNVDHLSMYLDVADSTNLPYGWSRYAQFSLTVINQLHQKYSIRKDTQHQFNARESDWGFTSFMPLGELYDPGRGYLVNDSCIVEADVAVRRVIDYWSHDSKKETGYVGLKNQGATCYMNSLLQTLYHIPYFRKAVYHMPTTENDIPSGSIPLALQSLFYKLQYSDTSVATKELTKSFGWDTYDSFMQHDVQELNRVLSEKLEDKMKIFVTEDNSKLSEIHLVDLMEFYIYIYIIVDLQLDVKGCRDVYASFDKYVEVERLEGDNKYHAEQHGLQDARKGVLFIDFPPVLQLQLKRFEYDFMRDTMVKINDRYEFPLQLDLDRENGKYLSPEADCSVRNLYTLHSVLVHSGGVHGGHYYAYIRPTLSDQWFKFDDERVTKEDVKRALEEQYGGEEELPQTNPGFNNSPFKFTKYSNAYMLVYIRESDKEKVICNVDEKDIAEHLRIRLKKEQEEKEQKRKEKAEAHLYTIIKVARSEDLLEQIGKDVYFDLVDHDKVRSFRIQKQITFNLFKEEVAKEFGIPVQFQRFWLWAKRQNHTYRPNRPLTPQEESQSVGQLREVSNKANNAELKLFLEVEVGQDSRPVPPPEKTKEDILLFFKLYDPSKEKLRYVGRLFVKGSGKPLEILTKLNEMAGFAPDQEIELYEEIKFEPNVMCEHIDKRLTFRSSQLEDGDIVCFQKPPQMGSNEQCRYPDVPSFLEYMHNRQVCHVFILLAGCLACGVMAHFQTIVVRLGTKRGRVTGSTRQSQELNTASAKNLNEEDLNWHRKPNSTRYSDEKSNGDELECLTKLVLVLTWFHWDTWSGSLKTLPGHLGFSGECLGQLKWKPRWVHGSSLWVVRFRSLEKSKEDEFCLELSKLHTYDDVVERVANHLGLDDPSKIRLTSHNCYSQQPKPQPIKYRGVDHLSDMLVHYNQTSDILYYEVLDIPLPELQGLKTLKVAFHHATKDEVVIHTIRLPKQSTVGDVINDLKTKVELSHPSAELRLLEVFYHKIYKYATSSFQIFPHNEKIENINDQYWTLRAEEIPEEEKNLGPHDRLIHVYHFMKDTTQNQVVQNFGEPFFLVIHEGEALADVKMRVQRKLQVPDEEFSKWKFAFLSLGRPEYLQDSDIVSNRFQRRDIYGAWEQYLGLEHSDNAPKRSYAANQNRHTFEKPVKIYN

SEQ ID NO: 3810 - DNA, 3813 bp, Populus balsamifera subsp. trichocarpa
  misc_feature (1)..(3813): useful for making plants with increased salt and oxidative stress resistance as described in USSN 12/922,143
  misc_feature (1)..(3813): Ceres ANNOT ID no.1465343
atgcaacaagaagacgatgagatgttggtcccacacactgaatttactgagggacctcagcctatggaagtagcacaagcagaaacagcgacggcagttgatgcacagtcagtggatgatccaccatcagctaggtttacatggacaattgataatttttcgaggtttaatactaagaagctttactccgatgtttttgttgttggaggctacaagtggcggatactggtttttccaaaggggaacaatgtggatcatttatccatgtatttagatgttgcagattcaactaatttgccatatgggtggagtcgatatgcgcagtttagcttgactgtcatcaatcaacttcaccaaaaatattcaattcggaaagacacgcagcaccagttcaatgcacgtgagagtgattggggcttcacttcatttatgccacttggggaattgtatgaccctgggagagggtatcttgtaaatgactcatgcatagttgaagctgatgttgctgttcgtagggttattgattactggtcacatgattcaaaaaaggagaccggttatgttggtctcaagaaccaaggagctacatgctacatgaactctctccttcaaacgctgtatcatattccttattttagaaaggctgtatatcatatgccaacaactgagaatgatatcccatcagggagcattccactggcgttgcagagtttgttttataaacttcaatacagtgacactagtgtagcaacaaaagagttgacaaagtctttcggctgggatacatatgactctttcatgcagcatgatgtccaagaacttaatagggttctttctgaaaagcttgaagataaaatgaagggaactgtcgtggagggcactatacaacagttatttgaagggcaccatatgaattatattgaatgcatcaatgttgactataagtcgacaagaaaggagtcattttatgatcttcagcttgatgtcaaaggctgtcgggatgtttatgcttcttttgataagtatgtggaggtggaacgtcttgaaggtgacaataaatatcatgctgaacaacatggattacaggatgctaggaagggtgtcctattcattgacttcccccctgttctccaacttcaacttaaaaggtttgagtatgattttatgcgggatacgatggtgaagataaatgatcgctatgagttccctttgcaacttgatctggatagagagaatggaaaatatttatcacctgaggccgactgcagtgtccgcaatctctacacccttcacagtgttttggttcacagtggcggcgtgcatggtggacactactatgcttatatcagaccaactctatcagatcagtggttcaaatttgatgatgagcgggtaaccaaagaggatgtgaaaagggcattagaggagcagtatggtggtgaggaagagttaccacagacaaatcctggctttaacaactctcccttcaagtttacaaaatactcgaatgcttatatgcttgtgtatatacgtgaaagtgacaaggaaaaagtaatctgtaatgtggatgagaaggatattgcagagcacctcaggataagactgaagaaagaacaggaagagaaagagcaaaagagaaaggaaaaagctgaggcccacttgtacactatcataaaggttgcacgtagtgaggatctacttgaacagattggcaaagatgtatattttgatctcgtggatcatgacaaagttcgtagtttccgtatccagaaacaaataacctttaaccttttcaaggaagaagttgctaaagaatttggtattccagtgcaatttcaacgtttttggctgtgggcaaaacgacaaaatcatacataccgtccaaatcggccactgactcctcaggaggaatcacaatctgttggacaattgagagaggtttctaataaggcaaataatgcagagctgaagttgtttctggaagtagaagttgggcaggattcgcgacctgttcctccacctgagaagactaaagaggatatccttcttttctttaaactttatgatccatcaaaagagaaactccggtatgttgggaggctgtttgtgaagggcagtggtaaaccattggagatcctgacaaaattaaatgaaatggctggctttgctcctgaccaggagattgaactttatgaggaaataaaatttgaacctaatgtcatgtgtgaacacattgacaagaggctcacttttcgttctagccagcttgaagatggagatattgtttgctttcagaaaccccctcaaatgggaagcaatgaacagtgccgctaccctgatgtgccttcattcctcgagtatatgcacaatcgccaggtatgccatgttttcattctgcttgctggctgcttggcatgtggtgtaatggcacattttcaaaccatagttgtcagacttggcacgaaaagaggccgggtaactggttctaccaggcagtctcaggagttgaatacagcatcagcaaagaatctgaatgaagaagacctaaattggcatagaaaacctaactcgactagatacagtgatgagaaatcaaatggagatgaacttgaatgcttaaccaagttagtattggtcttgacctggtttcactgggatacctggtctgggtcgctaaaaaccctgccaggtcacctgggtttttctggtgaatgtcttggacagttaaaatggaaacccagatgggtccatggctcgagtctctgggttgttcgatttcgatctttggagaaatcaaaagaggatgaattttgtcttgagctatcaaagctccacacttatgatgatgttgtggaaagagtagctaaccatcttggcttggatgacccatccaaaattaggcttacatcccataactgttactcccagcaacctaaacctcaacccatcaagtaccggggagtggatcatttatctgatatgctggtgcactacaatcagacatctgatattctatactatgaagtattggacatccctcttccagaactgcaaggccttaaaacattaaaggttgcatttcatcatgctaccaaggatgaggtagtgattcataccatcagattgccaaaacagagcactgtaggtgatgtcatcaatgaccttaagacaaaggtggagctgtctcatcccagtgctgaacttagattgcttgaggttttctatcacaagatctacaagtatgcaacctcatcttttcagatctttccacataatgaaaaaatcgagaacattaatgatcaatactggacactacgtgcagaggagatacctgaagaagagaaaaaccttggtcctcatgatcgtttgattcatgtatatcatttcatgaaagacacaactcaaaaccaggtggttcagaattttggagaaccatttttcctggtcattcatgagggcgaggctttagctgacgtcaaaatgcgtgtacagagaaaattgcaggttcctgatgaagaattttcaaagtggaagtttgcatttttgtcactaggtcgccccgagtaccttcaagactcagacattgtgtccaatcgttttcagagaagggacatttatggtgcctgggagcaatatcttggactcgagcattctgacaatgctcccaaaaggtcatatgctgctaatcagaatcgtcatacatttgagaagccgagtagtctggtttcacatcgaagtgtttgggtaacatatgcgatcgagattgaaagtgaatctccaggccatcatctcaaccatttgtcggtggactag

SEQ ID NO: 3811 - protein, 1249 aa, Populus balsamifera subsp. trichocarpa
  misc_feature (1)..(1249): useful for making plants with increased salt and oxidative stress resistance as described in USSN 12/922,143
  misc_feature (1)..(1249): Ceres ANNOT ID no.1465343
  misc_feature (1)..(1249): Bit score of 1007.7 for HMM based on sequences of FIGURE 10 of USSN 12/922,143.
  misc_feature (29)..(149): Pfam Name: MATH Pfam Description: MATH domain
  misc_feature (1)..(1249): Functional Homolog Of Ceres SEEDLINE ID no. ME03280
MEVAQAETATAVDAQSVDDPPSARFTWTIDNFSRFNTKKLYSDVFVVGGYKWRILVFPKGNNVDHLSMYLDVADSTNLPYGWSRYAQFSLTVINQLHQKYSIRKDTQHQFNARESDWGFTSFMPLGELYDPGRGYLVNDSCIVEADVAVRRVIDYWSHDSKKETGYVGLKNQGATCYMNSLLQTLYHIPYFRKAVYHMPTTENDIPSGSIPLALQSLFYKLQYSDTSVATKELTKSFGWDTYDSFMQHDVQELNRVLSEKLEDKMKGTVVEGTIQQLFEGHHMNYIECINVDYKSTRKESFYDLQLDVKGCRDVYASFDKYVEVERLEGDNKYHAEQHGLQDARKGVLFIDFPPVLQLQLKRFEYDFMRDTMVKINDRYEFPLQLDLDRENGKYLSPEADCSVRNLYTLHSVLVHSGGVHGGHYYAYIRPTLSDQWFKFDDERVTKEDVKRALEEQYGGEEELPQTNPGFNNSPFKFTKYSNAYMLVYIRESDKEKVICNVDEKDIAEHLRIRLKKEQEEKEQKRKEKAEAHLYTIIKVARSEDLLEQIGKDVYFDLVDHDKVRSFRIQKQITFNLFKEEVAKEFGIPVQFQRFWLWAKRQNHTYRPNRPLTPQEESQSVGQLREVSNKANNAELKLFLEVEVGQDSRPVPPPEKTKEDILLFFKLYDPSKEKLRYVGRLFVKGSGKPLEILTKLNEMAGFAPDQEIELYEEIKFEPNVMCEHIDKRLTFRSSQLEDGDIVCFQKPPQMGSNEQCRYPDVPSFLEYMHNRQVCHVFILLAGCLACGVMAHFQTIVVRLGTKRGRVTGSTRQSQELNTASAKNLNEEDLNWHRKPNSTRYSDEKSNGDELECLTKLVLVLTWFHWDTWSGSLKTLPGHLGFSGECLGQLKWKPRWVHGSSLWVVRFRSLEKSKEDEFCLELSKLHTYDDVVERVANHLGLDDPSKIRLTSHNCYSQQPKPQPIKYRGVDHLSDMLVHYNQTSDILYYEVLDIPLPELQGLKTLKVAFHHATKDEVVIHTIRLPKQSTVGDVINDLKTKVELSHPSAELRLLEVFYHKIYKYATSSFQIFPHNEKIENINDQYWTLRAEEIPEEEKNLGPHDRLIHVYHFMKDTTQNQVVQNFGEPFFLVIHEGEALADVKMRVQRKLQVPDEEFSKWKFAFLSLGRPEYLQDSDIVSNRFQRRDIYGAWEQYLGLEHSDNAPKRSYAANQNRHTFEKPSSLVSHRSVWVTYAIEIESESPGHHLNHLSVD

SEQ ID NO: 3812 - DNA, 3327 bp, Populus balsamifera subsp. trichocarpa
  misc_feature (1)..(3327): useful for making plants with increased salt and oxidative stress resistance as described in USSN 12/922,143
  misc_feature (1)..(3327): Ceres ANNOT ID no.1507750
atgactatgatgactccttcaccgttggatcaagaagacgaggagatgctcgtgccgcattcagatttagttgaaggcccacaaccaatagaagtggcacaagtggagcaaactagtacggtggaaaatcagccagtggaggatcccccgtccatgaaatttacgtggactattgagaattttactaggttgaacacaaagaagcattattccgatgtatttattgttggcagttacaaatggcgagtactgatcttccctaaaggaaacaatgtggaccacttgtcgatgtatttggatgttgctgattctacgactttgccatatggatggagtagatatgcgcaattcagcttggccgtggtcaatcaaattcataacaagtactcaattagaaaggacacacaacatcagttcaacgcaagagagagtgactggggttttacatctttcatgcctctgagtgaactttatgatccaagtagaggatatctagtgaacgatacagttgttattgaagctgaagttgctgtccgtaagcttctagattattggtcctatgactcgaagaaggagacaggctatgtaggactgaagaaccagggagcaacatgttacatgaactctctcctacagactcagtaccatattccttacttccgaaaggctgtgtaccacatgccaacaactgagaatgacatgcctacaggaagcattccattggccctgcagagtttattctataagcttcaatataatgataccagtgttgcaacaaaggaactgaccaaatcttttggctgggatacatatgattccttcatgcaacatgatgtgcaagaactcaacagagtcctatgtgagaagctagaggataaaatgaaggggactgttgtggaggggactatacagcagttgtttgagggtcaccatatgaactacattgagtgcatcaatgtggactacaaatctacaaggaaggagtcattttacgatctccagcttgatgtgaaaggttgtcgagatgtttatgcttcttttgacaaatatgtggaagttgaacggcttgagggtgataacaaataccatgctgaagaacatggtttgcaggatgcaaagaagggtgtcttgtttattgacttcccccctgttcttcaactccaattaaagcgttttgaatatgattttatgcgtgacaccatggtgaagattaatgatcgctatgaatttcctcttcaacttgacctggatagggagaatgggaaatatttatcacctgatgcagacaggagtgttcgcaatctatacacacttcacagcgttttggttcatagcggaggggtgcatggtggacattattatgcttttatcaggccaaccctctctgatcagtggttcaaatttgatgatgaacgggtgacaaaagaagatatgaagagggcattagaagaacagtatggtggtgaggaagagctacctcagaccaatcctggctttaacaatactccatttaaattcacaaaatactcaaatgcatacatgcttgtgtatatacgggaaagtgacaaggacaagataatttgtaatgtcgatgagaaagatattgctgaacacttgaggataaggctgaagaaagaacaagaagaaaaagaagacaagagaagatataaagcacaagctcacctttacacaattataaaggtcgcacgagatgaggaccttaaagagcaaattggaaaggatatttattttgaccttgtggatcatgacaaagtccataacttccggattcagaaacagatgcagtttagtctttttaaggaggaggttgctaaagagtttggtataccagtacaatttcagcgattttggatatgggcaaagcgccaaaaccacacatataggccaaatcgatcattgacaccccaggaagaagttggacagctgagagaggtgtcaaataagacgcataatgctgaattaaaattgttcttggaaatcgagcttggactggatttacgtcccattgcgccacctgaaaaaactaaagaagatattctgcttttcttcaagctttatgaccctgaaaaacaagaattgcggcttttcgtgaagagttctggcaagccaatagaaattctagcaaagctcaatcaaatggctggctttccacccgatgaagagattgaactttatgaggaaatcaagttcgagccttgtgtcatgtgtgaacatcttgataatagggcctcatttcgaataagtcagatcgaagatggggacataatatgctttcagaaatctcctcctcttgaaaaggaagaagaatgtcgatatccagatgtgccttcatatttggaatatgtgcacaatcgacagatagttcatttccgatctctggaaaagccgaaggaggatgatttttgtctagagttgtcgaaggtacatacttatgatgatgttgtcgaaagagtggcccgccaaattggcctggatgatccatccaaaatcaggttgacatcccacaactgctactctcagcagcctaagccgcaaccaattaaatatcgaggagtggagcatctatcagatatgttagttcactacaatcagacttctgatatcttgtattacgaagttctggatattcctcttccagaattgcaaggtctaaaaaatttgaaagttgctttccatcatgctattaaagacgaagtggtaattcataacattagattgcctaaacaaagcaccgtgggagatgtgattaatgaacttaaaacgaaggtagaattgtctcacccaaatgctgaacttcgactgcttgaagttttctatcacaagatttataagatctttccacccaatgaaaaaatcgagaatataaatgatcagtattggacattacgggcagaggagatccctgaggaagaaaaaaatcttggtccccaagatcgcctgattcacgtgtatcacttcacaaaagagtctggacagaatcaaatgcaagtacagaattttggtgaaccctttttcttggtcatccatgaaggtgaaactttagctcaagttaaaatgcgcatacaaaagaaactgcaggtccctgacgaggagtttgcaaagtggaaatttgcatttctgtcgctgggtcgtccagagtacttgcaggattctgatgttgtgttcacccgctttcagagaagagatgtttatggcgcttgggagcagtaccttggcttggagcaccctgataatactcctaaaaggtcttatgcagttaatcagaaccgccacacatttgagaagccagttaaaatatacaattag

SEQ ID NO: 3813 - protein, 1105 aa, Populus balsamifera subsp. trichocarpa
  misc_feature (1)..(1105): useful for making plants with increased salt and oxidative stress resistance as described in USSN 12/922,143
  misc_feature (1)..(1105): Ceres ANNOT ID no.1507750
  misc_feature (1)..(1105): Bit score of 1098.6 for HMM based on sequences of FIGURE 10 of USSN 12/922,143.
  misc_feature (55)..(175): Pfam Name: MATH Pfam Description: MATH domain
  misc_feature (1)..(1105): Functional Homolog Of Ceres SEEDLINE ID no. ME03280
MTPSPLDQEDEEMLVPHSDLVEGPQPIEVAQVEQTSTVENQPVEDPPSMKFTWTIENFTRLNTKKHYSDVFIVGSYKWRVLIFPKGNNVDHLSMYLDVADSTTLPYGWSRYAQFSLAVVNQIHNKYSIRKDTQHQFNARESDWGFTSFMPLSELYDPSRGYLVNDTVVIEAEVAVRKLLDYWSYDSKKETGYVGLKNQGATCYMNSLLQTQYHIPYFRKAVYHMPTTENDMPTGSIPLALQSLFYKLQYNDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERVTKEDMKRALEEQYGGEEELPQTNPGFNNTPFKFTKYSNAYMLVYIRESDKDKIICNVDEKDIAEHLRIRLKKEQEEKEDKRRYKAQAHLYTIIKVARDEDLKEQIGKDIYFDLVDHDKVHNFRIQKQMQFSLFKEEVAKEFGIPVQFQRFWIWAKRQNHTYRPNRSLTPQEEVGQLREVSNKTHNAELKLFLEIELGLDLRPIAPPEKTKEDILLFFKLYDPEKQELRLFVKSSGKPIEILAKLNQMAGFPPDEEIELYEEIKFEPCVMCEHLDNRASFRISQIEDGDIICFQKSPPLEKEEECRYPDVPSYLEYVHNRQIVHFRSLEKPKEDDFCLELSKVHTYDDVVERVARQIGLDDPSKIRLTSHNCYSQQPKPQPIKYRGVEHLSDMLVHYNQTSDILYYEVLDIPLPELQGLKNLKVAFHHAIKDEVVIHNIRLPKQSTVGDVINELKTKVELSHPNAELRLLEVFYHKIYKIFPPNEKIENINDQYWTLRAEEIPEEEKNLGPQDRLIHVYHFTKESGQNQMQVQNFGEPFFLVIHEGETLAQVKMRIQKKLQVPDEEFAKWKFAFLSLGRPEYLQDSDVVFTRFQRRDVYGAWEQYLGLEHPDNTPKRSYAVNQNRHTFEKPVKIYN

SEQ ID NO: 3814 - protein, 1148 aa, Oryza sativa subsp. indica
  misc_feature (1)..(1148): useful for making plants with increased salt and oxidative stress resistance as described in USSN 12/922,143
  misc_feature (1)..(1148): Public GI ID no.125534834
  misc_feature (1)..(1148): Bit score of 920.4 for HMM based on sequences of FIGURE 10 of USSN 12/922,143.
  misc_feature (61)..(181): Pfam Name: MATH Pfam Description: MATH domain
  misc_feature (1)..(1148): Functional Homolog Of Ceres SEEDLINE ID no. ME03280
MTMMTPPPLEPEEDEMLVPHQELVAADAAQPMEVVAQTEAASTAESQPAEDPQTSRFTWTIENFTRINAKKHYSDAFVVGGYKWRVLIFPKGNNVDHFSMYLDVADSANLPYGWSRYAQFSLAVVNQIQQKYTIRKDTQHQFNARESDWGFTSFMPLSELYDPSRGYLVDDTVVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKVTNLRTVVEGTIEKLFEGHHINYIECINVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLVQMQIELMVISYHLSKEVCGVRLPEENHMPYALLLYKFDDERVTKEDTKKALEEQYGGEEELPQINPGFNNAPFKFTKYSNAYMLVYIRESDKDKIMCNVDEKDIAEHLRVRLKKEQEEKEHKKKEKAEAHLYTIIKVARDENLKEQIGKDIYFDLVDHEKVRSFRIQKQLPFTTFKEEVAKEYGIPVQFQRFWLWAKRQNHTYRPNRPLSPHEETQSVGQLREVSNKAHNAELKLFLEVELGPDLRPLPPPEKSKEDILLFFKLYNPEKEELCFVGRLFVKALGKPSEILTKLNEMAGFVPNEEVELYEARAKFMMLYLWDNLVYVTPLRRVLGEIKFEPNVMCEHIDKKATFRASQLEDGDIICFQKSPIPDSDTQMRYPDVPSYLEYVHNRQVQGVYFLSVVHFRLLEKPKDDDFSLELSKLHTYDDVVERVARQLGVDDPAKIRLTSHNCYSQQPKPQPIRYRGVEHLLDMLIHYNQTSDILYYEVLDIPLPELQGLKTLKVAFHHATKDEVVIHSIRLPKNSTIADVINDLKTKVELSSPSAELRLLEVFYHKIYKIFPLHEKIENINDQYWTLRAEEIPEEEKNLGPNDRLIHVYHFMKDPLQNQQIQNFGDPFYLAIREGETLAEVKERIQKKLQVPDEEFCKWKFAFISMNRPDYLQDSDVVSARFQRRDVYGAWEQYLGLEHADTAPKRAYTANQNRHTYEKPVRIYN

SEQ ID NO: 3815 - protein, 1397 aa, Oryza sativa subsp. japonica
  misc_feature (1)..(1397): useful for making plants with increased salt and oxidative stress resistance as described in USSN 12/922,143
  misc_feature (1)..(1397): Public GI ID no.125577575
  misc_feature (1)..(1397): Bit score of 965.3 for HMM based on sequences of FIGURE 10 of USSN 12/922,143.
  misc_feature (61)..(181): Pfam Name: MATH Pfam Description: MATH domain
  misc_feature (1)..(1397): Functional Homolog Of Ceres SEEDLINE ID no. ME03280
MTMMTPPPLEPEEDEMLVPHQELVAADAAQPMEVVAQTEAASTAESQPAEDPQTSRFTWTIENFTRINAKKHYSDAFVVGGYKWRVLIFPKGNNVDHFSMYLDVADSANLPYGWSRYAQFSLAVVNQIQQKYTIRKDTQHQFNARESDWGFTSFMPLSELYDPSRGYLVDDTVVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKVTNLRTVVEGTIEKLFEGHHINYIECINVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLAPDADRSIRNLYALHRYKFDDERVTKEDTKKALEEQYGGEEELPQINPGFNNAPFKFTKYSNAYMLVYIRESDKDKIMCNVDEKDIAEHLRVRLKKEQEEKEHKKKEKAEAHLYTIIKVARDENLKEQIGKDIYFDLVDHEKVRSFRIQKQLLFTTFKEEVAKEYGIPVQFQRFWLWAKRQNHTYRPNRPLSPHEETQSVGQLREVSNKAHNAELKLFLEVELGPDLRPLPPPEKSKEDILLFFKLYNPEKEELCFVGRLFVKALGKPSEILTKLNEMAGFVPNEEIELYEARAKFMMLYLWDNLVYVTPLRRVLGEIKFEPNVMCEHIDKKATFRASQLEDGDIICFQKSPIPDSDTQMRYPDVPSYLEYVHNRQVVHFRLLEKPKDDDFSLEMSKLHTYDDVVERVARQLGVDDPAKIRLTSHNCYSQQPKPQPIRYRGVEHLLDMLIHYNQTSDILYYEVLDIPLPELQGLKTLKVAFHHATKDEVVIHSIRLPKNSTIADVINDLKTKVELSSPSAELRLLEVFYHKIYKIFPLHEKIENINDQYWTLRAEEIPEEEKNLGPNDRLIHVYHFMKDPLQNQQIQNFGDPFYLAIREGETLAEVKERIQKKLQVPDEEFCKWKFAFISMNRPDYLQDSDVVSARFQRRDVYGAWEQYLGLEHADTAPKRAYTANQKKLTRITAAVSAALGSVIVIADEIFASTYILTILSKKLYLMSRIKFGVTRSIFFSRHYDLNKAPVHLTLQLPTSPMDNPTPSSSSGGGGAAAAANASSDEHRKTSPATAADFFDEEHTFDDILLPVDLFDFTHGLDAGDGCYIENIFHHLNGQEMIPQSIRPQPTNLVRPITVPEDFDRFAALTRYREKKRNIKFIKKADYSARKEVALRMKRSKGKFAPRVQTSENSLAHRKGITFCTNCGESSDATPMMRHAPNGTKSFCNACGLMWANSRKIRKIRNPTSGEQEDQ

SEQ ID NO: 3816 - protein, 1451 aa, Oryza sativa subsp. japonica
  misc_feature (1)..(1451): useful for making plants with increased salt and oxidative stress resistance as described in USSN 12/922,143
  misc_feature (1)..(1451): Public GI ID no.77551602
  misc_feature (1)..(1451): Bit score of 965.3 for HMM based on sequences of FIGURE 10 of USSN 12/922,143.
  misc_feature (61)..(181): Pfam Name: MATH Pfam Description: MATH domain
  misc_feature (1)..(1451): Functional Homolog Of Ceres SEEDLINE ID no. ME03280
MTMMTPPPLEPEEDEMLVPHQELVAADAAQPMEVVAQTEAASTAESQPAEDPQTSRFTWTIENFTRINAKKHYSDAFVVGGYKWRVLIFPKGNNVDHFSMYLDVADSANLPYGWSRYAQFSLAVVNQIQQKYTIRKDTQHQFNARESDWGFTSFMPLSELYDPSRGYLVDDTVVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKVTNLRTVVEGTIEKLFEGHHINYIECINVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLAPDADRSIRNLYALHRYKFDDERVTKEDTKKALEEQYGGEEELPQINPGFNNAPFKFTKYSNAYMLVYIRESDKDKIMCNVDEKDIAEHLRVRLKKEQEEKEHKKKEKAEAHLYTIIKVARDENLKEQIGKDIYFDLVDHEKVRSFRIQKQLLFTTFKEEVAKEYGIPVQFQRFWLWAKRQNHTYRPNRPLSPHEETQSVGQLREVSNKAHNAELKLFLEVELGPDLRPLPPPEKSKEDILLFFKLYNPEKEELCFVGRLFVKALGKPSEILTKLNEMAGFVPNEEIELYEARAKFMMLYLWDNLVYVTPLRRVLGEIKFEPNVMCEHIDKKATFRASQLEDGDIICFQKSPIPDSDTQMRYPDVPSYLEYVHNRQVVHFRLLEKPKDDDFSLELSKLHTYDDVVERVARQLGVDDPAKIRLTSHNCYSQQPKPQPIRYRGVEHLLDMLIHYNQTSDILYYEVLDIPLPELQGLKTLKVAFHHATKDEVVIHSIRLPKNSTIADVINDLKTKVELSSPSAELRLLEVFYHKIYKIFPLHEKIENINDQYWTLRAEEIPEEEKNLGPNDRLIHVYHFMKDPLQNQQIQNFGDPFYLAIREGETLAEVKERIQKKLQVPDEEFCKWKFAFISMNRPDYLQDSDVVSARFQRRDVYGAWEQYLGLEHADTAPKRAYTANQKKLTRITAAVSAALGSVIVIADEIFASTYILTILSKKLYLMSRIKFGVTRSIFFSRHYDLNKAPVHLTLQLPTSPMDNPTPSSSSGGGGAAAAANASSDEHRKTSPATAADFFDEEHTFDDILLPVDLFDFTHGLDAGDGCYVDDQAAIGQKPLSPAPEPAAEQQPSPAPEHGDDERLVMYYQGQEYIFDPVQPQKIENIFHHLNGQEMIPQSIRPQPTNLVRPITVPEDFDRFAALTRYREKKRNIKFIKKADYSARKEVALRMKRSKGKFAPRVQTSENSLAHRKGITFCTNCGESSDATPMMRHAPNGTKSFCNACGLMWANSRKIRKIRNPTSGEQEDQ

SEQ ID NO: 3817 - protein, 1051 aa, Oryza sativa subsp. indica
  misc_feature (1)..(1051): useful for making plants with increased salt and oxidative stress resistance as described in USSN 12/922,143
  misc_feature (1)..(1051): Public GI ID no.125536666
  misc_feature (1)..(1051): Bit score of 939.0 for HMM based on sequences of FIGURE 10 of USSN 12/922,143.
  misc_feature (52)..(172): Pfam Name: MATH Pfam Description: MATH domain
  misc_feature (1)..(1051): Functional Homolog Of Ceres SEEDLINE ID no. ME03280
MLVPHQELPAAAAAVVADAVQPMEVVAQTEPANAAESQPPEDPQTSRFTWTIENFTRINGKKHYSEPFVVGGFKWRVLIFPKGNNVDHFSMYLDVADSVNLPYGWNRYAQFSLAVVNQIHPKYTIRKDTQHQFNARESDWGFTSFMPLSDLYDPSRGYLVNDTVVVEAEVAVRRMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKETVVEGTIEQLFEGHHINYIECINVDYKSNRKESFYDLQLDVKGCRDVYASFDKYVEVERLEGDNKYHAEQYGLQDAKKGVLFLDFPPVLQLQLKRFEYDYMRDTMVKINDRYEFPLQLDLDRDDGKYLAPDADRSIRNLYTLHRYKFDDERVTKEDTKKALEEQYGGEEELPQINPGFNNTPFKFTKYSNAYMLVYIRESDKDKIMCNVDEKDIAEHLRIRLKKEQEEKEHKKKEKAEAHLYTIIKVARDEDLKEQIGKNIYFDLVDHEKVRSFRIQKQLPFTSFKEEVAKECGIPVQFQRFWLWAKRQNHTYRPNRPLGPHEESQSVGQLREVSNKAHNAELKLFLEVETGVDLRPIRPPEKSKEDILLFFKLYNPEKEELCFVGRLFVKATGKPSEILTKLNEMAGFAPNEEIELYEEIKFEPNVMCEHIDKKLTFRSSQLEDGDIICFQKSPVLDGETQVRYPDVPSFLEYVHNRQVVHFRSLEKPKEDDFCLELSKLHTYDDVVERVARQLGLDDPSKIRLTSHNCYSQQPKPQPIRYRGVEHLLDMLVHYNQTSDILYYEVLDIPLPELQCLKTLKVAFHHATKDEVVIHSIRLPKNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLLVIREGETAAEILERIQKKLRVPDEEFSKRRDVYGAWEQYLGLEHTDTTPKRSYTANQCCMCLD

SEQ ID NO: 3818 - DNA, 3348 bp, Populus balsamifera subsp. trichocarpa
  misc_feature (1)..(3348): useful for making plants with increased salt and oxidative stress resistance as described in USSN 12/922,143
  misc_feature (1)..(3348): Ceres ANNOT ID no.1528487
atgactatgatgactccttcaccgttagaccaagaagacgaggagatgctcgtaccgcattcagatttagttgaaggtcctcagccaatggaagtagtggcacaagtggagcaaactagtaccgtggagaatcagcctgtggaggatcctccatcgatgaaatttacttggactattgagaattttactaggttgaacacgaagaagcattattctgatatatttattgttggcagttacaaatggagagtactgatattccctaaaggaaacaacgtggaccacctgtcgatgtatttggatgttgcagattcgacagctttgccatatggatggagtagatatgcgcaattcagtttggctgtggtcaatcaaattcataacaaatactcgattagaaaggacacacaacatcagttcaatgcaagagagagtgactggggctttacatctttcatgcctctgagtgaactttatgatcctagcagaggatacttagtgaatgatacagttgttattgaagctgaagttgctgtttgcaaggttttagattattggtcctatgactcaaagaaggagacgggctatgtaggactgaaaaaccaaggagcaacatgttacatgaactctctcctacagactctataccatatttcctacttccgaaaggcggtgtaccacatgccaacaactgagaatgacatgcctacaggaagcattccattggccctgcagagtttattctttaagcttcaatataatgataccagtgttgcaacaaaggaactgaccaaatcttttggctgggatacgtatgattccttcatgcaacatgacgtgcaagagcttaacagggtcctgtgtgagaagctagaggataaaatgaaggggactgttgtggagggcactatacagcagttgtttgagggtcaccatatgaactacattgagtgcatcaatgtggaatacaaatctacaagaaaggagtcattttatgatcttcagcttgatgtgaaaggttgtcgagatgtttatgcttcttttgacaaatatgtggaagttgaacgacttgagggtgataacaaatatcatgccgaagaacatggtttgcaggatgcaaagaagggtgtcttatttatcgacttcccgcctgttcttcaactccaattaaagcggtttgaatatgattttatgcgcgatactatggtgaagattaatgatcgctatgaatttcctcttcaacttgacctggacagggagaatgggaaatatttatcacctgaatctgacaggagtgtgcgaaatctatacacacttcacagtgttttggttcacagtggaggtgtgcatggtggacattattatgcttttatcaggcctaccctctctgatcaatggttcaaatttgatgatgaacgcgtgacaaaggaagatgtgaagagggccttagaagaacagtatggtggtgaggaagagctacctcagaccaatcctggctttaacaatactccatttaaattcacaaaatactcaaatgcatacatgcttgtgtatatacgggaaagtgacaaggacaagataatttgtaatgttgatgagaaagacattgctgaacacttgaggataaggctgaagaaagaacaagaagaaaaggaagacaagagaagatataaagcacaagctcacctttacacaattataaaggttgcgcgagatgaggaccttaaagagcaaattggaaaggatatttattttgaccttgtggatcatgacaaagtccgtaacttccgtattcagaaacagacgcagtttagtctgtttaaggaggaggttgctaaagagcttggtataccagtacaatttcagagattttggatatgggcaaagcgccaaaaccacacatatagacccaatcggccattgactccccaggaggaagcacaatcagttggacaactgagagaggtgtcaaataagacgcataatgctgaattaaagttgttcttggaagttgagcttgggctggatttacgtcccattgctccacctgaaaaaactaaagaagatattctgcttttcgtcaagctttatgaccctgaaaaacaagaattacgatatgttggtaggctttttgtgaagaattctagtaaaccgatagaaattctagcaaagcttaatcaaatggctggctttgcgtctgaggaagagattgaactttatgaggaaatcaagtttgagccttgtgtcatgtgtgaacaccttgataagagagcctcatttcgaacaagtcagattgaagatggggacataatatgctttcagaaatctcctcctgaaaatgaagaagactgtcgaaatccagatgtgccttcatatttggaatatgtgcacaatcggcagatagttcatttccgatctctagagaaggcaaaagaggatgatttttgtctagagttgtcaaaattacacacttatgatgatgttgtcgaaagagtagctcgccagattggtttggacgatccatccaaaatcaggttaacatcccacaactgctactctcagcagcctaagccacagccaattaaatatcgaggagtggagcatctatcagatatgttagttcactacaatcagacttccgatatcttgtattatgaagttctagatattcctcttccagagttgcaaggtctaaaaaatttgaaagttgctttccatcacgctaccaaagatgaagtggtaattcataacattagattgcctaaacaaagcaccgtgggggatgtaattaatgaacttaaaactaaggtagaattgtctcacccaaatgctgaacttcgactgcttgaagtattttatcacaagatttataagatctttccacccaatgaaaaaattgagaatataaatgaccagtattggacgctgcgggcagaggagattcccgaggaagaaaaaaatcttggtccccaagatcgcctgattcacgtttatcacttcacgaaagagtctggacagaatcaaatgcaagtacagaattttggtgaaccctttttcttggccatccatgaaggtgaaaccttagccgaagttaaaatgcgtatacaaaagaagctgcaggttcctgatgaggagtttgctaagtggaaatttgcatttctgtcactgggtcgtccagagtacttgcaggattctgatgttgtgttcacccgctttcagagaagagatgtatatggtgcttgggagcagtaccttgggttggagcactctgataatactcctaaaaggtcttatgcagtaaatcagaaccgtcacacatttgagaagcctgttaaaatatacaattag

SEQ ID NO: 3819 - protein, 1112 aa, Populus balsamifera subsp. trichocarpa
  misc_feature (1)..(1112): useful for making plants with increased salt and oxidative stress resistance as described in USSN 12/922,143
  misc_feature (1)..(1112): Ceres ANNOT ID no.1528487
  misc_feature (1)..(1112): Bit score of 1100.1 for HMM based on sequences of FIGURE 10 of USSN 12/922,143.
  misc_feature (56)..(176): Pfam Name: MATH Pfam Description: MATH domain
  misc_feature (1)..(1112): Functional Homolog Of Ceres SEEDLINE ID no. ME03280
MTPSPLDQEDEEMLVPHSDLVEGPQPMEVVAQVEQTSTVENQPVEDPPSMKFTWTIENFTRLNTKKHYSDIFIVGSYKWRVLIFPKGNNVDHLSMYLDVADSTALPYGWSRYAQFSLAVVNQIHNKYSIRKDTQHQFNARESDWGFTSFMPLSELYDPSRGYLVNDTVVIEAEVAVCKVLDYWSYDSKKETGYVGLKNQGATCYMNSLLQTLYHISYFRKAVYHMPTTENDMPTGSIPLALQSLFFKLQYNDTSVATKELTKSFGWDTYDSFMQHDVQELNRVLCEKLEDKMKGTVVEGTIQQLFEGHHMNYIECINVEYKSTRKESFYDLQLDVKGCRDVYASFDKYVEVERLEGDNKYHAEEHGLQDAKKGVLFIDFPPVLQLQLKRFEYDFMRDTMVKINDRYEFPLQLDLDRENGKYLSPESDRSVRNLYTLHSVLVHSGGVHGGHYYAFIRPTLSDQWFKFDDERVTKEDVKRALEEQYGGEEELPQTNPGFNNTPFKFTKYSNAYMLVYIRESDKDKIICNVDEKDIAEHLRIRLKKEQEEKEDKRRYKAQAHLYTIIKVARDEDLKEQIGKDIYFDLVDHDKVRNFRIQKQTQFSLFKEEVAKELGIPVQFQRFWIWAKRQNHTYRPNRPLTPQEEAQSVGQLREVSNKTHNAELKLFLEVELGLDLRPIAPPEKTKEDILLFVKLYDPEKQELRYVGRLFVKNSSKPIEILAKLNQMAGFASEEEIELYEEIKFEPCVMCEHLDKRASFRTSQIEDGDIICFQKSPPENEEDCRNPDVPSYLEYVHNRQIVHFRSLEKAKEDDFCLELSKLHTYDDVVERVARQIGLDDPSKIRLTSHNCYSQQPKPQPIKYRGVEHLSDMLVHYNQTSDILYYEVLDIPLPELQGLKNLKVAFHHATKDEVVIHNIRLPKQSTVGDVINELKTKVELSHPNAELRLLEVFYHKIYKIFPPNEKIENINDQYWTLRAEEIPEEEKNLGPQDRLIHVYHFTKESGQNQMQVQNFGEPFFLAIHEGETLAEVKMRIQKKLQVPDEEFAKWKFAFLSLGRPEYLQDSDVVFTRFQRRDVYGAWEQYLGLEHSDNTPKRSYAVNQNRHTFEKPVKIYN

SEQ ID NO: 3820 - protein, 1125 aa, Oryza sativa subsp. japonica
  misc_feature (1)..(1125): useful for making plants with increased salt and oxidative stress resistance as described in USSN 12/922,143
  misc_feature (1)..(1125): Public GI ID no.108862691
  misc_feature (1)..(1125): Bit score of 1076.3 for HMM based on sequences of FIGURE 10 of USSN 12/922,143.
  misc_feature (69)..(189): Pfam Name: MATH Pfam Description: MATH domain
  misc_feature (1)..(1125): Functional Homolog Of Ceres SEEDLINE ID no. ME03280
MTMMTPPPIEQQQQEDEEMLVPHQELPAAAAVVADAVQPMEVVAQTEPANAAESQPPEDPQTSRFTWTIENFTRINGKKHYSEPFVVGGFKWRVLIFPKGNNVDHFSMYLDVADSVNLPYGWNRYAQFSLAVVNQIHPKYTIRKDTQHQFNARESDWGFTSFMPLSDLYDPSRGYLVNDTVVVEAEVAVRRMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKETVVEGTIEQLFEGHHINYIECINVDYKSNRKESFYDLQLDVKGCSDVYASFDKYVEVERLEGDNKYHAEQYGLQDAKKGVLFLDFPPVLQLQLKRFEYDYMRDTMVKINDRYEFPLQLDLDRDDGKYLAPDADRSIRNLYTLHSVLVHSGGVHGGHYYAFIRPTLSDQWYKFDDERVTKEDTKKALEEQYGGEEELPQINPGFNNTPFKFTKYSNAYMLVYIRESDKDKIMCNVDEKDIAEHLRIRLKKEQEEKEHKKKEKAEAHLYTIIKVARDEDLKEQIGKNIYFDLVDHEKVRSFRIQKQLPFTSFKEEVAKECGIPVQFQRFWLWAKRQNHTYRPNRPLGPHEESQSVGQLREVSNKAHNAELKLFLEVETGVDLRPIRPPEKSKEDILLFFKLYNPEKEELCFVGRLFVKATGKPSEILTKLNEMAGFAPNEEIELYEEIKFEPNVMCEHIDKKLTFRSSQLEDGDIICFQKSPVSDGETQVRYPDVPSFLEYVHNRQVVHFRSLEKPKEDDFCLELSKLHTYDDVVERVARQLGLDDPSKIRLTSHNCYSQQPKPQPIRYRGVEHLLDMLVHYNQTSDILYYEVLDIPLPELQCLKTLKVAFHHATKDEVVIHSIRLPKNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLLVIREGETAAEILERIQKKLRVPDEEFSKWKLAFISMNRPEYLQDVDVVSARFQRRDVYGAWEQYLGLEHTDTTPKRSYTANQNRHTFEKPVKIYN

SEQ ID NO: 3821 - protein, 1108 aa, Oryza sativa subsp. japonica
  misc_feature (1)..(1108): useful for making plants with increased salt and oxidative stress resistance as described in USSN 12/922,143
  misc_feature (1)..(1108): Public GI ID no.14209584
  misc_feature (1)..(1108): Bit score of 919.3 for HMM based on sequences of FIGURE 10 of USSN 12/922,143.
  misc_feature (57)..(175): Pfam Name: MATH Pfam Description: MATH domain
  misc_feature (1)..(1108): Functional Homolog Of Ceres SEEDLINE ID no. ME03280
MVTPRAPELLQQDQDEEMLVPDQDVVVEGPQPMEDSGSTVENEQVPETSTSRFTWTIEDFSNHRKLYSDVFVVGGHKWRVLVFPTGNSVQSLSMYLDIADANEQPHGWSKYAQFSLAVINQLDSKYSLRKEAAHHFSTRESDWGFTSFMHLGDLYDPTKGYIVNDKCIIEAEVAVRKIVDFWNYDSKKETGYVGLKNQGATCYMNSLLQTLYHIPYFRKAVYHMPTTENDTPCGSIPLALQSLFCKLQHSDNSVSTKELTKSFGWDTVDSFLQHDVQELNRVLCEKLENKMKGTTVEGTIQQLFEGHHMNYIECINVDYKSTRKESFYDLALDVKGCSDVYASFDKYVEVERLEGDNKYQSEKHGLQDAKKGMLFIDFPPVLQVQLKRFEYDFVRDTMVKINDRYEFPLQLDLDKDDGKYLSPEADRRVRNLYTLHSVLVHSGGGHGGHYYAFIRPALSDIWYKFDDERVTKEDMKRALEEQYGGEEELPHTNPGLNTTPLRFTKHSNAYMLVYIRESDREKIICNLDENDIPEHLKIRLRKENEEREYKKKEKAEAHMFTALKVARDSDFAEQIGKHIYFDLVDYDNIQSLRAPKHLTINQAKVDLSKEFGIPVQSQRFWLWAKRQNHTFRPVRPLTLQEEASSIGHLTDPSNKSLNSELKLFLEVALGQENHPISVPPKTKDDILIFFKLYDPEKEELRYVGKLLVKASGKPADIVQKLQEMAGFQSDEDIELYEEVMFEPSVMCEPININDSFLSSQLEDGDIICYQKRCSPEKLDHYRCADVPSFFEYIQNRQVVHFRLLENPKDDDFTLELSKRFTYDDVVEKVANQLGLDDPSKLRLTQHLPYSQMPKSHYIKYRGLDHLSDMLRNGNQMSDILYYEILDIPLPVLQDLITLRVAFYHATNNEVSSHFIRLPKGSTMSDLIEDMKSKVELSYSDAEFRLFEVYKNKIRKVYQPSEKISVNEFNGLLCVEEVPEEEKNAGVRDRLVHVCHFIIEKQHIDYYGEPFFFLIRDGETLSDIKVRIQKKLLVSDEQFAKWKFAYIAHNRLAGEYFQDSDIVLSRFQKDVYGPWEQCLGLEHSDVTPKRSCLSNQNRNSFDKAVKIFN

SEQ ID NO: 3822 - DNA, 1913 bp, Arabidopsis thaliana
  misc_feature (1)..(1913): useful for making plants with increased salt and oxidative stress resistance as described in USSN 12/922,143
  misc_feature (1)..(1913): Ceres SEEDLINE ID no.ME06336
  misc_feature (116)..(116): r is g or a
aaagagagaagggagaggcgagggagctcaccaggagagaggggcctgtgcgtgagcattgagcaaagcaaaggaagcagtacatacatacatatttctctcgctcgctcgcagaraggcccggccggccggctccatgcaacaagggaggacgacgagcggtggcggtgggcgatgatgatgatgatgatggcgggggagcacgtgctggccgctctgggcaccctactgctggcctcgctcctgaccctggtgctgaaccacttcctgcccttgcttctgaaccccaaggcccccaggggaagcttcgggtggccgctcctcggcgagacgctcaggttcctcacgccgcacgcctccaacacgctgggcggcttcctcgaggatcactgctccaggtatgggcgggtgttcaagtcccacctgttctgcaccccgacggtggtgtcctgcgaccaggacctcaaccacttcatcctgcagaacgaggagcggctgttccagtgcagctacccgaggccgatccatggcatcctgggcaagtcctccatgctcgtcgtcctgggcgaggaccacaagcgcctcaggaacctggccctcgccctcgtcacctccaccaagctcaagcccagctacctaggcgacatcgagaagatcgcgctgcacgtcgtcggcgcatggcgacggcacggcagcagcggcggcgtcagggtcgtcgcattctgcgaggaggcaagaaagttcgcattcagtgtgatagtgaagcaggtgctggggctgtcgccagaggagccggtcactgcaaggatactggaggacttcctggccttcatgaagggactcatctccttccccctctacatcccagggaccccatatgccaaggctgtccgggcgagagagaggatatccagcactgtgaagggcatcatcaaggagcggaggagcgctgggtcatggaacaagcagggcgacttccttgacgtgctgctgtcaagcaacgagctatctgacgaggagaaagtgagctttgtgctggactccctgctgggagggtatgagaccacctcgctcctcatctccatggtcgtttatttccttggccagtctgctcaagatctggacctggttaagagggagcacgacagcataagatccaacaaaggcaaggaggagtgcttgacttcagaagactacaagaagatggaatatacccaacaagtcatcaacgaggcgctgagatgcggcaacatcgtcaagttcgtccaccggaaggcgctgaaagacgtcaaatacaaagagtatctgattccatctggctggaaggtcctaccggtcttcactgccgttcatctgaacccctcacttcatggagacgcgcagcagtttcagccctgtaggtgggagggcacaagccaagggacaagcaagaggtttacaccgttcggtggtggcccccggctctgcccaggatcagagctcgctaaagtggagactgctttcttcctccatcaccttgtcctcaattatagatggagaattgatggcgatgacattccaatggcatacccgtatgtggagtttcagagaggtctgccaatagaaatcgagccaacgtcccctgaatcttgactgtcctggagctacagccatcagttatcacaccagagagaaaaggggaaggtgcatggagtatacatgaatggtcagtgacagatctcacaagtgaaggaacactgagggcgcgtgctagtagctagcatatgaggcagctgagactgtaatttaatgtacatggtgtagatatattttgtccatggcaattgcttgaagtggctgattcacttcaccctgtaaaacattctccagtggtttcaactgctatcctataaaaaagaagggcccctgtgttt

SEQ ID NO: 3823 - DNA, 1932 bp, Arabidopsis thaliana
  misc_feature (1)..(1932): useful for making plants with increased salt and oxidative stress resistance as described in USSN 12/922,143
  misc_feature (1)..(1932): Ceres SEEDLINE ID no.ME06336
  misc_feature (1)..(1932): Inplanta Sequence
aaagagagaagggagaggcgagggagctcaccaggagagaggggcctgtgcgtgagcattgagcaaagcaaaggaagcagtacatacatacatatttctctcgctcgctcgcagagaggcccggccggccggctccatgcaacaagggaggacgacgagcggtggcggtgggcgatgatgatgatgatgatggcgggggagcacgtgctggccgctctgggcaccctactgctggcctcgctcctgaccctggtgctgaaccacttcctgcccttgcttctgaaccccaaggcccccaggggaagcttcgggtggccgctcctcggcgagacgctcaggttcctcacgccgcacgcctccaacacgctgggcggcttcctcgaggatcactgctccaggtatgggcgggtgttcaagtcccacctgttctgcaccccgacggtggtgtcctgcgaccaggacctcaaccacttcatcctgcagaacgaggagcggctgttccagtgcagctacccgaggccgatccatggcatcctgggcaagtcctccatgctcgtcgtcctgggcgaggaccacaagcgcctcaggaacctggccctcgccctcgtcacctccaccaagctcaagcccagctacctaggcgacatcgagaagatcgcgctgcacgtcgtcggcgcatggcgacggcacggcagcagcggcggcgtcagggtcgtcgcattctgcgaggaggcaagaaagttcgcattcagtgtgatagtgaagcaggtgctggggctgtcgccagaggagccggtcactgcaaggatactggaggacttcctggccttcatgaagggactcatctccttccccctctacatcccagggaccccatatgccaaggctgtccgggcgagagagaggatatccagcactgtgaagggcatcatcaaggagcggaggagcgctgggtcatggaacaagcagggcgacttccttgacgtgctgctgtcaagcaacgagctatctgacgaggagaaagtgagctttgtgctggactccctgctgggagggtatgagaccacctcgctcctcatctccatggtcgtttatttccttggccagtctgctcaagatctggacctggttaagagggagcacgacagcataagatccaacaaaggcaaggaggagtgcttgacttcagaagactacaagaagatggaatatacccaacaagtcatcaacgaggcgctgagatgcggcaacatcgtcaagttcgtccaccggaaggcgctgaaagacgtcaaatacaaagagtatctgattccatctggctggaaggtcctaccggtcttcactgccgttcatctgaacccctcacttcatggagacgcgcagcagtttcagccctgtaggtgggagggcacaagccaagggacaagcaagaggtttacaccgttcggtggtggcccccggctctgcccaggatcagagctcgctaaagtggagactgctttcttcctccatcaccttgtcctcaattatagatggagaattgatggcgatgacattccaatggcatacccgtatgtggagtttcagagaggtctgccaatagaaatcgagccaacgtcccctgaatcttgactgtcctggagctacagccatcagttatcacaccagagagaaaaggggaaggtgcatggagtatacatgaatggtcagtgacagatctcacaagtgaaggaacactgagggcgcgtgctagtagctagcatatgaggcagctgagactgtaatttaatgtacatggtgtagatatattttgtccatggcaattgcttgaagtggctgattcacttcaccctgtaaaacattctccagtggtttcaactgctatcctataaaaaagaagggcccctgtgtttaataaaaaaaaaaaaaaaa

SEQ ID NO: 3824 - protein, 485 aa, Arabidopsis thaliana
  misc_feature (1)..(485): useful for making plants with increased salt and oxidative stress resistance as described in USSN 12/922,143
  misc_feature (1)..(485): Ceres SEEDLINE ID no.ME06336
  misc_feature (1)..(485): Bit score of 1231.9 for HMM based on sequences of FIGURE 7 of USSN 12/922,143.
  misc_feature (228)..(466): Pfam Name: p450 Pfam Description: Cytochrome P450
MMMMMMAGEHVLAALGTLLLASLLTLVLNHFLPLLLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGSSGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 3825 - protein, 471 aa, Oryza sativa subsp. indica
  misc_feature (1)..(471): useful for making plants with increased salt and oxidative stress resistance as described in USSN 12/922,143
  misc_feature (1)..(471): Public GI ID no.114329476
  misc_feature (1)..(471): Bit score of 310.8 for HMM based on sequences of FIGURE 7 of USSN 12/922,143.
  misc_feature (40)..(432): Pfam Name: p450 Pfam Description: Cytochrome P450
  misc_feature (1)..(471): Functional Homolog Of Ceres SEEDLINE ID no. ME06336
MGAFLLFVCVLAPFLLVCAVRGRRRQAGSSEAAACGLPLPPGSMGWPYVGETFQLYSSKNPNVFFNKKRNKYGPIFKTHILGCPCVMVSSPEAARFVLVTQAHLFKPTFPASKERMLGPQAIFFQQGDYHAHLRRIVSRAFSPESIRASVPAIEAIALRSLHSWDGQFVNTFQEMKTYALNVALLSIFGEEEMRYIEELKQCYLTLEKGYNSMPVNLPGTLFHKAMKARKRLGAIVAHIISARRERQRGNDLLGSFVDGREALTDAQIADNVIGVIFAARDTTASVLTWMVKFLGDHPAVLKAVTEEQLQIAKEKEASGEPLSWADTRRMKMTSRVIQETMRVASILSFTFREAVEDVEYQGYLIPKGWKVLPLFRNIHHNPDHFPCPEKFDPSRFEVAPKPNTFMPFGNGTHSCPGNELAKLEMLVLFHHLATKYRWSTSKSESGVQFGPFALPLNGLPMSFTRKNTEQE

SEQ ID NO: 3826 - DNA, 1154 bp, Gossypium hirsutum
  misc_feature (1)..(1154): useful for making plants with increased salt and oxidative stress resistance as described in USSN 12/922,143
  misc_feature (1)..(1154): Ceres CLONE ID no.1849135
tgagttaacagtgaagcaactaatgagctatgaccctggtgaatggagtgaaagtttaagaaaagaataccttctagttattgaaggattcttcaccgttccgcttccacttttttcaaccacttatcgtcgagccatcaaagctcggaccaaggtggcggaggcattgagtttaatagtgagggaaaggaggaaagagtatgaaagaggggcgaaaaagaatgatatgttggcagcattgttggcaggggatgataaattttcagatgaacaaatagtggattttttggtagcattgcttgttgctggttacgaaacaacttcaactattatgactcttgctgtcaagttcttgactgagacacctcttgctttggctcaactcaaggaagaacacgaagggattagggcgaaaaaatccgaatccgaggctttacaatggagtgattataagtcaatgccattcactcaatgtgttgttaacgagacgttacgagttgcaaacataatcagcggagttttccgacgagcaatgacggatatcaacataaaaggttacacaattccgaaaggttggagggttttcgcatcattccgagccgtacatctcgaccacaatcagttcaaagatgctcgcacgttcaatccgtggagatggcagagtaactccggaataagctgccccagacacgttttcacaccatttggaggagggcctcgattgtgcccaggatacgagcttgctagagtagaactctcggtattcttacaccacctagtgacccggtttagttgggaaccggccgaagaagataagctcgtcttctttccaacgacgcgaacgcaaaaacggtatccgatcaatgtgcggcgtcgaaacggatcgttttcttagccaaatgtactgttaaaaacataaatgttagagaaggagaggtgtaatagaattttggatggtgtgagatgcaataattaaaattagggggaaaaaaaaggaaaaatagagttagtgaatgtaaattaatttgattcttattatgtgttgggcattatatatatatattttatccatattcaagttgtaacaatgcctaatggtagaatccatccatttccattaaaatgaaaagaacaatatatataagtttttatgc

SEQ ID NO: 3827 - protein, 290 aa, Gossypium hirsutum
  misc_feature (1)..(290): useful for making plants with increased salt and oxidative stress resistance as described in USSN 12/922,143
  misc_feature (1)..(290): Ceres CLONE ID no.1849135
  misc_feature (1)..(290): Bit score of 325.1 for HMM based on sequences of FIGURE 7 of USSN 12/922,143.
  misc_feature (28)..(282): Pfam Name: p450 Pfam Description: Cytochrome P450
  misc_feature (1)..(290): Functional Homolog Of Ceres SEEDLINE ID no. ME06336
MSYDPGEWSESLRKEYLLVIEGFFTVPLPLFSTTYRRAIKARTKVAEALSLIVRERRKEYERGAKKNDMLAALLAGDDKFSDEQIVDFLVALLVAGYETTSTIMTLAVKFLTETPLALAQLKEEHEGIRAKKSESEALQWSDYKSMPFTQCVVNETLRVANIISGVFRRAMTDINIKGYTIPKGWRVFASFRAVHLDHNQFKDARTFNPWRWQSNSGISCPRHVFTPFGGGPRLCPGYELARVELSVFLHHLVTRFSWEPAEEDKLVFFPTTRTQKRYPINVRRRNGSFS

SEQ ID NO: 3828 - protein, 438 aa, Oryza sativa subsp. indica
  misc_feature (1)..(438): useful for making plants with increased salt and oxidative stress resistance as described in USSN 12/922,143
  misc_feature (1)..(438): Public GI ID no.125534105
  misc_feature (1)..(438): Bit score of 209.7 for HMM based on sequences of FIGURE 7 of USSN 12/922,143.
  misc_feature (240)..(436): Pfam Name: p450 Pfam Description: Cytochrome P450
  misc_feature (1)..(438): Functional Homolog Of Ceres SEEDLINE ID no. ME06336
MGFPIVGETFQFFRTSPSIDMPIYYKRRLERYGPIFKTNIGGQHVVISLDPEVNQFIFQQEGKLFQSWFPETTLNIFGKKTLTTYNRTAHKLIRSFVCKLYGPENVKKSLLPELENSMRESLASWIGKPSVEVNDGVSNMIFGLAAKHLIGLDITNSGELKKNFQEIFQVMVSIPFPIYFPGTSFYRCMQGRRNVWTTLTNVMKKRLSAPGNKFGDLVDLIVEELRSENPTIDESFAIDTLSGLLFASFAPLSCTLTTTFKFLNDNPEVFDKLKEEHEMILKKREGANSGFTWEEYKSLKFSTQVVNEINRITTVIPGGFRKALTDVEVNGYTIPSGWLVMISPMGVHLNPKLFEDPLKFDPWRWTEEKRISMQRNFMPFGGGIRMCPAVEFNKLFITLFLHIVVTEYRWKDIDGGNVKRISEVLVAQEYHIQLVPQT

SEQ ID NO: 3829 - protein, 469 aa, Solanum tuberosum
  misc_feature (1)..(469): useful for making plants with increased salt and oxidative stress resistance as described in USSN 12/922,143
  misc_feature (1)..(469): Public GI ID no.76803519
  misc_feature (1)..(469): Bit score of 316.7 for HMM based on sequences of FIGURE 7 of USSN 12/922,143.
  misc_feature (37)..(462): Pfam Name: p450 Pfam Description: Cytochrome P450
  misc_feature (1)..(469): Functional Homolog Of Ceres SEEDLINE ID no. ME06336
MEFVSMLCLFTFISFTLLLIHSIFKFLAFASKKLPLPPGTLGLPYIGETLQLYSQNPNVFFASKVKKYGSIFKTYILGCPCVMISSPEAAKQVLVTRANLFKPTFPASKERMLGKQAIFFHQGDYHAKLRKLVLQAFKPDSIRNIIPDIESIAITSLESFEGRLINTYQEMKTYTFNVALISIFGKDEFLYREELKKCYYILEKGYNSMPINLPGTLFNKAMKARKELAKIVAKIISTRREMKIDHSDLLGSFMGDKEGLTDEQIADNVIGVIFAARDTTASVLTWILKYLGENPSVLQAVTEEQENIMRTKEVNDEEKVLNWQDTRQMPMTTRVIQETLRVASILSFTFREAVEDVEFEGYLIPKGWKVLPLFRNIHHSPDNFPEPEKFDPSRFEVSPKPNTFMPFGNGVHSCPGNELAKLEILILVHHLTTKYRWSMVGPQNGIQYGPFALPQNGLPIKLSLKTSST

SEQ ID NO: 3830 - protein, 448 aa, Oryza sativa subsp. indica
  misc_feature (1)..(448): useful for making plants with increased salt and oxidative stress resistance as described in USSN 12/922,143
  misc_feature (1)..(448): Public GI ID no.125549394
  misc_feature (1)..(448): Bit score of 262.9 for HMM based on sequences of FIGURE 7 of USSN 12/922,143.
  misc_feature (288)..(409): Pfam Name: p450 Pfam Description: Cytochrome P450
  misc_feature (1)..(448): Functional Homolog Of Ceres SEEDLINE ID no. ME06336
MEKSELLLGSYSYAALCGVTLIIGWLAHWIYKWMNPPCIGRLPPGSMGFPIIGETFQFFRASPSIDMPSYYKQRLERYGPLFKTSLVGRPVIISLDPEVNRFIFQQEGKLFQSWYPETAINIFGKKSLTTYNGTIHKFIRGVAAKLFGLENLKESLLPELENSMRESFASWTGKPSVEVQDGVSDMIFDLVAKKLIGLDVTNSRELRKNFQDFFQGMVSFPIYFPGTSFYRSMQGRRNVRNTLTDIMKERLSAPGKKYGDLVDLIVEELQSEKPMIDENFAIDALAALLFTSFATLSSTLTVAFKYLTDNPKVVEELKEEHGTILKKREGVNSGFTWEEYRSLKFSTQVMNEITRISNVTPGVFRKTLTDVQVKGYTIPSGWLVMISPMAVHLNPKLFEDPLKFDPWRWRTVSKSIIGTKGGKSKASEARAPPLSSIRTLCNYAALGY

SEQ ID NO: 3831 - DNA, 1621 bp, Panicum virgatum
  misc_feature (1)..(1621): useful for making plants with increased salt and oxidative stress resistance as described in USSN 12/922,143
  misc_feature (1)..(1621): Ceres CLONE ID no.1992165
ggcactcctcagttgagttaccatataccagacgctagcgaagtagcgatggatatgggcgatccctcccttgtggtggcggccgtcgccgtggccttatcccttgtgttccttgtcgtagcggcgagggccagcaggaagccaggcaagctgccgctgccccccgggtcgatgggcctgccggtgatcgggcagagcctgggcttcctccgcgcgctgcgctccaacacagcagagcagtggattcaggagcgcgtggagcggtacgggccggtgtccaagctgaggctcttcggcacccgcacggtgatgctcaccgggcccgcggccaacaagttcgtcttcaccagcgcgtcgctggggacggagcagccccagtcgacgcggcggatagtcggggagaggcagatcctggagctcatgggcgccgaccacaagcgcgtccgcggcgcgctgctcgagttcctcaagccggacatgctgcggctatacgtgggcaagatcgacggcgaggtgcggcgccacctcgacgagtactgggccggccgggccaccgtcacggtgatgccgctgatgaagaggctcacgttcgacatcatctccctgctgctcttcggcctggagcgaggcgccgtccgggaagccctcttcgacgacttcgagcacgtcttggatggcgtgtggtccgtccccctggacctacccttcacggcgtaccgccggagcctcagggccagcgccagtgctcgccgggtgatcgccgggatcacgcgggagaccaaggccaagctggagcggggcgaggcctcccggagcagcgacctcgtcgcgtgcctgctcagcttgaccgccggcagcggcgcgcggctgctgagcgatcaggaggtcgtggacaacgccatggcctccatgatcgccggccacgacacgtcctccatccttctcgccttcctcatccgccagctcgccgacgatcctgacacgctctccgccatggtccacgagcacgagcagatcgccaagagcaagggcgacggcgacaccctgacctgggaggacctgtctaacatgaagttcacgtggcgcgccgcgcaggagatgctccggctggtgcccccgatcttcggcaccttcaggacagcgctcaaagacatcgagttcaacggctacctcatccccaaagggtggaaggtgctctggacggcgcccgccacgcacatggacgggagcatctaccccgagccggccaaattcaacccgtcccgcttcgagaacccgacggcgccgccttgctccttcgtcgccttcggcggcggcccgaggatctgcgtcggcatggagttcgccaggatcgagacgctggtggccatgcattacctggtgaggcgcttcagctggaagctctgctgcaaggagaacaccttcgtcaggaacatccagccgtggccgctgcacggcctgcccgtacaacttgagcaaaaggcagcaaaatcgccatgattcatcacatcatatacgatcgaccgtgacgatacaataatatactccaacttcaaagatacctagcgatgttgattcgtcaccacagatccaaatgaataaatttatatcttgtctcctc

SEQ ID NO: 3832 - protein, 481 aa, Panicum virgatum
  misc_feature (1)..(481): useful for making plants with increased salt and oxidative stress resistance as described in USSN 12/922,143
  misc_feature (1)..(481): Ceres CLONE ID no.1992165
  misc_feature (1)..(481): Bit score of 271.0 for HMM based on sequences of FIGURE 7 of USSN 12/922,143.
  misc_feature (164)..(451): Pfam Name: p450 Pfam Description: Cytochrome P450
  misc_feature (1)..(481): Functional Homolog Of Ceres SEEDLINE ID no. ME06336
MGDPSLVVAAVAVALSLVFLVVAARASRKPGKLPLPPGSMGLPVIGQSLGFLRALRSNTAEQWIQERVERYGPVSKLRLFGTRTVMLTGPAANKFVFTSASLGTEQPQSTRRIVGERQILELMGADHKRVRGALLEFLKPDMLRLYVGKIDGEVRRHLDEYWAGRATVTVMPLMKRLTFDIISLLLFGLERGAVREALFDDFEHVLDGVWSVPLDLPFTAYRRSLRASASARRVIAGITRETKAKLERGEASRSSDLVACLLSLTAGSGARLLSDQEVVDNAMASMIAGHDTSSILLAFLIRQLADDPDTLSAMVHEHEQIAKSKGDGDTLTWEDLSNMKFTWRAAQEMLRLVPPIFGTFRTALKDIEFNGYLIPKGWKVLWTAPATHMDGSIYPEPAKFNPSRFENPTAPPCSFVAFGGGPRICVGMEFARIETLVAMHYLVRRFSWKLCCKENTFVRNIQPWPLHGLPVQLEQKAAKSP

SEQ ID NO: 3833 - protein, 475 aa, Oryza sativa subsp. indica
  misc_feature (1)..(475): useful for making plants with increased salt and oxidative stress resistance as described in USSN 12/922,143
  misc_feature (1)..(475): Public GI ID no.125558545
  misc_feature (1)..(475): Bit score of 245.7 for HMM based on sequences of FIGURE 7 of USSN 12/922,143.
  misc_feature (129)..(466): Pfam Name: p450 Pfam Description: Cytochrome P450
  misc_feature (1)..(475): Functional Homolog Of Ceres SEEDLINE ID no. ME06336
MDSSILPALLIALFIPILLHLVTRFKYSSYNLPPGSLGFPFVGQSISFLRALRSNTDHQWYQGRIGKYGPVSKMWLFGSPAVLMAGPAANRFIFSNKDLLFTGTRSINLLSGRNILMLSGEELKQVSPEMVIRYVSKMDEEVRRHVKVNWVGHKTVKVLPLAKRLTLDIICSVIFGQEAGSVREALATDFPAMVRAALSIPVKIPFTRFSRGLSASQRIRELLRGIARERETLLQQQQAHGASAADDFFTYMLALRAEGAHSLTVEDIVDNAIFLLIAGYETTSVLITFMLWHLDKEPEVLSKITEEQDEIARNKGPEDALTWDDVSRMKYTWKVAMETLRTIPPIFGSFRTATRDIEYQGYHIPKGWMVFTAQSVTHLDANIFPEPSNFDPARFENNSSIPPYCFVPFGGGPRMCPGNEFARTETLVTMHYLVTQFRWKLCCKEESYKKDPSPTPLLGLPVELEPRCLPENAHA

SEQ ID NO: 3834 - protein, 476 aa, Stevia rebaudiana
  misc_feature (1)..(476): useful for making plants with increased salt and oxidative stress resistance as described in USSN 12/922,143
  misc_feature (1)..(476): Public GI ID no.89242710
  misc_feature (1)..(476): Bit score of 271.1 for HMM based on sequences of FIGURE 7 of USSN 12/922,143.
  misc_feature (234)..(448): Pfam Name: p450 Pfam Description: Cytochrome P450
  misc_feature (1)..(476): Functional Homolog Of Ceres SEEDLINE ID no. ME06336
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 3835 - protein, 480 aa, Artemisia annua
  misc_feature (1)..(480): useful for making plants with increased salt and oxidative stress resistance as described in USSN 12/922,143
  misc_feature (1)..(480): Public GI ID no.86279654
  misc_feature (1)..(480): Bit score of 269.7 for HMM based on sequences of FIGURE 7 of USSN 12/922,143.
  misc_feature (225)..(452): Pfam Name: p450 Pfam Description: Cytochrome P450
  misc_feature (1)..(480): Functional Homolog Of Ceres SEEDLINE ID no. ME06336
MPMTVMLLFVFLLFIAICFFLVHRHNSTTTKNLPPGSFGWPFIGETLAYIRSKRGGDPERFTKERIEKYGSTLVFKTSVAGERMAVFCGPEGNKFLFGNENKLVASWWPNSVRILFEKCLITIRGDEAKWLRKMMFAYLGPDALSNRYTGTMEVVTRLHIQNHWQGKSELKVFETVRPYLFELACRLFLSLDDPKHVAELGTLFNTFLKGLTELPINIPGTRFYRAKRAANAIKKQLIVIIKQRRQALKQEDQSSSFEDLLSHLLVSSDENGRFLSEAEIANNVLLLLFAGHDTSAVSITLLMKSLAEHPQVYDNVLKEQLGILEAKAPGEMLNWEDIQKMRYSWYVVCEVMRLIPPVVGSFREALVDFEYAGYTIPKGWKIIWSAVMTHKEENNFPNATKFDPSRFEGAGPTPFTYVPFGGGPRMCLGKELARVRILVFLHNIMTKFKWDLLIPDEKIGYDPLATPVKGLPVRLHPHQV

SEQ ID NO: 3836 - protein, 485 aa, Taxus cuspidata
  misc_feature (1)..(485): useful for making plants with increased salt and oxidative stress resistance as described in USSN 12/922,143
  misc_feature (1)..(485): Public GI ID no.28380196
  misc_feature (1)..(485): Bit score of 279.7 for HMM based on sequences of FIGURE 7 of USSN 12/922,143.
  misc_feature (226)..(453): Pfam Name: p450 Pfam Description: Cytochrome P450
  misc_feature (1)..(485): Functional Homolog Of Ceres SEEDLINE ID no. ME06336
MDALKQLEVSPSILFVTLAVMAGIILFFRSKRHSSVKLPPGNLGFPLVGETLQFVRSLGSSTPQQFIEERMSKFGDVFKTSIIGHPTVVLCGPAGNRLVLSNENKLVQMSWPSSMMKLIGEDCLGGKTGEQHRIVRAALTRFLGPQALQNHFAKMSSGIQRHINEKWKGKDEATVLPLVKDLVFSVASRLFFGITEEHLQEQLHNLLEVILVGSFSVPLNIPGFSYHKAIQARATLADIMTHLIEKRRNELRAGTASENQDLLSVLLTFTDERGNSLADKEILDNFSMLLHGSYDSTNSPLTMLIKVLASHPESYEKVAQEQFGILSTKMEGEEIAWKDLKEMKYSWQVVQETLRMYPPIFGTFRKAITDIHYNGYTIPKGWKLLWTTYSTQTKEEYFKDADQFKPSRFEEEGKHVTPYTYLPFGGGMRVCPGWEFAKMETLLFLHHFVKAFSGLKAIDPNEKLSGKPLPPLPVNGLPIKLYSRS

SEQ ID NO: 3837 - protein, 498 aa, Oryza sativa subsp. indica
  misc_feature (1)..(498): useful for making plants with increased salt and oxidative stress resistance as described in USSN 12/922,143
  misc_feature (1)..(498): Public GI ID no.125558388
  misc_feature (1)..(498): Bit score of 266.2 for HMM based on sequences of FIGURE 7 of USSN 12/922,143.
  misc_feature (39)..(489): Pfam Name: p450 Pfam Description: Cytochrome P450
  misc_feature (1)..(498): Functional Homolog Of Ceres SEEDLINE ID no. ME06336
MAVVAVAVVIALLAAFLTPLAVYLARRASPPPPPRRNLPPGSLGLPLIGQSLSLLRAMRRNTADRWLQDRIDRYGPVSKLSLFGAPTVLVAGPAANKVVFHHEALAPKQPRSLAAIIGRRNILELVGDDHRRVRGAILQFLRPDMVRRYVGKIDSEVRRHLAARWAGRRTVAVFPLMKTLAFDVIATLLFGLDRGAIREQLADAFDGMHEGLWTVPVDLPFTPFRRGLMASARARRLVEATVREKAAKLEHGESSPSDDLISCLLSLRDGGRQLLTEEEIVDNSVLALVAGHDTSAVLLTFMLRHLANDPATLAAMAQGKNPTLPSPDEHSEHEEIARGKRDGEALTWEDVAKMKLSWRVAQETLRMVPPVLGSFRRAPVDVEFEGYTIPRGWQIFWSPSVTHMDPAIFHEPTKFEPSRFDGTAAAAAYSFVPFGGGPRICPGMELARVETLVTAHYLVRHFRWKLCLGEEKNTFLRDPMPTPHDGLPVELDHIAPLC

SEQ ID NO: 3838 - DNA, 2319 bp, Panicum virgatum
  misc_feature (1)..(2319): useful for making plants with increased salt and oxidative stress resistance as described in USSN 12/922,143
  misc_feature (1)..(2319): Ceres CLONE ID no.1807209
accccaacagcatcctcctcgcccatctcctcctccctcttcctcattctcggcatcccttcacccgtcgcagacttgcagtctccttcctcctccgcgcgccctttcctagctcgctccgttcacagcggctagcggagcaggagcgaaagcaaaaaaaggccatgggcgccctcctgctcttcgtctgcctcctggcgccgttcgtgctcgcctgcgccgcccgcggcaggcggcggcgggcggcggcgccggcgtcgtcggcgtgcggcaaggcgctgccgctgccgccggggtccatggggtggccgtacgtgggcgagacgttccagctctactcctccaagaaccccaacgtgttcttcgcccggaagcagaaccggtccgggcccatcttcaagacgcacatcctggggtgcccctgcgtgatggtgtccagcccggaggcggcgcgcttcgtgctcgtcacgcaggcgcacctcttcaagcctaccttcccggccagcaaggagcgcatgctgggcccgcaggccatcttcttccagcagggcgactaccacgcccacctccgccgcctcgtctcccgggccttctccccggaggccatccgcgcctccgtgccggccatcgaggccatcgcgctgcgctcgctccgctcctgggacggccagctcgtcaacaccttccaggagatgaagctgtacgcgctgaatgtggcattgctgtccatcttcggcgaggaggagatgcgctacatcgaggagctgaagcagtgctacctgaccctggagaaggggtacaactcgatgccggtgaacctgccgggcaccctgttctacaaggccatgaaggcccgcaagcgcctgggcgacatcgtggcccacatcatctcggcgcgccgcgagcgccggcagcgcgggagagacctcctggcctccttcctggacgaccgcgaggcgctcaccgacgcccagatcgccgacaacgtcatcggcgtcatcttcgccgcccgcgacaccaccgccagcgtcctcacctggatggtcaagttcctcggcgaccacccctcggtgctcaaggccgtcatcgacgagcaggaggagctcgcgcggtccaagtgctcccccgacgcgcccctgacgtgggcggacacccggcggatgcgcatgacgagccgtgtgatccaggagacgatgcgagtggcgtccatcctgtccttcaccttccgggaggccgtggaggacgtggagtaccaagggtacctgatccccaagggctggaaggtgctgcccctgttccggaacatccaccacagccccgaccacttcccctgcccggaaaagtttgacccctcccgattcgaggtggcgcccaagcccaacacgttcatgcccttcggcaacgggacccactcgtgccccggcaacgagctcgccaagctggagatgctcgtgctctttcaccacctcgccaccaagtacaggtggttcacctccaagtccgagagcggcgtgcagttcggccccttcgcgctgccgctcaacggcctgcccatgaccttcacccgcaaggactgatcgagccggcacgcacaggatgcacggtggtattggtattggtatatgctcctacttgtactaagcaatacccaggcacggcacgcggaaaccgctgccggaattgggcgtcggccgcgggcgccggtcgccatcggccatcggatcaggcatgggatcgcagaaagatcacgcaagacgatagcccttgtacagattcttcctcagctctcagctggtaggaccggaccgcaacaagccggaagaggagaccagagacacaaagattaggcgtagccgcgtaggtgtcagtcagtcggtcagtgttaagctaagctaagctgctccagtaggcatcagacgccacaaagaagtggcgctcaactgtaaaccaaacccattttgatcttcttcttatccccccccccctagatttttttttttaaaaaaaaccagccagacagcaccctataggagaagaacaagaaaacaaaaaagaaaggagaagagaggaggcccctgattgggattgtaagcaaaactagttgtccgcctgaaagcaggctggcagctaggccgaataatccatggacggatggatggatgcatcgccggagtcaaaagagaaccacgtcctcgtcccgcagctacggcccgggacggcgacacaccctcttgtattttgtttcgtccaacgcaagagacagtgactgctttcggaacagctactgctcgaactaatttaattgccaagtgcgtgcgc

SEQ ID NO: 3839 - protein, 470 aa, Panicum virgatum
  misc_feature (1)..(470): useful for making plants with increased salt and oxidative stress resistance as described in USSN 12/922,143
  misc_feature (1)..(470): Ceres CLONE ID no.1807209
  misc_feature (1)..(470): Bit score of 283.6 for HMM based on sequences of FIGURE 7 of USSN 12/922,143.
  misc_feature (42)..(435): Pfam Name: p450 Pfam Description: Cytochrome P450
  misc_feature (1)..(470): Functional Homolog Of Ceres SEEDLINE ID no. ME06336
MGALLLFVCLLAPFVLACAARGRRRRAAAPASSACGKALPLPPGSMGWPYVGETFQLYSSKNPNVFFARKQNRSGPIFKTHILGCPCVMVSSPEAARFVLVTQAHLFKPTFPASKERMLGPQAIFFQQGDYHAHLRRLVSRAFSPEAIRASVPAIEAIALRSLRSWDGQLVNTFQEMKLYALNVALLSIFGEEEMRYIEELKQCYLTLEKGYNSMPVNLPGTLFYKAMKARKRLGDIVAHIISARRERRQRGRDLLASFLDDREALTDAQIADNVIGVIFAARDTTASVLTWMVKFLGDHPSVLKAVIDEQEELARSKCSPDAPLTWADTRRMRMTSRVIQETMRVASILSFTFREAVEDVEYQGYLIPKGWKVLPLFRNIHHSPDHFPCPEKFDPSRFEVAPKPNTFMPFGNGTHSCPGNELAKLEMLVLFHHLATKYRWFTSKSESGVQFGPFALPLNGLPMTFTRKD

SEQ ID NO: 3840 - protein, 485 aa, Taxus x media
  misc_feature (1)..(485): useful for making plants with increased salt and oxidative stress resistance as described in USSN 12/922,143
  misc_feature (1)..(485): Public GI ID no.60459952
  misc_feature (1)..(485): Bit score of 274.9 for HMM based on sequences of FIGURE 7 of USSN 12/922,143.
  misc_feature (226)..(453): Pfam Name: p450 Pfam Description: Cytochrome P450
  misc_feature (1)..(485): Functional Homolog Of Ceres SEEDLINE ID no. ME06336
MDALKQLEVSPSILFVTLAVMAGIILFFRSKRHSSVKLPPGNLGFPLVGETLQFVRSLGSSTPQQFIEERMSKFGDVFKTSIIGHPTVALCGPAGNRLVLSNENKLVQMSWPSSMMKLIGEDCLGGKTGEQHRIVRAALTRFLGPQALQNHFAKMSSGIQRHINEKWKGKDEATVLPLVKDLVFSVASRLFFGITEEHLQEQLHNLLEVILVGSFSVPLNIPGFSYHKAIQARATLADIMTSLIEKRRNELRAGTASENQDLLSVLLTFTDERGNSLADKEILDNFSMLLHGSYDSTNSPLTMLIKVLASHPESYEKVAQEQFGILSTKMEGEEIAWKDLKEMKYSWQVVQETLRMYPPIFGTFRKAITDIHYNGYTIPKGWKLLWTTYSTQTKEEYFKDADQFKPSRFEEEGKHVTPYTYLPFGGGMRVCPGWEFAKMETLLFLHHFVKAFSGLKAIDPNEKLSGKPLPPLPVNGLPIKLYSRS

SEQ ID NO: 3841 - protein, 485 aa, Taxus chinensis
  misc_feature (1)..(485): useful for making plants with increased salt and oxidative stress resistance as described in USSN 12/922,143
  misc_feature (1)..(485): Public GI ID no.62005121
  misc_feature (1)..(485): Bit score of 265.9 for HMM based on sequences of FIGURE 7 of USSN 12/922,143.
  misc_feature (226)..(449): Pfam Name: p450 Pfam Description: Cytochrome P450
  misc_feature (1)..(485): Functional Homolog Of Ceres SEEDLINE ID no. ME06336
MDALKQLEVSPSILFVTLAVMVGIILFFRSKRHSSVKLPPGNLGFPLVGETLQFVRTLGSSTPQQFIEERMSKFGDVFKTSIIGHPTVVLCGPAGNRLVLSNENKLVQMSWPSSMMKLIGEDCLGGKTGEQHRIVRAALTRFLGPQALQNHFAKMSSGIQRHINEKWRGKDEVTVLPLVKDLVFSVASRLFFGITEEHLQEQLHNLLEVILVGSFSVPLNIPGFSYHKAMQARATLVDIMTSLIEKRRNELRAGTASENQDLLSVLLTFTDERGNSLADKEILDNFSMLLHGSYDSTNSPLTMLIKVLASHPESYEKVAQEQFGILSTKMEGDEIAWKDLKEMKYSWQVAQETLRMFPPIFGTFRKAITDIHYNGYTIPKGWKLLWTTYSTHTKEGYFKGADQFKPSRFEEEGKHVTPYTYLPFGGGMRGCPGWEFAKMETLLFLHHFVKALSGLKAIDPNEKLSGKPLPPLPVNGLPIKLYSRS

SEQ ID NO: 3842 - protein, 490 aa, Pisum sativum
  misc_feature (1)..(490): useful for making plants with increased salt and oxidative stress resistance as described in USSN 12/922,143
  misc_feature (1)..(490): Public GI ID no.27764533
  misc_feature (1)..(490): Bit score of 272.5 for HMM based on sequences of FIGURE 7 of USSN 12/922,143.
  misc_feature (234)..(481): Pfam Name: p450 Pfam Description: Cytochrome P450
  misc_feature (1)..(490): Functional Homolog Of Ceres SEEDLINE ID no. ME06336
MASLWFIFGAIAGALLVLRSLLKNVNWFLYEAKLGDKQYSLPPGDMGWPIIGNMWSFLRAFKSSKPDSFMDSIVKRFGNTGIYKVFMFGFPSVIVTSPEACKKVLTDDENFEPGWPQSTVELIGEKSFIKMPFEEHRRLRRLTSASINGYEALSVYLKYIEEIVISSLEKWTQMGEIEFLTQMRKLTFKIIIHIFLGSESEPVMEALEREYTVLNLGVRAMRINIPGFAFHKSLKARKNLVAIFQSIVDKRRNERRGKEPAPGKKAKDMMDSLIDAVDENGRKLGDDEIIDIMLMYLNAGHESSGHITMWATYFLQRHPEFFRKAKEEQVEMLKRRPPSQKGLKLEDVRKMEYLSKVIDETMRVVTFSLMVFRQARNDVKVNGYLIPKGWRVLTWFRSVHFDSELYPDPREFNPENFSVVRKAGEFLPFGAGTRLCPGNDLAKLEISVFLHHFLLKYELEQLNPKSPIRFLPHTRPLDNCLARIKKQEAA

SEQ ID NO: 3843 - protein, 485 aa, Phaseolus vulgaris
  misc_feature (1)..(485): useful for making plants with increased salt and oxidative stress resistance as described in USSN 12/922,143
  misc_feature (1)..(485): Public GI ID no.86129702
  misc_feature (1)..(485): Bit score of 270.5 for HMM based on sequences of FIGURE 7 of USSN 12/922,143.
  misc_feature (52)..(478): Pfam Name: p450 Pfam Description: Cytochrome P450
  misc_feature (1)..(485): Functional Homolog Of Ceres SEEDLINE ID no. ME06336
MAELVLFVSVPAAVLAFGVPAFFKVCTSEYRWRDVGLHGGRDWRKKTKLRFPPGSMGWPYFGETLQLYSQDPNVYFSTKHKRFGEIFKTNILGCPCVMLISPEAARFVLVTQAHLFKPTYPKSKERLIGPFALFFHQGDYHTRLRKLVQRSLSFEALRNLVPHVEALVLSGMNSWGDGQVINMFKEMKRISFEVGILTTFGHLEPRSREELKKNYRIVDAGYNSFPTCIPGTQYKKALLARKRLGKIISDIICERKEKKLVERDLLSCLLNWKGEGGEVLSDDQIADNIIGVLFAAQDTTASAMTWVVKYLHDEPKLLESVKAEQKAIHKSNEGNIPLSWDQTRNMRITHKVVLESLRMASIISFPFREAIADVEYKGFLIPKGWKAMPFGNGVHHACPGNEPQKCNPSRFYVAPKANTFMPFGSGGHACPGYELAKLEMLIMTHHLVTKFRWEAEGSNSGIQYGPFPVPVRGLPARFRKESTNF

SEQ ID NO: 3844 - protein, 509 aa, Taxus cuspidata
  misc_feature (1)..(509): useful for making plants with increased salt and oxidative stress resistance as described in USSN 12/922,143
  misc_feature (1)..(509): Public GI ID no.30350220
  misc_feature (1)..(509): Bit score of 235.6 for HMM based on sequences of FIGURE 7 of USSN 12/922,143.
  misc_feature (161)..(493): Pfam Name: p450 Pfam Description: Cytochrome P450
  misc_feature (1)..(509): Functional Homolog Of Ceres SEEDLINE ID no. ME06336
MDVFYPLKSTVAKFNECFPAILFIVLSAVAGIVLPLLLFLRSKRRSSVGLPPGKLGYPFIGESLLFLKALRSNTVEQFLDERVKNFGNVFKTSLIGHPTVVLCGPAGNRLILANEEKLVQMSWPKSSMKLMGEKSITAKRGEGHMIIRSALQGFFSPGALQKYIGQMSKTIENHINEKWKGNDQVSVVALVGDLVFDISACLFFNINEKHERERLFELLEIIAVGVLAVPVDLPGFAYHRALQARSKLNAILSGLIEKRKMDLSSGLATSNQDLLSVFLTFKDDRGNPCSDEEILDNFSGLLHGSYDTTVSAMACVFKLLSSNPECYEKVVQEQLGILSNKLEGDEITWKDVKSMKYTWQVVQETLRLYPSIFGSFRQAITDIHYNGYIIPKGWKLLWTPYTTHPKEMYFSEPEKFLPSRFDQEGKLVAPYTFLPFGGGQRSCPGWEFSKMEILLSVHHFVKTFSTFTPVDPAEIIARDSLCPLPSNGFSVKLFPRSYSLHTGNQVKKI

SEQ ID NO: 3845 - protein, 485 aa, Ginkgo biloba
  misc_feature (1)..(485): useful for making plants with increased salt and oxidative stress resistance as described in USSN 12/922,143
  misc_feature (1)..(485): Public GI ID no.47498770
  misc_feature (1)..(485): Bit score of 240.5 for HMM based on sequences of FIGURE 7 of USSN 12/922,143.
  misc_feature (224)..(477): Pfam Name: p450 Pfam Description: Cytochrome P450
  misc_feature (1)..(485): Functional Homolog Of Ceres SEEDLINE ID no. ME06336
MASIFVPVCVSVAVITITCLKKFNGWRYECGLSSKKPLPPGDMGWPLLGNMLSFLIAFKFNRPNSFVSAFVSRFGRTGLYKPFMFGSPTILATTPETCKQVLMDDAHFVPGWPVSTVQLMGRKSFVALSHEDHDRLRKLTAPSINGHEALSNYLGWIEQRVVSAYEDWANQDRIVLLNELKKVTFDIISYIFLSYESKTGTKLASLEREYTSLNMGIRAMAINLPGTAYHKALKARKNLVAILQSVTEERRSSPDPQAKSNKDVLNALLHVKDENGSLLTDEEIIDLLVMYLNAGHESSAHITMWAIIFLVSHPRLYAEAKAEQEKIVNKRPDGQTHLIMYEIREMNYLRKIIDESLRMVNISLMVFREAMDDVEINGYTIPKGWKTQVWLRSVHMDPQVYPNPTKFDPDRWDKLIPKSGMFIPFGAGSRLCPGSDLAKMEICVFIHHLLFHYKIERLNPDCPVRYLPHPRPTDYCKGRVRKLST

SEQ ID NO: 3846 - protein, 497 aa, Taxus cuspidata
  misc_feature (1)..(497): useful for making plants with increased salt and oxidative stress resistance as described in USSN 12/922,143
  misc_feature (1)..(497): Public GI ID no.28380205
  misc_feature (1)..(497): Bit score of 248.4 for HMM based on sequences of FIGURE 7 of USSN 12/922,143.
  misc_feature (51)..(493): Pfam Name: p450 Pfam Description: Cytochrome P450
  misc_feature (1)..(497): Functional Homolog Of Ceres SEEDLINE ID no. ME06336
MDSFIFLRSIGTKFGQLESSPAILSLTLAPILAIILLLLFRYNHRSSVKLPPGKLGFPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSLSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEEFRPSRFEDEGRHVTPYTYVPFGGGLRTCPGWEFSKIEILLFVHHFVKNFSSYIPVDPNEKVLSDPLPPLPANGFSIKLFPRS

SEQ ID NO: 3847 - protein, 479 aa, Medicago truncatula
  misc_feature (1)..(479): useful for making plants with increased salt and oxidative stress resistance as described in USSN 12/922,143
  misc_feature (1)..(479): Public GI ID no.84514135
  misc_feature (1)..(479): Bit score of 238.8 for HMM based on sequences of FIGURE 7 of USSN 12/922,143.
  misc_feature (221)..(476): Pfam Name: p450 Pfam Description: Cytochrome P450
  misc_feature (1)..(479): Functional Homolog Of Ceres SEEDLINE ID no. ME06336
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 3848 - protein, 497 aa, Taxus x media
  misc_feature (1)..(497): useful for making plants with increased salt and oxidative stress resistance as described in USSN 12/922,143
  misc_feature (1)..(497): Public GI ID no.44903417
  misc_feature (1)..(497): Bit score of 242.2 for HMM based on sequences of FIGURE 7 of USSN 12/922,143.
  misc_feature (51)..(493): Pfam Name: p450 Pfam Description: Cytochrome P450
  misc_feature (1)..(497): Functional Homolog Of Ceres SEEDLINE ID no. ME06336
MDSFIFLRSIGTKFGQLESSPAILSLTLAPILAIILLLLFRYNHRSSVKLPPGKLGFPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSLSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVSCSPYTTHLREEYFPEPEEFRPSRFEDEGRHVTPYTYVPFGGGLRTCPGWEFSKIEILLFVHHFVKNFSSYIPVDPNEKVLSDPLPPLPANGFSIKLFPRS

SEQ ID NO: 3849 - DNA, 1672 bp, Triticum aestivum
  misc_feature (1)..(1672): useful for making plants with increased salt and oxidative stress resistance as described in USSN 12/922,143
  misc_feature (1)..(1672): Ceres CLONE ID no.846122
ctccagttctccaacaagatcagtccatctattaatggcgatggtggcagcaggcggaggaggaggtgtactgggcgagtggggctggtggctgggcctcgttttcggtgccgccccgctgctctgcctcgccgtctggaacgccaccgacgcctggtaccgcgctgccttcttcctcaaacacggcagccagcgccgcctcccaccgggccacatgggcctgcccttcctcggcgagacgctctctctgatctggcacttcaagctcgcgcgccgtcctgacgagttcatcgccgccaagaggcgtgcgcacggcggcgccggggccggcctctaccgcacgcacctcttcggctcccccgctgtcatcgcctgttcgccggccgccaacaagttcgttcttcagtcccccgacaacttcggtgcgcggtggcccgtgccggagcttgtgggcatcacgtccgtggtgaacgttgagggtgccacccatgccaggctccgcgggttcatcaccgcagccatcaaccggccgagctcgcttcggaccatcgccgccgtcatgcagccccgcatcatggtggcgctggcctcttgggccgacatggggaccatcgtcgctgccaccgagatcaagaatgtgacgttcgccaacatctgcaagatgttcattagcatggagccttctccattgacggagaagatcgacaagttgttccgtgacttggttgctggccttaggtcattccccttggattttccagggacaacatttcatagtgctcgcaagtgtcgtcggaagctaaacgctatctttcgagaggagctggaggcgaggaagaaggtgggcagggagtgtgatgatctcatgggtgggctgatgcacatggaggacgagcaggggaggaagttgagggacgaggaggtggtggacaacatcgtctccctcgtcatcgctggatacgagtctaccgccagcgccatcatgtgggctacctaccacctcgccaaatcccccgtcgccctagccaagctccgggaggagaatatggcggtgagcaaaagcaaaggggcatcgtcaatgatcacccatgacgacctcccgaatatgaagtacaccgcgaaggtagtggaggagacaattcggatggctaacatatcgccgatgttgcaccgtgtggcgaacagggatgtggatcacaatgggtacacgataccggcgggttggtcggtggtagtgtgggtgaggtcgctgcacactgatcccggcaattacgagaaccccctcaccttcaaccctgacagatgggatgagccagcaaagccagggacgtaccttgtgttcggaggcggctacaggatctgtgctggcaacatgctcgctaggttgcagctcaccatcatgcttcatcatctctccattggctatgaatgggagttgctgaaccctgatgcagagattgattacctcccaaacccaaggccagcggatggtgcagtcatgtccttccgtaagcttagcacctgatcaagatgtgatcaatgacatttctctctcatctaaaaataaaccattgtggtggttgtggtgcacacattgtagttaacaagatgataccccacacgttgtggccatgttttgcaatatatttcaatgagacatgattgtatggac

SEQ ID NO: 3850 - protein, 494 aa, Triticum aestivum
  misc_feature (1)..(494): useful for making plants with increased salt and oxidative stress resistance as described in USSN 12/922,143
  misc_feature (1)..(494): Ceres CLONE ID no.846122
  misc_feature (1)..(494): Bit score of 245.5 for HMM based on sequences of FIGURE 7 of USSN 12/922,143.
  misc_feature (283)..(458): Pfam Name: p450 Pfam Description: Cytochrome P450
  misc_feature (1)..(494): Functional Homolog Of Ceres SEEDLINE ID no. ME06336
MVAAGGGGGVLGEWGWWLGLVFGAAPLLCLAVWNATDAWYRAAFFLKHGSQRRLPPGHMGLPFLGETLSLIWHFKLARRPDEFIAAKRRAHGGAGAGLYRTHLFGSPAVIACSPAANKFVLQSPDNFGARWPVPELVGITSVVNVEGATHARLRGFITAAINRPSSLRTIAAVMQPRIMVALASWADMGTIVAATEIKNVTFANICKMFISMEPSPLTEKIDKLFRDLVAGLRSFPLDFPGTTFHSARKCRRKLNAIFREELEARKKVGRECDDLMGGLMHMEDEQGRKLRDEEVVDNIVSLVIAGYESTASAIMWATYHLAKSPVALAKLREENMAVSKSKGASSMITHDDLPNMKYTAKVVEETIRMANISPMLHRVANRDVDHNGYTIPAGWSVVVWVRSLHTDPGNYENPLTFNPDRWDEPAKPGTYLVFGGGYRICAGNMLARLQLTIMLHHLSIGYEWELLNPDAEIDYLPNPRPADGAVMSFRKLST

SEQ ID NO: 3851 - protein, 497 aa, Taxus chinensis
  misc_feature (1)..(497): useful for making plants with increased salt and oxidative stress resistance as described in USSN 12/922,143
  misc_feature (1)..(497): Public GI ID no.24266823
  misc_feature (1)..(497): Bit score of 237.3 for HMM based on sequences of FIGURE 7 of USSN 12/922,143.
  misc_feature (51)..(493): Pfam Name: p450 Pfam Description: Cytochrome P450
  misc_feature (1)..(497): Functional Homolog Of Ceres SEEDLINE ID no. ME06336
MDSFIFLRSIGTKFGQLESSPAIISLTLAPILAIILLLLFRYNHRSSVKLPPGKLGFPLIGETIQLLRTLRSETPQKFFDDRLKKFGPVYMTSLIGHSTVVLCGPAGNKLALSNEDKLVEMEGPKSFMKLIGEDSIVAKRGEDHRILRTALARFLGAQALQNYLGRMSSEIGHHFNKKWKGKDEVKVLPLVRGLIFSIASTLFFDANDGHQQKQLHHLLETILVGSLSVPLDFPGTRYRKGLQARLKLDEILSSLIKRRRSDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEKFRPSRFEDEGRHVTPYTYVPFGGGLRTCPGWEFSKIEILLFVHHFVKNFSSYIPVDPNEKVLSDPLPPLPANGFSIKLFPRS

SEQ ID NO: 3852 - protein, 499 aa, Taxus cuspidata
  misc_feature (1)..(499): useful for making plants with increased salt and oxidative stress resistance as described in USSN 12/922,143
  misc_feature (1)..(499): Public GI ID no.64180315
  misc_feature (1)..(499): Bit score of 232.9 for HMM based on sequences of FIGURE 7 of USSN 12/922,143.
  misc_feature (53)..(495): Pfam Name: p450 Pfam Description: Cytochrome P450
  misc_feature (1)..(499): Functional Homolog Of Ceres SEEDLINE ID no. ME06336
MDALYKSTVAKFNEVTQLDCSTESFSIALSAIAGILLLLLLFRSKRHSSLKLPPGKLGIPFIGESFIFLRALRSNSLEQFFDERVKKFGLVFKTSLIGHPTVVLCGPAGNRLILSNEEKLVQMSWPAQFMKLMGENSVATRRGEDHIVMRSALAGFFGPGALQSYIGKMNTEIQSHINEKWKGKDEVNVLPLVRELVFNISAILFFNIYDKQEQDRLHKLLETILVGSFALPIDLPGFGFHRALQGRAKLNKIMLSLIKKRKEDLQSGSATATQDLLSVLLTFRDDKGTPLTNDEILDNFSSLLHASYDTTTSPMALIFKLLSSNPECYQKVVQEQLEILSNKEEGEEITWKDLKAMKYTWQVAQETLRMFPPVFGTFRKAITDIQYDGYTIPKGWKLLWTTYSTHPKDLYFNEPEKFMPSRFDQEGKHVAPYTFLPFGGGQRSCVGWEFSKMEILLFVHHFVKTFSSYTPVDPDEKISGDPLPPLPSKGFSIKLFPRP

SEQ ID NO: 3853 - protein, 500 aa, Taxus cuspidata
  misc_feature (1)..(500): useful for making plants with increased salt and oxidative stress resistance as described in USSN 12/922,143
  misc_feature (1)..(500): Public GI ID no.34559857
  misc_feature (1)..(500): Bit score of 224.7 for HMM based on sequences of FIGURE 7 of USSN 12/922,143.
  misc_feature (250)..(468): Pfam Name: p450 Pfam Description: Cytochrome P450
  misc_feature (1)..(500): Functional Homolog Of Ceres SEEDLINE ID no. ME06336
MDALSLVNSTVAKFNEVTQLQASPAILSTALTAIAGIIVLLVITSKRRSSLKLPPGKLGLPFIGETLEFVKALRSDTLRQFVEEREGKFGRVFKTSLLGKPTVILCGPAGNRLVLSNEEKLLHVSWSAQIARILGLNSVAVKRGDDHRVLRVALAGFLGSAGLQLYIGKMSALIRNHINEKWKGKDEVNVLSLVRDLVMDNSAILFFNIYDKERKQQLHEILKIILASHFGIPLNIPGFLYRKALKGSLKRKKILSALLEKRKDELRSRLASSNQDLLSVLLSFRDERGKPLSDEAVLDNCFAMLDASYDTTTSQMTLILKMLSSNPECFEKVVQEQLEIASNKKEGEEITMKDIKAMKYTWQVLQESLRMLSPVFGTLRKTMNDINHDGYTIPKGWQVVWTTYSTHQKDIYFKQPDKFMPSRFEEEDGHLDAYTFVPFGGGRRTCPGWEYAKVEILLFLHHFVKAFSGYTPTDPHERICGYPVPLVPVKGFPIKLIARS

SEQ ID NO: 3854 - protein, 495 aa, Taxus canadensis
  misc_feature (1)..(495): useful for making plants with increased salt and oxidative stress resistance as described in USSN 12/922,143
  misc_feature (1)..(495): Public GI ID no.67633430
  misc_feature (1)..(495): Bit score of 256.2 for HMM based on sequences of FIGURE 7 of USSN 12/922,143.
  misc_feature (255)..(463): Pfam Name: p450 Pfam Description: Cytochrome P450
  misc_feature (1)..(495): Functional Homolog Of Ceres SEEDLINE ID no. ME06336
MDAMDLTVAKFKEFTQLQSSAILLTVVSGIIVIVILLLRSKRRSSLKLPPGKLGLPLIGESLSFLWALRSNTLEQFVDKRVKKYGNVFKTSLLGQPTVVLCGAAGNRLILSNQEKLLSRTVSDRVAKLTGDTSISVIAGDSHRIIRAAVAGFLGPAGLKIHIGEMSAHIRNHINQVWKGKDEVNVLSLARELVFAISASLFLNINDREEQHQLHKTLETILPGYFSVPINFPGFAFRKALEGNSKRRKHFSVLQEKRRRDLSVGLASRTQDLLSVLLAYEDDKGNPLTDEEVLDNISALIDGSYESTSSQMAMLLKLLSDHPECYEKVVQEQLEIASHKKEGEEITWKDVKAMRYTWQVMQETLRMFAPVFGPRGKAITDIHYDGYTIPKGWQLSWATYSTHQNDTYFNEPDKFMPSRFDEEGGRLAPYTFVPFGGGRRKCPGWEFAKTEILLFVHHFVKTFSAYTPIDPHESIWGRPLPPVPANGFPIKLISRS

SEQ ID NO: 3855 - protein, 474 aa, Artemisia annua
  misc_feature (1)..(474): useful for making plants with increased salt and oxidative stress resistance as described in USSN 12/922,143
  misc_feature (1)..(474): Public GI ID no.86279656
  misc_feature (1)..(474): Bit score of 202.4 for HMM based on sequences of FIGURE 7 of USSN 12/922,143.
  misc_feature (208)..(445): Pfam Name: p450 Pfam Description: Cytochrome P450
  misc_feature (1)..(474): Functional Homolog Of Ceres SEEDLINE ID no. ME06336
MVDLILIYSIFLSLIVVLVPLSLYFVFYKSKPVVDRKLPPGQTGWPVIGETLEFLTNGWKGHPEKFIFDRMARFSPHVFKTSLMLEDAAVFCGSAGNKFLFSNENKLVKAWWPASVEKILPSAKETTNQRKMLSRSFRPESLRQYVPVMDMMAQRHFKTEWDGMDQIVTHEVTQNFTFSLACKIFVSIEDPEEVKHLSGPFEKFAPGIFSIPIDLPWTPLRRAIHAGNFIRKEIIAIIKQRKIDLADGKASPTQDILSQMLCDEESQNIAEADTADVIIGLLIGGHDNASSTCAFIVKFLADLPEIYEGVLKEQLEIAKFKAPGELLNWEDLSKMKYSWNVACEVLRLAPPLQGSFREAMTDFVYNGYSIPKGWKLYWSALSTHKNPEVFTEPQKLDPSRFDGKGPAPYTFVPFGGGPHMCPGREYARLEILVFMHHLVIKYKWEKVIPNEQIIVNPMPKLAKGLPLRLYPRYA

SEQ ID NO: 3856 - protein, 502 aa, Taxus chinensis
  misc_feature (1)..(502): useful for making plants with increased salt and oxidative stress resistance as described in USSN 12/922,143
  misc_feature (1)..(502): Public GI ID no.53759170
  misc_feature (1)..(502): Bit score of 234.4 for HMM based on sequences of FIGURE 7 of USSN 12/922,143.
  misc_feature (53)..(495): Pfam Name: p450 Pfam Description: Cytochrome P450
  misc_feature (1)..(502): Functional Homolog Of Ceres SEEDLINE ID no. ME06336
MDALYKSTVAKFNEVTQLDCSTESFSIALSSIAGILLLLLLFRSKRHSSLKLPPGKLGIPFIGESFIFLRALRSNSLEQFFDERVKKFGLVFKTSLIGHPTVVLCGPAGNRLILSNEEKLVQMSWPAQFMKLMGENSVATRRGEDHIVMRSALAGFFGPGALQSYIGKMNTEIQNHINEKWKGKDEVNVLPLVRELVFNISAILFFNIYDKQEQDRLHKLLETILVGSFALPIDLPGFGFHRALQGRATLNKIMLSLIKKRKEDLQSGSATATQDLLSVLLTFRDDKGTPLTNDEILDNFSSLLHASYDTTTSPMALIFKLLSSNPECYQKVVQEQLEILSNKEEGEEITWKDLKAMKYTWQVAQETLRMFPPVFGTFRKAITDIQYDGYTIPKGWKLLWTTYSTHPKDLYFSEPEKFMPSRFDQEGKHVAPYTFLPFGGGQRSCVGWEFSKMEILLFVHHFVKTFSSYTPVDPDEKISGDPLPPLPSKGFSIKLFPETIVN

SEQ ID NO: 3857 - protein, 493 aa, Taxus chinensis
  misc_feature (1)..(493): useful for making plants with increased salt and oxidative stress resistance as described in USSN 12/922,143
  misc_feature (1)..(493): Public GI ID no.38481843
  misc_feature (1)..(493): Bit score of 204.9 for HMM based on sequences of FIGURE 7 of USSN 12/922,143.
  misc_feature (250)..(461): Pfam Name: p450 Pfam Description: Cytochrome P450
  misc_feature (1)..(493): Functional Homolog Of Ceres SEEDLINE ID no. ME06336
MDALSLVNSTVAKFNEVTQLQASPAILSIALTAIAGIIVLLVITSKRRSSLKLPPGKLGLPFIGETLEFVKALRSDTLRQFVEEREGKFGRVFKTSLLGKPTVILCGPAGNRLVLSNEEKLLHVSWSAQIARILGLNSVAVKRGDDHRVLRVALAGFLGSAGLQLYIGKMSALIRNHINEKWKGKDEVNVLSLVRDLVMDNSAILFFNIYDKERKQQLHEILKIILASHFGIPLNIPGFLYRKALKGSLKRKKILSALLEKRKDELRSGLASSNQDLLSVLLSFRGDEAVLDNCFAMLDASYDTTTSQMTLILKMLSSNPECFEKVVQEQLEIASNKKEGEEITMKDIKAMKYTWQVLQESLRMLSPVFGTLRKIMNDINHDGYTIPKGWQVVWTTYSTHQKDIYFKQPDNFMPSRFEEEDGHLDAYTFVPFGGGRRACPGWEYAKVGILLFLHHFVKAFSGYTPTDPHERICGYPVPLVPIKGFPIKLIARS

SEQ ID NO: 3858 - protein, 485 aa, Taxus cuspidata
  misc_feature (1)..(485): useful for making plants with increased salt and oxidative stress resistance as described in USSN 12/922,143
  misc_feature (1)..(485): Public GI ID no.48869189
  misc_feature (1)..(485): Bit score of 179.4 for HMM based on sequences of FIGURE 7 of USSN 12/922,143.
  misc_feature (223)..(481): Pfam Name: p450 Pfam Description: Cytochrome P450
  misc_feature (1)..(485): Functional Homolog Of Ceres SEEDLINE ID no. ME06336
MNTFSFLEFIQLQSILFLTLLALLLLCLFRYKTQSSAVKLPPGNLGFPFIGETIPFLRALHSETPQTFFDERMKRFGNVFVTSLIGQPIVVLCGPAGNRLLLSNEDKLVEMSPPKFSLKLIGQDSLLSKREDEHRTLRAALARFLRPQALQSYMGIMSSEIEHHINEKWKGKDEVKMLPLIRGLIFSIATTLFFDINDEHLKDRLHHLLETILVGTVSLPLDFPGTSFRKAVEARSKLDEILSSLIKSRRSDLHSGIASDGQDLLTVLLTFKDERGNSLADNEILDNFSLMLHASYETSVSPTVLMFKLLSSNPECYDKLVQEQLGILANKKEGEDISWKDVKAMKYTWQVVQETMRIFPPGFGSYRKAIIDIDYDGYTIPKGWQLYDALYYTWERTVLPYPEQFRPSRFEEGELVAPYTFLPFGAGARICPGWEFAKTEILLFVHHFVKNFSSYHLVDPKEKISGNPFPPLPNNGFSLKVFPRS

SEQ ID NO: 3859 - DNA, 1844 bp, Zea mays
  misc_feature (1)..(1844): useful for making plants with increased salt and oxidative stress resistance as described in USSN 12/922,143
  misc_feature (1)..(1844): Ceres CLONE ID no.1691419
agcccaacaccccgccaactaccccaagtttgatcgagctctctccacgccagcatacttgcaatggctttcatcgtgctccttgctgctgcagcagcggcaatagccttcgtcctcctccacctcctcagtgcccaaaaaaagcgcagcagcaggtctgcaggctcgacgtcctacagcctaccgcccggcgacctcggcgtccccgtcatcggccagaccttctccctcctccacgcgctgcgcagcaacacggacgaccagtggttcagggcgcggatcaagaggtacggcccggtgtccaagatgtcggtgctgggctcgccgacggtgctgctggccgggacggaggccaaccacttcatattcaccaaccagggcctcatcctcacgcagacgcgcgcgctccgctccctcctccgccgctccatcctcacgctcaccggcgacgacctgaagcaggtgcgcagcgcgctgcagggctacttaaggcctgagatggtccgggggtacgtggggaagatggacgccgaggtcaggaggcagctcaagctcaactgggttggtcgcagcactgtcaacgtcctgccgatggcgaggagccttacactaggggtcatctgctccgtcgtcttcggcgaagaagcagccgccatagtagacgccctagctactgacttccagcagctaggtgacgcgatcctgtcgttcccagtcaacatccccttcacgaggttcggcaagggcatgcggtcgagcgccaagatcagggaggccatcacgaagttcgccaggaagagggaggaggagtactccttgctgctgtcgcaggacgaagggtgcaccgccactgctactgctacgacttcagccgccaccgacttcgtcacctacatgctcctcctgcgctccaggggcgcgcactccctctcgctggcggacatcgtcgacaacgtgatgggcatcgtcatcggcgcgcacggcaccacctcgacgctcatcaccttcatggtgcgccacctcgccaacgagccagacgtcctcgccaagatcacccaagaacaagatgagatcgctggcagaaacggaagagacggtgctctaacatgggaagacgtttcgagcatgaagtacacatggagggcggcgctggagacgctgcgcacggtgccgccggtgttcgggagcttcaggactgccaccaaggacatcgaataccagggctacctcatccccaagggctggaaagtcttcgcatcccagagcatcacgcacatggatcccaggttcttcgccgaacccaccaagttcgatccgtcccgcttcgagaagcgctcgtcgatcccgccgtacagcttcctgccgttcgggggagggccaaggatgtgccctggaaccgagttctccagggtggaaaccatggtggccatgcactatctagtgacgcggttcaggtggaagctgcgcttcgaagacgaagcctacaacaaggatcccaaacctacgcctgttttcggatgtccagtggaactggagctgagaaaaccccctgcaatataatagctgatggtgcttgaaatgatgctttaatattgtacgcccattgattgtaaaatgtacaggctgcttgtttggctgtggccaaaccattgttgtccgtccagcaatacttggcctaagaagagtgcatggatatgtttgggtgtgcagttttcatgtgtagatgtatatacactgaagaagtagatatatatataggtgtcacttgtaattagtttaggtttctatatatgttgtgattgtgtaatgtcaatggcataatattaggcagatcatcaaaactt

SEQ ID NO: 3860 - protein, 498 aa, Zea mays
  misc_feature (1)..(498): useful for making plants with increased salt and oxidative stress resistance as described in USSN 12/922,143
  misc_feature (1)..(498): Ceres CLONE ID no.1691419
  misc_feature (1)..(498): Bit score of 181.4 for HMM based on sequences of FIGURE 7 of USSN 12/922,143.
  misc_feature (168)..(495): Pfam Name: p450 Pfam Description: Cytochrome P450
  misc_feature (1)..(498): Functional Homolog Of Ceres SEEDLINE ID no. ME06336
MAFIVLLAAAAAAIAFVLLHLLSAQKKRSSRSAGSTSYSLPPGDLGVPVIGQTFSLLHALRSNTDDQWFRARIKRYGPVSKMSVLGSPTVLLAGTEANHFIFTNQGLILTQTRALRSLLRRSILTLTGDDLKQVRSALQGYLRPEMVRGYVGKMDAEVRRQLKLNWVGRSTVNVLPMARSLTLGVICSVVFGEEAAAIVDALATDFQQLGDAILSFPVNIPFTRFGKGMRSSAKIREAITKFARKREEEYSLLLSQDEGCTATATATTSAATDFVTYMLLLRSRGAHSLSLADIVDNVMGIVIGAHGTTSTLITFMVRHLANEPDVLAKITQEQDEIAGRNGRDGALTWEDVSSMKYTWRAALETLRTVPPVFGSFRTATKDIEYQGYLIPKGWKVFASQSITHMDPRFFAEPTKFDPSRFEKRSSIPPYSFLPFGGGPRMCPGTEFSRVETMVAMHYLVTRFRWKLRFEDEAYNKDPKPTPVFGCPVELELRKPPAI

SEQ ID NO: 3861 - DNA, 1799 bp, Glycine max
  misc_feature (1)..(1799): useful for making plants with increased salt and oxidative stress resistance as described in USSN 12/922,143
  misc_feature (1)..(1799): Ceres CLONE ID no.661613
aatcacgcgaggatccaaatccaaaaaaatcatggagcagttgtactacctcacccttgtgctactgtttgtgtccttcgtctctgtctcttttttcatcattttctacaggcatcgttctccgttcagcgtccccaacttgccgccggggaaggcggggtttccggtgatcggcgagagcctggagtttctgtcggcgggacggaaggggcttccggagaagttcttctccgatcgcatgacagagtactcttccaaagtgttcaagacctccatcttaggggagcctacagtgattttctgtggagccgcatgtaacaagttcttgttttctaacgagaacaaacacgtcatttcgtggtggcctgaaaatgtcaagaagttgttcccaacgaatattcaaacaaactctaaggaagaagccaagaagttgagaaacattctccctcagttcctcagcgccaaagccatccaacgttacgttggtattatggacactgttgcccaaagacactttgctctggagtgggagaacaacacccaagtcaccgtattgcccttggccaagaggtatacctttggggtggctagccgtgtgttcatgagcattgatgatttgaatcaagtggcgaaattggcagaacctttaaatcaggtgaatgcaggaattatatcaatgcccattaacttccccggaactgtgttcaaccgaggaatcaaggcctccaagttcattaggagggagctgttgaggattgtcaagcagaggaaggtggaactagctaatggaatgtccacaccaacacaagacattttgtctcacatgctaatatattgtgatgagaatggacaatatttggctgaacatgatattgtcaacaagatccttggcttgctgataggtagccatgaaaccacaagtactgtttgcactttcgttgtcaaataccttgccgagctccctcaaaatatttatgaaaatgtctatcaagaacaaatggcgattgcaaaatccaaagctccaggagagttgttgaattgggatgacatccagaagatgaaatattcatggaatgtagcttgtgaagtaataaggcttaaccctccagcccaaggagcttttagggaagccatcaatgactttatcttcgatggattctcaattccaaaaggctggaagttgtattggagtgcaaattcaactcacaaaaatccagagtacttccctgagccagagaaatttgatccaagcagatttgaaggaactggaccagctccttatacttatgtgccatttggtggagggccaagtatgtgccctggaaaagagtatgcgcgaatggaactattggtgttcatgcacaacttagtgaagaggttcaagtgtgaaactctttttcctaatggaaatgttacttataaccctacgcctattcctgccaagggccttcctgttcgtcttattcctcaccgatcatgaaggaattaattatatttggatgggtgaacctatgtcaactcttatgcagaaacggtatggcataaagcctgcccaatgtcagcaattgcattttagtttgttattttttattaattgtttgatcaagtttttaggattagttgttttattttctgttacttaatagttgttatgttaatggttagttattgttatgttagtagtttgttattgttatgttattgtttggttattatttagcacatcagtaattattacttctttttgttccaataaattgtatttaaacagatgatcatttaatagaaaagtgtgtacc

SEQ ID NO: 3862 - protein, 482 aa, Glycine max
  misc_feature (1)..(482): useful for making plants with increased salt and oxidative stress resistance as described in USSN 12/922,143
  misc_feature (1)..(482): Ceres CLONE ID no.661613
  misc_feature (1)..(482): Bit score of 185.7 for HMM based on sequences of FIGURE 7 of USSN 12/922,143.
  misc_feature (220)..(479): Pfam Name: p450 Pfam Description: Cytochrome P450
  misc_feature (1)..(482): Functional Homolog Of Ceres SEEDLINE ID no. ME06336
MEQLYYLTLVLLFVSFVSVSFFIIFYRHRSPFSVPNLPPGKAGFPVIGESLEFLSAGRKGLPEKFFSDRMTEYSSKVFKTSILGEPTVIFCGAACNKFLFSNENKHVISWWPENVKKLFPTNIQTNSKEEAKKLRNILPQFLSAKAIQRYVGIMDTVAQRHFALEWENNTQVTVLPLAKRYTFGVASRVFMSIDDLNQVAKLAEPLNQVNAGIISMPINFPGTVFNRGIKASKFIRRELLRIVKQRKVELANGMSTPTQDILSHMLIYCDENGQYLAEHDIVNKILGLLIGSHETTSTVCTFVVKYLAELPQNIYENVYQEQMAIAKSKAPGELLNWDDIQKMKYSWNVACEVIRLNPPAQGAFREAINDFIFDGFSIPKGWKLYWSANSTHKNPEYFPEPEKFDPSRFEGTGPAPYTYVPFGGGPSMCPGKEYARMELLVFMHNLVKRFKCETLFPNGNVTYNPTPIPAKGLPVRLIPHRS

SEQ ID NO: 3863 - protein, 487 aa, Medicago truncatula
  misc_feature (1)..(487): useful for making plants with increased salt and oxidative stress resistance as described in USSN 12/922,143
  misc_feature (1)..(487): Public GI ID no.92892075
  misc_feature (1)..(487): Bit score of 153.3 for HMM based on sequences of FIGURE 7 of USSN 12/922,143.
  misc_feature (203)..(481): Pfam Name: p450 Pfam Description: Cytochrome P450
  misc_feature (1)..(487): Functional Homolog Of Ceres SEEDLINE ID no. ME06336
MELQWFWMFAATLLACYIFVSKVMRNLNGWYYDLIFKNKQYPLPPGDMGWPLIGNLWSFFKYFYSGRGEMFINNIIFKFGRTGIYKTHLYGSPSIIVIAPAICKKVLIDEVTFKIGYPKSALELGDSKILHKERGRFKQLVSSPINGHNVLEMYLERIEDIVINKLEELSSMKHPVEFLTEMKKASFEFVIHIFFDSCDQDTVNKIGDLFNVMSIALLSFMPINVPGFAYNKALKARMEFVKIIENIICGRRMAIKNGQIGENNNLLDIILETKDERGEKLEDKDIIDLLIAFLFGAHDSIATASMWSVMYLAQNPLCLKKAKEEQEGILKARSTSQKRLSIEEIKKMIYLSQVVDETIRHITIFSAFREAAIDVNINGYFIPKGWKVLVWLSALHMDPEYYSNPKEFNPTRWDDYNPGSGTFIPFGVGRRLCPGRDLAKYEISIFLHYFVLNYKLERINPECPITSFPYSKPIDNCLAKVIKISDS

SEQ ID NO: 3864 - protein, 388 aa, Medicago truncatula
  misc_feature (1)..(388): useful for making plants with increased salt and oxidative stress resistance as described in USSN 12/922,143
  misc_feature (1)..(388): Public GI ID no.84514201
  misc_feature (1)..(388): Bit score of 134.7 for HMM based on sequences of FIGURE 7 of USSN 12/922,143.
  misc_feature (211)..(387): Pfam Name: p450 Pfam Description: Cytochrome P450
  misc_feature (1)..(388): Functional Homolog Of Ceres SEEDLINE ID no. ME06336
MELSIMLCFFTSILFIVLFRIFIKSFVSKRHDLPLPPGSMGWPYIGETFQLYSQDPNVFFASKIKRYGSMFKSHILGCPCVMISSPEAAKFVLNKAQLFKPTFPASKERMLGKQAIFFHQGEYHANLRRLVLRTFMPVAIRNIVPDIESIAEDSLKSMEGRLITTFLEMKTFTFNVALLSIFGKDEIHYREQLKQCYYTLEKGYNSMPINLPGTLFHKAMKARKELAQILAQIISSRREKKEEYKDLLGSFMDEKSGLSDEQIANNVIGVIFATRDTTASVLTWIVKYLGENISALESVIEEQESILKSKEENGEEKGLNWEDTKKMVITSRVIQETLRVASILSFTFREAVEDVEYQGYLIPKGWKVLPLFRNIHHSPNNFKDPEKV

SEQ ID NO: 3865 - protein, 495 aa, Taxus chinensis
  misc_feature (1)..(495): useful for making plants with increased salt and oxidative stress resistance as described in USSN 12/922,143
  misc_feature (1)..(495): Public GI ID no.55668263
  misc_feature (1)..(495): Bit score of 227.3 for HMM based on sequences of FIGURE 7 of USSN 12/922,143.
  misc_feature (245)..(463): Pfam Name: p450 Pfam Description: Cytochrome P450
  misc_feature (1)..(495): Functional Homolog Of Ceres SEEDLINE ID no. ME06336
MDAMDLTVAKFKEFTQLQSSAILLTAVSGIIVIVILLLRSKRRSSLKLPPGKLGLPLIGESLSFQWALRSNTLEQFVDKRVKKYGNVFKTSLLGQPTVVLCGAAGNRLILSNQEKLLSRTVSDRVAKLTGDNSISVIVGDSHRIIRAAVAGFLGPAGLQIHIGEMSAHIRNHINQVWKGKDEVNVLSLARELVFATSASLFLNINDREEQHQLHKTPETILAGYFSVPINFPGFAFRKALEGNSKRRKHFSVLLEKRRRDLSLGLASRNQDLLSVLLTFKDDKGNPLTDEDDLDNISALIDGSYESTSSQMAVLLKLLSAHPQCYEKVVQEQLEIASHKKEGEEITWKDVKAMRYTWQVMQETLRMFAPVFGPRGKAITDIHYDGYTIPKGWQLSWATYSTHQNDTYFNEPDKFMPSRFDEEGGRLAPYTFVPFGGGRRTCLGWEFAKTEILLFVHHFVKTFSAYTPIDPHESIRGRPLPPVPANGFPIKLISRS

SEQ ID NO: 3866 - DNA, 1320 bp, Gossypium hirsutum
  misc_feature (1)..(1320): useful for making plants with increased salt and oxidative stress resistance as described in USSN 12/922,143
  misc_feature (1)..(1320): Ceres CLONE ID no.1919620
  misc_feature (1227)..(1227): s is g or c
aaaacacagagaagtgaagaaatggagttagatttgtggagtattgctataattgtggtaacatttgttgtttcatttggattccttaagaaagcttatgagagattagggcagcagcagcttaagtccctccctccaggtgatatgggatggccattgattgggaatacgtggtctttcataagagcttacaaatcccaaaacccagaatctttcatcaacaatttgaagaaaaggtacggtaaaacagggatttacaagacccatttgtttgggaaggcaagcatcttagtttgcagtgcggagttatgtaagaaagtgttgacagatgacaataactttcaatggggctaccctgtttcaaatctgattcagggtgatgtgccattcgactacatgtctagtcacaggcgacttcacaggctagtgacaacggttctcaatcaacaccaacccccttcatcgcatttagggaccattgagaaaatcgttatcaacacactggaagaatggagtaagatgaaggaaccgatccttttcgttcctgaggtgaataagtttgtgttcaaactcattatagccatctttcttggctctggaactgacgataatcaaattgcatccatggaggagtattatagaaaagtatactatggattacataccactcccattaacatccctggttttgcataccatagagcagtccaggcaaggaaggtgctggtgaataagattcgaggtgtattgggtgaaaggagagagaggagatgtaatgaccccgacccaaacacaggcataatcgactttttggagaaagctgattatgaggatagtagacctatgagccatgaacaccttgttgttttattaatcgggctcttcattgcgggtcgtgaaactacatctcgaacggctatatgggccaccatctatctccataatcatccccatctgttgcataaggccaaggaagagcaggaggaaatcgtgaaaagaagaccttcttcccagaaaggtttaaccttcaccgaaattaaacaaatgaaatatctatccaaggtgattaatgagacactacgaatacgcaccaataatttttcaatctttcgagaagcaaaaaatgtaacttatctcaatggctaccagataccacaaggctggaaagtgttggtatggacaagtgcagttcatatggaccctgaaatttatcccaacccaaaccasttccttccttcaagatgggatgattttatacccatagccggggcttttctacccttttcaacaggaagtagtacctgtcctggagctgatttg

SEQ ID NO: 3867 - protein, 433 aa, Gossypium hirsutum
  misc_feature (1)..(433): useful for making plants with increased salt and oxidative stress resistance as described in USSN 12/922,143
  misc_feature (1)..(433): Ceres CLONE ID no.1919620
  misc_feature (1)..(433): Bit score of 123.2 for HMM based on sequences of FIGURE 7 of USSN 12/922,143.
  misc_feature (220)..(430): Pfam Name: p450 Pfam Description: Cytochrome P450
  misc_feature (1)..(433): Functional Homolog Of Ceres SEEDLINE ID no. ME06336
  misc_feature (402)..(402): Xaa is any aa, unknown or other
MELDLWSIAIIVVTFVVSFGFLKKAYERLGQQQLKSLPPGDMGWPLIGNTWSFIRAYKSQNPESFINNLKKRYGKTGIYKTHLFGKASILVCSAELCKKVLTDDNNFQWGYPVSNLIQGDVPFDYMSSHRRLHRLVTTVLNQHQPPSSHLGTIEKIVINTLEEWSKMKEPILFVPEVNKFVFKLIIAIFLGSGTDDNQIASMEEYYRKVYYGLHTTPINIPGFAYHRAVQARKVLVNKIRGVLGERRERRCNDPDPNTGIIDFLEKADYEDSRPMSHEHLVVLLIGLFIAGRETTSRTAIWATIYLHNHPHLLHKAKEEQEEIVKRRPSSQKGLTFTEIKQMKYLSKVINETLRIRTNNFSIFREAKNVTYLNGYQIPQGWKVLVWTSAVHMDPEIYPNPNXFLPSRWDDFIPIAGAFLPFSTGSSTCPGADL

SEQ ID NO: 3868 - DNA, 1691 bp, Gossypium hirsutum
  misc_feature (1)..(1691): useful for making plants with increased salt and oxidative stress resistance as described in USSN 12/922,143
  misc_feature (1)..(1691): Ceres CLONE ID no.1946684
atccattaaattttcccacgctttctttctcaagtaagctaaaaatcgccacggaaatggagatggagctttctccacttgtttcactcactgctcctactagtcttctcacacttgctattattttcgttgtcatctttgcactaagacccaaacccaaatcgagtagcgacaaagagcttccaccagggagcttagggtggccaatcgtcggcgaaactctcgagttcctgttggggaacccggaaaatttcgtgtttaatcggatgagaaaatattctcctcgtattttcaaaacaaagattctcggcgaagaaaccgtcgtcatatgtggtccggaaggacacaaatttttgttctcaaacgaacaaaagctcttcaccgctttccgacttcactccacccagaaactattccgatcttaccagtcctcctccgccacgtccgtacaaagctcctgcgacacagactcgaaaaaaatcttgcgttcgccgggattcttgaaacccgaagcattaatgaggtatttaggcaaaatggacgccataacacagcaacaaatggagaaatactgggaaaaaaaagaccaagtgaaggcgtttccactcgcaaagaccttaactttgactctcgcatgtcgtttctttttaggaatcgatgaaccagagcgtatctccaggcttgttaaaagtttcgacgatataactttggggatgcattcgattcctttggattttccggggacggctttttataaagctaataaggctgcggcagcgatacggagggagcttaaggaggttataaaagagaagaaagctgctatggtgacggaagttgccatgcaagatatactttgtcatatgattgtggccaccgatgagaccggcaaatacatggcggaagctgagattgccgataagattatgggattgttggtcgccggatacagcaccgtcgctactgctataaccttcttcatgaaatacgttggcgagagacctcacatctatgccaaaattctagcagaacaattgcaagtagaaggtgataaaaaggcaggggagatgttggaatgggatgacatacaaaaaatgaaatattcatggaatgtgatgtatgaagtgatgagactcacacctccactccaaggcactttcagagaggccctcactgattttacttatgctggttacactgttccaaagggttggaagatatattggacggtaagcacaacaaacaagaacccagaatattttccggaaccggagaaattcgatccatcgagatacgatgaagggaacaaactgccgccgtttacatacgttccgttcggcggtgggcctcgaatgtgccccggaaaagagtatgcaagattggctatcctcgctttcgtgcataacgttgtgaaaaggtttcaatgggaattggtgaatccaaaggaaaagattgttggtgatatgatgccaacacccaataatggtcttcctattcgtctaactctacgccattaaaagacctactagttttcgcacctagaaaattataaaggttaaattgtagtttaagtccctctacttaaaatttgacatttagtccttatgttttagtttttcataatttgatctctgacatcagttagaacaaatatttaatcatgaaggaaaaattaagatgtttattttcgg

SEQ ID NO: 3869 - protein, 486 aa, Gossypium hirsutum
  misc_feature (1)..(486): useful for making plants with increased salt and oxidative stress resistance as described in USSN 12/922,143
  misc_feature (1)..(486): Ceres CLONE ID no.1946684
  misc_feature (1)..(486): Bit score of 160.2 for HMM based on sequences of FIGURE 7 of USSN 12/922,143.
  misc_feature (227)..(480): Pfam Name: p450 Pfam Description: Cytochrome P450
  misc_feature (1)..(486): Functional Homolog Of Ceres SEEDLINE ID no. ME06336
MEMELSPLVSLTAPTSLLTLAIIFVVIFALRPKPKSSSDKELPPGSLGWPIVGETLEFLLGNPENFVFNRMRKYSPRIFKTKILGEETVVICGPEGHKFLFSNEQKLFTAFRLHSTQKLFRSYQSSSATSVQSSCDTDSKKILRSPGFLKPEALMRYLGKMDAITQQQMEKYWEKKDQVKAFPLAKTLTLTLACRFFLGIDEPERISRLVKSFDDITLGMHSIPLDFPGTAFYKANKAAAAIRRELKEVIKEKKAAMVTEVAMQDILCHMIVATDETGKYMAEAEIADKIMGLLVAGYSTVATAITFFMKYVGERPHIYAKILAEQLQVEGDKKAGEMLEWDDIQKMKYSWNVMYEVMRLTPPLQGTFREALTDFTYAGYTVPKGWKIYWTVSTTNKNPEYFPEPEKFDPSRYDEGNKLPPFTYVPFGGGPRMCPGKEYARLAILAFVHNVVKRFQWELVNPKEKIVGDMMPTPNNGLPIRLTLRH

SEQ ID NO: 3870 - protein, 465 aa, Phaseolus vulgaris
  misc_feature (1)..(465): useful for making plants with increased salt and oxidative stress resistance as described in USSN 12/922,143
  misc_feature (1)..(465): Public GI ID no.86129700
  misc_feature (1)..(465): Bit score of 164.6 for HMM based on sequences of FIGURE 7 of USSN 12/922,143.
  misc_feature (359)..(429): Pfam Name: p450 Pfam Description: Cytochrome P450
  misc_feature (1)..(465): Functional Homolog Of Ceres SEEDLINE ID no. ME06336
  misc_feature (242)..(242): Xaa is any aa, unknown or other
MDLSAILLLGARGLFFFLFRRLIKSFRSFGSHFPLLPGTMVCPYFGETFQMYSQDPNVFFATKIKRYGSMFKSHILGYPCVMISNPEAAKFVLHKAQLFKPTFPASKQRMLGTQAIFFHQGAYHATLRKLVLRSFTTEAIKNVVSDIESIAQTCLKSWEGKFITTFLEMKTYTFNVALLSIFGKDETLNAEDLKRCYYTLERGYNSMPINLPGTLFHKAMKARKELAEILAQKISTRRKMKXRTHDLMGSFMNEKAGFTDEQIICYIIGCIFAARDTTASVLTWMVWYLGRNPSVLETATEEEKCILETKGGSGEDQGQKPNDTDKMPLSSRVFQYTKQFFSIPCLWFCVAVVDIISSGYLIPKGWKVLPLFRNIHHSPDNFKEPEKFDPSRFEVAPKPNTFMPFGNGVHSCPGNVLAKLEIFVLLHHITTKFWCSIMGANNGIQYGPFSLPQNGLPSTLYLKKQ

SEQ ID NO: 3871 - DNA, 1667 bp, Arabidopsis thaliana
  misc_feature (1)..(1667): useful for making plants with increased salt and oxidative stress resistance as described in USSN 12/922,143
  misc_feature (1)..(1667): Ceres CLONE ID no.11278
aaccaaagactcttaaccatctcttctctctctctttgaaaacatagcacacacaaaaaaaaaacagagcaaaaagaaaaaacaaagatgggcataatgatgatgattttgggtcttcttgtgatcattgtttgtttatgtactgctcttctccgatggaaccagatgcgatattctaagaaaggtcttcctcctggaaccatgggctggccaatatttggtgaaaccactgagtttcttaaacaaggaccagatttcatgaaaaaccaaagactaagatatgggagtttcttcaagtctcacattcttggctgcccaacaatagtctcaatggacgcagagttaaacagatacattctaatgaatgaatcgaaaggacttgttgccggttacccgcaatctatgcttgatattctagggacatgcaacatagctgcggttcatggcccgagccaccggctaatgagaggctcgttgctttctttaataagcccaaccatgatgaaagaccatctcttgcctaagattgatgatttcatgagaaactatctttgcggttgggatgatcttgagacagttgatatccaagaaaagaccaaacatatggcatttttatcatcgttgttacaaatagctgagactttgaaaaaaccagaggttgaagaatatagaacagagtttttcaagcttgttgtgggaactctatcggtcccgatcgatatcccgggaacgaattaccgcagtggagtccaagcaagaaacaacatcgataggttattgacagaactgatgcaagaaagaaaagagtctggagaaactttcacagacatgttgggttacttgatgaagaaggaagataaccgatacttgttaaccgataaagagataagagatcaagtggtaacgatcttgtattccggttatgagactgtctctacaacctccatgatggctcttaagtatctccatgatcatccaaaagctcttgaagaactcagaagagaacatttggctataagggagagaaaacgacctgacgaaccgctcactctcgacgatattaaatcgatgaaattcactcgagctgtgatctttgagacatcaagattggcaacgattgttaatggtgtccttaggaaaactactcacgacttagaactcaacggttatttaatcccaaaaggttggagaatttacgtatacacaagagagattaactatgatacatctctttatgaagatccaatgatctttaacccatggagatggatggaaaagagcttagaatcaaagagctatttcttactctttggaggtggagttaggctttgccctggaaaggaactaggaatctcggaagtctcaagcttccttcactactttgttacaaaatatagatgggaagagaatggagaagacaaattaatggtctttccaagagtttctgcaccaaaaggataccatcttaagtgttcaccttactgactagttttgtcctaatattgaaaaatgtgtaaataaatctattaagggtcattttgtagggctaattaacctattttatctattaaatctctcaagatcatagaggagatggataatgtacagagagagagagagaagaagaaaatggaatatagaaaaaaataaaatatttgaaatgttgt

SEQ ID NO: 3872 - protein, 465 aa, Arabidopsis thaliana
  misc_feature (1)..(465): useful for making plants with increased salt and oxidative stress resistance as described in USSN 12/922,143
  misc_feature (1)..(465): Ceres CLONE ID no.11278
  misc_feature (1)..(465): Bit score of 365.4 for HMM based on sequences of FIGURE 7 of USSN 12/922,143.
  misc_feature (212)..(462): Pfam Name: p450 Pfam Description: Cytochrome P450
  misc_feature (1)..(465): Functional Homolog Of Ceres SEEDLINE ID no. ME06336
MGIMMMILGLLVIIVCLCTALLRWNQMRYSKKGLPPGTMGWPIFGETTEFLKQGPDFMKNQRLRYGSFFKSHILGCPTIVSMDAELNRYILMNESKGLVAGYPQSMLDILGTCNIAAVHGPSHRLMRGSLLSLISPTMMKDHLLPKIDDFMRNYLCGWDDLETVDIQEKTKHMAFLSSLLQIAETLKKPEVEEYRTEFFKLVVGTLSVPIDIPGTNYRSGVQARNNIDRLLTELMQERKESGETFTDMLGYLMKKEDNRYLLTDKEIRDQVVTILYSGYETVSTTSMMALKYLHDHPKALEELRREHLAIRERKRPDEPLTLDDIKSMKFTRAVIFETSRLATIVNGVLRKTTHDLELNGYLIPKGWRIYVYTREINYDTSLYEDPMIFNPWRWMEKSLESKSYFLLFGGGVRLCPGKELGISEVSSFLHYFVTKYRWEENGEDKLMVFPRVSAPKGYHLKCSPY

SEQ ID NO: 3873 - protein, 506 aa, Oryza sativa subsp. japonica
  misc_feature (1)..(506): useful for making plants with increased salt and oxidative stress resistance as described in USSN 12/922,143
  misc_feature (1)..(506): Public GI ID no.50253219
  misc_feature (1)..(506): Bit score of 429.6 for HMM based on sequences of FIGURE 7 of USSN 12/922,143.
  misc_feature (224)..(406): Pfam Name: p450 Pfam Description: Cytochrome P450
  misc_feature (1)..(506): Functional Homolog Of Ceres SEEDLINE ID no. ME06336
METLVCVAVWAVAMAMVVASVMWAYRWSHPRANGRLPPGSLGLPLLGETLQFFAPNTTCDISPFVKERLNRYGSIFKTSVVGRPVVVTADPEMNYYVFQQEGKLFESWYPDTFTEIFGRDNVGSLHGFMYKYLKSLVLRLYGQENLRAVLLDETDRACRTSLASWAAQPSVELKDSISAMIFDLTAKKLISYEPSKSSENLRKNFVAFIRGLISFPVDIPGTAYHECMKGRRNAMKVLKKMMRERMEEPGRQCEDFFDVLIEELGREKPVLTEGIALDLMFVLLFASFETTSLALTLGVRLLAENPTVLDALTEEHEAIVRGRKEGCDAAGLTWADYKSMTFTSQVTLEMVRLANIVPGIFRKALQDIEFKGYTIPAGWGVMVCPPAVHLNPEIYEDPLAFNPWRWQMQLTLVVLMLSGLSVGLIPKIYRVQQDKVEITGGSKHFMAFGGGLRFCVGTDLSKVLIATFIHHLVTKYRWKTVKGGNIVRTPGLSFPDGFHVQFFPKN

SEQ ID NO: 3874 - protein, 506 aa, Oryza sativa subsp. indica
  misc_feature (1)..(506): useful for making plants with increased salt and oxidative stress resistance as described in USSN 12/922,143
  misc_feature (1)..(506): Public GI ID no.125540653
  misc_feature (1)..(506): Bit score of 426.1 for HMM based on sequences of FIGURE 7 of USSN 12/922,143.
  misc_feature (224)..(406): Pfam Name: p450 Pfam Description: Cytochrome P450
  misc_feature (1)..(506): Functional Homolog Of Ceres SEEDLINE ID no. ME06336
METLVCVAVWAVAMAMVVASVMWAYRWSHPRANGRLPPGSLGLPLLGETLQFFAPNTTCDISPFVKERLNRYGSIFKTSVVGRPVVVTADPELNYYVFQQEGKLFESWYPDTFTEIFGRDNVGSLHGFMYKYLKSLVLRLYGQENLRAVLLDETDRACRASLASWAAQPSVELKDSISAMIFDLTAKKLISYEPSKSSENLRKNFVAFIRGLISFPVDIPGTAYHECMKGRRNAMKVLKKMMRERMEEPGRQCEDFFDVLIEELGREKPVLTEGIALDLMFVLLFASFETTSLALTLGVRLLAENPTVLDALTEEHEAIVRGRKEGCDAAGLTWAEYKSMTFTSQVTLEMVRLANIVPGIFRKALQDIEFKGYTIPAGWGVMVCPPAVHLNPEIYEDPLAFNPWRWQMQLTLVVLILSGLSVGLIPKIYRVQQDKVEITGGSKHFMAFGGGLRFCVGTDLSKVLIATFIHHLVTKYRWKTVKGGNIVRTPGLSFPDGFHVQFFPKN

SEQ ID NO: 3875 - protein, 465 aa, Arabidopsis thaliana
  misc_feature (1)..(465): useful for making plants with increased salt and oxidative stress resistance as described in USSN 12/922,143
  misc_feature (1)..(465): Public GI ID no.9294419
  misc_feature (1)..(465): Bit score of 361.3 for HMM based on sequences of FIGURE 7 of USSN 12/922,143.
  misc_feature (212)..(462): Pfam Name: p450 Pfam Description: Cytochrome P450
  misc_feature (1)..(465): Functional Homolog Of Ceres SEEDLINE ID no. ME06336
MGIMMMILGLLVIIVCLCTALLRWNQMRYSKKGLPPGTMGWPIFGETTEFLKQGPDFMKNQRLRYGSFFKSHILGCPTIVSMDAELNRYILMNESKGLVAGYPQSMLDILGTCNIAAVHGPSHRLMRGSLLSLISPTMMKDHLLPKIDDFMRNYLCGWDDLETVDIQEKTKHMAFLSSLLQIAETLKKPEVEEYRTEFFKLVVGTLSVPIDIPGTNYRSGFQARNNIDRLLTELMQERKESGETFTDMLGYLMKKEDNRYLLTDKEIRDQVVTILYSGYETVSTTSMMALKYLHDHPKALEELRREHLAIRERKRPDEPLTLDDIKSMKFTRAVIFETSRLATIVNGVLRKTTHDLELNGYLIPKGWRIYVYTREINYDTSLYEDPMIFNPWRWMEKSLESKSYFLLFGGGVRLCPGKELGISEVSSFLHYFVTKYRWEENGEDKLMVFPRVSAPKGYHLKCSPY

SEQ ID NO: 3876 - protein, 468 aa, Arabidopsis thaliana
  misc_feature (1)..(468): useful for making plants with increased salt and oxidative stress resistance as described in USSN 12/922,143
  misc_feature (1)..(468): Public GI ID no.18402179
  misc_feature (1)..(468): Bit score of 337.2 for HMM based on sequences of FIGURE 7 of USSN 12/922,143.
  misc_feature (35)..(463): Pfam Name: p450 Pfam Description: Cytochrome P450
  misc_feature (1)..(468): Functional Homolog Of Ceres SEEDLINE ID no. ME06336
MAEIWFLVVPILILCLLLVRVIVSKKKKNSRGKLPPGSMGWPYLGETLQLYSQNPNVFFTSKQKRYGEIFKTRILGYPCVMLASPEAARFVLVTHAHMFKPTYPRSKEKLIGPSALFFHQGDYHSHIRKLVQSSFYPETIRKLIPDIEHIALSSLQSWANMPIVSTYQEMKKFAFDVGILAIFGHLESSYKEILKHNYNIVDKGYNSFPMSLPGTSYHKALMARKQLKTIVSEIICERREKRALQTDFLGHLLNFKNEKGRVLTQEQIADNIIGVLFAAQDTTASCLTWILKYLHDDQKLLEAVKAEQKAIYEENSREKKPLTWRQTRNMPLTHKVIVESLRMASIISFTFREAVVDVEYKGYLIPKGWKVMPLFRNIHHNPKYFSNPEVFDPSRFEVNPKPNTFMPFGSGVHACPGNELAKLQILIFLHHLVSNFRWEVKGGEKGIQYSPFPIPQNGLPATFRRHSL

SEQ ID NO: 3877 - protein, 440 aa, Solanum lycopersicum
  misc_feature (1)..(440): useful for making plants with increased salt and oxidative stress resistance as described in USSN 12/922,143
  misc_feature (1)..(440): Public GI ID no.89146804
  misc_feature (1)..(440): Bit score of 334.0 for HMM based on sequences of FIGURE 7 of USSN 12/922,143.
  misc_feature (211)..(429): Pfam Name: p450 Pfam Description: Cytochrome P450
  misc_feature (1)..(440): Functional Homolog Of Ceres SEEDLINE ID no. ME06336
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYLMNEEATRFKLTDDEMIDLIITILYSGYETVSTTSMMAVKYLHDHPKVLEELRKEHMAIREKKKPEDPIDYNDYRSMRFTRAVILETSRLATIVNGVLRKTTQDMEINGYIIPKGWRIYVYTRELNYDPRLYPDPYSFNPWRWMDKSLEHQNSFLVFGGGTRQCPGKELGVAEISTFLHYFVTKYRNRWR

SEQ ID NO: 3878 - DNA, 1711 bp, Gossypium hirsutum
  misc_feature (1)..(1711): useful for making plants with increased salt and oxidative stress resistance as described in USSN 12/922,143
  misc_feature (1)..(1711): Ceres CLONE ID no.1941409
attgctctcatcatcacaacaagatcccccctcaccattccattaatctcctttcattgctagctctcatcttttttagctatggagattgtttctattttactatacattatcctcttcctctccactcttctttcattattaaagaaacaaaagaatgggattcattttaaaaaattcaagcttccacctggttcaatgggttggccatacgttggtgaaactcttcaactctattctcaagacccaaatattttctttttaaccaaacaaaaaagatatggtgaaatattcaaaacccatatactgggttgcccttgtgtgatgttggccagccctgaggcggctaggttcgtgttggtgacacatgctcatttgttcaaaccgacgtacccgaagagcaaagagaggcttatcggtcctcacgcactgttctttcaccgaggcggataccatgctcggttgaggagattggtgcagaactcgttagcacctcaaactataaagaaattgatccctgatattcaaggcattgctgtttcgacactcgaatcatgggctgcttctggtcaagttgtaaacaccttttatgagatgaagaagttgtcattcgatgtcggcattttgtccatttttggtcacatagaaagagggttcagagagatgttggaggagaattaccggaaagtagacaaaggttacaattcctttccgacaaacattcctgggactgcttatcaacaagctatccttgcgaggaaaaggctgaaccggattttgggtgaaataataagctcaaggaaggagaaaaggctgttggagaaggacatgttgggccattttttaagcttcaaggatgaaaatgatcaaaaattgagcgatgagcagattgcagataacattattggagtactttttgcagcacaagacacaacagccagtgttataacatgggttcttaaattccttcatgatgatcccaaacttctagaagctgttaaggcagagcaaatggcaatatatgacgccaacaacggaggaaaaatgccattaacatgggaacaaacaagaagcatgcctcttacacatagggttgtaatggagagcttgaggatggcaagtattatatctttcacattcagggaagcagtagttgatgttgactacaaaggatacttaatacccaagggttggaaagtgatgccattattcaggaacattcatcataacccagaattttttcccaatcctcaagaattcgatccatctagatttgaggtagctccaaaagccaacaccttcatgccatttggaaacggcgttcatgcttgccccggcaatgaactggcgaagctggaggctctcattttgatccaccacctagtaacaaattttaggtgcgaggttgtgagttcaaaaagtggtattcaatatgggccattcccagtgcctcaacaaggactcccagccagattttggaaggaaccaaagcagttacaatcatgatgtttggtctttaattagtaattagttaactaatttggtaaaagagaatactattccatgctttcaccattgtaccaatagtccaaaccaatactttttatgctacctaatggaaccctattatttttcaccatggggtttctacaatcatgtatatattattacctttggctatggcacgtaataataagaaaaaaattaatgc

SEQ ID NO: 3879 - protein, 474 aa, Gossypium hirsutum
  misc_feature (1)..(474): useful for making plants with increased salt and oxidative stress resistance as described in USSN 12/922,143
  misc_feature (1)..(474): Ceres CLONE ID no.1941409
  misc_feature (1)..(474): Bit score of 329.1 for HMM based on sequences of FIGURE 7 of USSN 12/922,143.
  misc_feature (36)..(465): Pfam Name: p450 Pfam Description: Cytochrome P450
  misc_feature (1)..(474): Functional Homolog Of Ceres SEEDLINE ID no. ME06336
MEIVSILLYIILFLSTLLSLLKKQKNGIHFKKFKLPPGSMGWPYVGETLQLYSQDPNIFFLTKQKRYGEIFKTHILGCPCVMLASPEAARFVLVTHAHLFKPTYPKSKERLIGPHALFFHRGGYHARLRRLVQNSLAPQTIKKLIPDIQGIAVSTLESWAASGQVVNTFYEMKKLSFDVGILSIFGHIERGFREMLEENYRKVDKGYNSFPTNIPGTAYQQAILARKRLNRILGEIISSRKEKRLLEKDMLGHFLSFKDENDQKLSDEQIADNIIGVLFAAQDTTASVITWVLKFLHDDPKLLEAVKAEQMAIYDANNGGKMPLTWEQTRSMPLTHRVVMESLRMASIISFTFREAVVDVDYKGYLIPKGWKVMPLFRNIHHNPEFFPNPQEFDPSRFEVAPKANTFMPFGNGVHACPGNELAKLEALILIHHLVTNFRCEVVSSKSGIQYGPFPVPQQGLPARFWKEPKQLQS

SEQ ID NO: 3880 - DNA, 1877 bp, Glycine max
  misc_feature (1)..(1877): useful for making plants with increased salt and oxidative stress resistance as described in USSN 12/922,143
  misc_feature (1)..(1877): Ceres CLONE ID no.512411
acacacaccctcttctccttcttcttcttctttgtgttatccttcacacacctattacaagtcaagccactcaactcacactaacataaaaacatggaactaagcaccatgtttttcctgtgtgcttctcttctcttcattgttctcttcttcaggacactcatcaaaccttactatgtctccaaacgccgtgacttgccactcccacctggctccatgggttggccttacataggagaaacctttcaaatgtattctcaagacccaaatgtcttctttgcctcaaaaataaaaaggtttggctctatgtttaagtcccacattctaggttgtccctgcgtgatgatttccagccccgaggctgccaagtttgtgctgaacaaagctcaactcttcaagccaacattcccagcaagcaaagagaggatgttgggaaaacaagctatcttctttcaccaaggagagtaccatgctaacttgagaaggcttgttcttcgcaccttcatgccagaagccatcaaaaacatcgtaccggacattgaatccattgcccaagattgcttaaagtcttgggaaggccgtttgatcaccactttccttgaaatgaaaacgttcaccttcaacgttgctctgctttcaattttcggaaaagaagagattctgtacagagatgctctgaaacggtgctactacactctggagcaagggtataactcaatgccaattaacgttccgggaacactgttccacaaggcgatgaaggcaaggaaggagcttgcacaaatcgtggcccaaataatctggagcaggaggcagaggaagatgattgattacaaggacttgttgggttcattcatggatgagaaatcagggctcaccgacgaccagatagcggataatgttattggcgtcattttcgcagctcgtgacaccaccgccagtgtgctgacgtggatcgtcaagtacctcggtgaaaaccccagtgtcctagaagctgttaatgaggagcaagagtgcatattgaagagcaaggaagaaaggggagaagataagggtctaaattgggaagatgccaaaaagatgccaataacttcaagggtcattcaggagactctaagagttgcttcaattttgtcttttactttcagagaagcagtagaggatgtagaatatcaagggtatcttattccaaaagggtggaaagtgctacctctatttaggaacatacaccacagtccagacaacttcaaggagccagaaaaatttgatccctcaagatttgaggctgctccaaaacccaacacttttatgccatttggcagtgggatccacatgtgtccagggaacgaattagccaagttggagattttggtcctcctacatcatctgaccacaaagtacaggtggtctgttgtgggtgcaaagaatgggattcaatacggcccttttgctcttccccaaaacggcttacccatcacattatttcccaagaacaagtagatatcactcaaacaatggcttcatagtagctttctaaatatggaaagaattgcttcatagctctcaaaattggtttccatattgcaattggataaccaaacaagggagatcaacttttcccttctttttggccaagagaaacccaaaggggtagtcttgacaatagcatacaaacaggaagaatgtcaagtgtatatagaggaggaggtttcacagcctgagcaaatagtattaagttcttttcattttcttattttttttatccttcaaatgtgaagaaaagtcctcataagattgtattgatgcattcaactaattagttctgtatccataagaatgccgcaaggccaaaataaaagttaaattttggttctgag

SEQ ID NO: 3881 - protein, 463 aa, Glycine max
  misc_feature (1)..(463): useful for making plants with increased salt and oxidative stress resistance as described in USSN 12/922,143
  misc_feature (1)..(463): Ceres CLONE ID no.512411
  misc_feature (1)..(463): Bit score of 335.7 for HMM based on sequences of FIGURE 7 of USSN 12/922,143.
  misc_feature (33)..(458): Pfam Name: p450 Pfam Description: Cytochrome P450
  misc_feature (1)..(463): Functional Homolog Of Ceres SEEDLINE ID no. ME06336
MFFLCASLLFIVLFFRTLIKPYYVSKRRDLPLPPGSMGWPYIGETFQMYSQDPNVFFASKIKRFGSMFKSHILGCPCVMISSPEAAKFVLNKAQLFKPTFPASKERMLGKQAIFFHQGEYHANLRRLVLRTFMPEAIKNIVPDIESIAQDCLKSWEGRLITTFLEMKTFTFNVALLSIFGKEEILYRDALKRCYYTLEQGYNSMPINVPGTLFHKAMKARKELAQIVAQIIWSRRQRKMIDYKDLLGSFMDEKSGLTDDQIADNVIGVIFAARDTTASVLTWIVKYLGENPSVLEAVNEEQECILKSKEERGEDKGLNWEDAKKMPITSRVIQETLRVASILSFTFREAVEDVEYQGYLIPKGWKVLPLFRNIHHSPDNFKEPEKFDPSRFEAAPKPNTFMPFGSGIHMCPGNELAKLEILVLLHHLTTKYRWSVVGAKNGIQYGPFALPQNGLPITLFPKNK

SEQ ID NO: 3882 - DNA, 1808 bp, Gossypium hirsutum
  misc_feature (1)..(1808): useful for making plants with increased salt and oxidative stress resistance as described in USSN 12/922,143
  misc_feature (1)..(1808): Ceres CLONE ID no.1883912
acacaacttcttcaccattcagctaccaaaccaagatttccaccctatttataatttattaaacatggcattctatttcatgattcccttatttgcttccattttctttatttttctcttcaattttctgcttaatttgttcaaatccaaaaaatcccgggacttacccctcccgcctggcaccctgggttggccgtacatcggtgaaacctttcagctctactcccaaaacccaaatgtcttctttgcttccaagcagaaaaggtacggctccatattcaagacccatatacttgggtgtccctgtgtgatgatttccagcccggaagctgcgaaattcgtgcttgtcaccaagtctcacctcttcaagccaacgtttccggccagtaaagagaggatgttgggcaaacaagccattttctttagccaaggacagtaccatgccaaattgaggaagcttgtgctccgtgccttcgtgcctgaggccgtcaaaagcttcgtttctaacatcgaatccattgccaaagattctctccagtcattggaaggcaggctgattaccactttccaagaaatgaaaacgtacacattcaatgttgcgctgctatcgatattcggagaggatgaagtgaagtacagagaagatctgaagaggtgttattacatattagaaaaagggtataactcgatgcccattaatattccgggtacacttttcaacaaatcgatgaaagcaaggaaagagctagctcagatcctggccaaaatcatatcgaccaggagggaaacgaagcaggagtacaatgacttgttgggttctttcatgggtgataaagaaggcctcaccgatgaacaaatcgctgataacatcattggtgtaatctttgctgctcgtgacaccaccgctagtgtactcacttggataattaagtaccttggagaaaaccccagcgttcttcaagctgtcacggatgaacaagaggccatagtgaaaggtaaagagaaatgcggtgaggagcaaactctgagctgggcagataccaagaagatgcccataacttcaagagtgattcaggagacacttagggttgcttcgattttatcttttaccttcagagaagcagtggctgatgttgaatatgaagggtatcttataccaaaaggatggaaagttttaccactttttagaaacattcatcacagcccagaaatcttcccagatcctgaaaagtttgatccttcgagatttgaggttgttccaaaacccaatacatttatgccatttggcaatggaacacattcatgtccagggaatgagttagccaagctggaaatcatggtccttctccatcatctgaccacaaagtacaggtggtctatggtgggtacaaacagtggaattcagtatggtccttttgctcttccccagaatggtttgcccatcagattaatcagaaaatcataggcatgcactcaatttcttaattttagagtatgaagcaaagaatgcaaaggcaaagacagttccaacaaagagctttttggacaaatgaagaaacttgagatcataaataacaaaaatggaaagaaaaaaaaccaagtccccaaactgtacagaaaagaaaagcaaaatctgcaaacagtttcctgtttattctttcttactgtttattctttctttctccaactcatagcaaagaataacaaaaaatggaaaaggagtgtcttttgtaagctttcttaatttaaatgaagtccgcaaggcaaaaaaaaaaattcatatttatatgaattattgaaaattttac

SEQ ID NO: 3883 - protein, 466 aa, Gossypium hirsutum
  misc_feature (1)..(466): useful for making plants with increased salt and oxidative stress resistance as described in USSN 12/922,143
  misc_feature (1)..(466): Ceres CLONE ID no.1883912
  misc_feature (1)..(466): Bit score of 340.0 for HMM based on sequences of FIGURE 7 of USSN 12/922,143.
  misc_feature (37)..(464): Pfam Name: p450 Pfam Description: Cytochrome P450
  misc_feature (1)..(466): Functional Homolog Of Ceres SEEDLINE ID no. ME06336
MAFYFMIPLFASIFFIFLFNFLLNLFKSKKSRDLPLPPGTLGWPYIGETFQLYSQNPNVFFASKQKRYGSIFKTHILGCPCVMISSPEAAKFVLVTKSHLFKPTFPASKERMLGKQAIFFSQGQYHAKLRKLVLRAFVPEAVKSFVSNIESIAKDSLQSLEGRLITTFQEMKTYTFNVALLSIFGEDEVKYREDLKRCYYILEKGYNSMPINIPGTLFNKSMKARKELAQILAKIISTRRETKQEYNDLLGSFMGDKEGLTDEQIADNIIGVIFAARDTTASVLTWIIKYLGENPSVLQAVTDEQEAIVKGKEKCGEEQTLSWADTKKMPITSRVIQETLRVASILSFTFREAVADVEYEGYLIPKGWKVLPLFRNIHHSPEIFPDPEKFDPSRFEVVPKPNTFMPFGNGTHSCPGNELAKLEIMVLLHHLTTKYRWSMVGTNSGIQYGPFALPQNGLPIRLIRKS

SEQ ID NO: 3884 - DNA, 1893 bp, Glycine max
  misc_feature (1)..(1893): useful for making plants with increased salt and oxidative stress resistance as described in USSN 12/922,143
  misc_feature (1)..(1893): Ceres CLONE ID no.1236416
attcattgacttgaaaagccatcgaagcaaattaaaacgcattccacacctatcatcacatttcgtcatattatttccacataacccgcactcgcgggaactcacatagagagagaagttagttgctacctacgccttgtgtgtgtgtgtgtgtttatggagatcattgccaccattttcttttgcattttactcatcttctcatcccttattctttcgtatccattaataaagaaacacaagaaacaacaacacgtagtagctaagcctaagcttccccctggctcaatgggctggccttacataggagagacccttcaactctattctcaagaccctaacatcttctttgcttcaaagcaaaaaagatatggagaaattttcaagacacacatactaggttgtccatgcgtgatgttggctagccctgaggctgcacgttttgtgttggtgactcatgctcacttgttcaaacccacatacccaaaaagcaaagagaagctaataggcacttcagcattgttcttccaccaaggagaataccacactcgtatcaggaagctggtgcaaacctctctctctcctgaaaccatccgaaaactgatcccagacatcgaaaccgaggtcgtttcctctttggaatcgtgggtttccactggacaagtcatcaacgctttccaagaaatgaaaaagttctctttcaatattggcatcctctctgtctttggtcacttggaagacaattatagagaccagcttaaggaaaactactgcatagtggagaaagggtacaattctttccctaacaggattcccggaactgtatactccaaagcactcttggcaaggaggagaatcagggagattataagtgagatcatttgtaaaagaaaggagcagagattgatggagatggatctattaggccacttgctgaactacaaggatgaaaaagaacaaacgctaagtgatgaccaaattgctgataatgtaattggggtactatttgcagctcaggatactacagcaagtgttctaacctggattctcaagtatcttcatgatgaccagaaacttcttgaagcaataaaagcagaccaaatggcagtatatgaagctaatgaaggagggaaaaagccattgacatggggtcagaccagaaatatgccaactactcatagggtgattttggaaagccttagaatgtcaagtatcatatcatttacttttagggaagctgtggttgatgtagtatacaaaggatatcttataccgaagggttggaaagtcatgccactgttcaggaacatccatcataatccagaatttcacccttctcctcacaattttgacccatcaaggtttgaggttgctccaaagcccaatacttttacaccatttggcaacggagtgcactcttgtccaggaaatgagcttgccaaactgaacatgttcattttaattcatcatctagtaaccaaatataggtgggaagtagtgggatatcagaacggaatccaacatagcccattcccagtccctctgcatggtctacctacaagattttggagaaacgaatagaatcaaagatgatcatcatatgataaaatctccctttattcatatataaaatttagatattccttgccaccccaccccaacttgatattgattgttcctccttaacccatcccatggccaattctcctgttttaaaagtgaggatccaaaaaaattgtcttattagcttcttccaagtaacatcatgtgtattatcctatttgtaagtaaatggtggcagtggcatatatagcttagtgccattaattagtctgagcgtgcatgtaagctgtactaataataataaatgttatcaactaatgattttagttt

SEQ ID NO: 3885 - protein, 474 aa, Glycine max
  misc_feature (1)..(474): useful for making plants with increased salt and oxidative stress resistance as described in USSN 12/922,143
  misc_feature (1)..(474): Ceres CLONE ID no.1236416
  misc_feature (1)..(474): Bit score of 320.7 for HMM based on sequences of FIGURE 7 of USSN 12/922,143.
  misc_feature (41)..(447): Pfam Name: p450 Pfam Description: Cytochrome P450
  misc_feature (1)..(474): Functional Homolog Of Ceres SEEDLINE ID no. ME06336
MEIIATIFFCILLIFSSLILSYPLIKKHKKQQHVVAKPKLPPGSMGWPYIGETLQLYSQDPNIFFASKQKRYGEIFKTHILGCPCVMLASPEAARFVLVTHAHLFKPTYPKSKEKLIGTSALFFHQGEYHTRIRKLVQTSLSPETIRKLIPDIETEVVSSLESWVSTGQVINAFQEMKKFSFNIGILSVFGHLEDNYRDQLKENYCIVEKGYNSFPNRIPGTVYSKALLARRRIREIISEIICKRKEQRLMEMDLLGHLLNYKDEKEQTLSDDQIADNVIGVLFAAQDTTASVLTWILKYLHDDQKLLEAIKADQMAVYEANEGGKKPLTWGQTRNMPTTHRVILESLRMSSIISFTFREAVVDVVYKGYLIPKGWKVMPLFRNIHHNPEFHPSPHNFDPSRFEVAPKPNTFTPFGNGVHSCPGNELAKLNMFILIHHLVTKYRWEVVGYQNGIQHSPFPVPLHGLPTRFWRNE

SEQ ID NO: 3886 - protein, 464 aa, Phaseolus vulgaris
  misc_feature (1)..(464): useful for making plants with increased salt and oxidative stress resistance as described in USSN 12/922,143
  misc_feature (1)..(464): Public GI ID no.86129698
  misc_feature (1)..(464): Bit score of 332.7 for HMM based on sequences of FIGURE 7 of USSN 12/922,143.
  misc_feature (36)..(460): Pfam Name: p450 Pfam Description: Cytochrome P450
  misc_feature (1)..(464): Functional Homolog Of Ceres SEEDLINE ID no. ME06336
MELSTILCLGASFLFIFLFRTLIKQFLSKRPHFPLPPGTMGWPYIGETFQMYSQDPNVFFASKIKRYGSMFKSHILGCPCVMISSPEAAKFVLNKAQLFKPTFPASKERMLGKQAIFFHQGEYHANLRRLVLRTFMPEAIKNIVPDIESIAQDSLKSWEGRLITTFLEMKTFTFNVALLSIFGKEEILYRDALKRCYYTLEQGYNSMPINVPGTLFHKAMKARKELAQIVAQIISSRRQRKQDYKDLLGSFMGEKAGLTDEQIADNVIGVIFAARDTTASVLTWIVKYLGENPSVLEAVTEEQECILKTKEESGEDKGLNWEDTKKMPITSRVIQETLRVASILSFTFREAVEDVEYQGYLIPKGWKVLPLFRNIHHSPDNFKEPEKFDPSRFEAAPKPNTFMPFGSGIHSCPGNELAKLEILVLLHHLTTKFRWSVVGAKNGIQYGPFSLPQNGLPITLYPKK

SEQ ID NO: 3887 - protein, 500 aa, Oryza sativa subsp. indica
  misc_feature (1)..(500): useful for making plants with increased salt and oxidative stress resistance as described in USSN 12/922,143
  misc_feature (1)..(500): Public GI ID no.125563993
  misc_feature (1)..(500): Bit score of 328.1 for HMM based on sequences of FIGURE 7 of USSN 12/922,143.
  misc_feature (45)..(474): Pfam Name: p450 Pfam Description: Cytochrome P450
  misc_feature (1)..(500): Functional Homolog Of Ceres SEEDLINE ID no. ME06336
MAASFVIVIVISFFISLAFMCYVHYTSRQRRKLHGYGHEKAVRLPPGSMGWPYIGETLQLYSQDPNVFFASKQKRYGEIFKTHILGCPCVMLASPEAARFVLVTQAHLFKPTYPRSKERMIGPSALFFNQGDYHLRLRKLVQGPLGPDALRALVPDVEAAVRSTLASWDGNVSSTFHAMKRLSFDVGIVTIFGGRLDERRKAELRQNYAIVEKGYNSFPNSFPGTLYYKAIQARRRLHGVLSDIMRERRARGEPGSDLLGCLMQSRAGDDGALLTDEQVADNIIGVLFAAQDTTASVLTWIVKYLHDHPKLLEAVRAEQAAIRAANDGGRLPLTWAQTRSMALTHKVILESLRMASIISFTFREAVADVEYKGFLIPKGWKVMPLFRNIHHNPDYFQDPQKFDPSRFKVSPRPNTFMPFGNGVHACPGNELAKLEMLVLIHHLVTGYRWEIVGSSDEVEYSPFPVPKHGLLAKLWRDDTVSVETDGCQNGDNDDNGVAMV

SEQ ID NO: 3888 - protein, 475 aa, Solanum tuberosum
  misc_feature (1)..(475): useful for making plants with increased salt and oxidative stress resistance as described in USSN 12/922,143
  misc_feature (1)..(475): Public GI ID no.76803521
  misc_feature (1)..(475): Bit score of 342.5 for HMM based on sequences of FIGURE 7 of USSN 12/922,143.
  misc_feature (41)..(470): Pfam Name: p450 Pfam Description: Cytochrome P450
  misc_feature (1)..(475): Functional Homolog Of Ceres SEEDLINE ID no. ME06336
MVNYFEIFFYISIFLLGILSYYFCFSKKYNSSSKKNAYKLPPGSMGWPYIGETLQLYSQDPNAFFINRQRRFGEIFKTKILGCPCVMLASPEAARFVLVNQANLFKPTYPKSKENLIGQSALFFHQGDYHNHLRKLVQASLNPESIRNQIPYIEELSISALNSWVGGHVVNTYHEMKKFSFEVGILAIFGHLDGHVKEELKKNYSIVDKGYNSFPINLPGSLYRKSLQARKRLGKILSEIIRERKEKKVLEKGLLSCFLNAKEEKGLLVLNEDQIADNIIGVLFAAQDTTASVLTWILKYLHDNPKLLECVKAEQKVILQSNEQENHGLTWTQTRKMPITNKVVLETLRMASIISFAFREAVADVEYKGYLIPKGWKVMPLFRNIHHNPEFFPDPQKFDPSRFENAPKPNTFMPFGSGVHACPGNELAKLEILIMTHHLVTKFRWEVVGSGSGIQYGPFPVPLGGLAARFWKEST

SEQ ID NO: 3889 - protein, 496 aa, Cucurbita maxima
  misc_feature (1)..(496): useful for making plants with increased salt and oxidative stress resistance as described in USSN 12/922,143
  misc_feature (1)..(496): Public GI ID no.11934677
  misc_feature (1)..(496): Bit score of 310.5 for HMM based on sequences of FIGURE 7 of USSN 12/922,143.
  misc_feature (48)..(488): Pfam Name: p450 Pfam Description: Cytochrome P450
  misc_feature (1)..(496): Functional Homolog Of Ceres SEEDLINE ID no. ME06336
MESTWAVAAVVTAVVAVATVFSVLKWAAKSLNEWIYEAKLGDRRLALPPGDLGWPLIGNMLGFLRAFKSKNPETFIDGYVSRYGKTGVYKVHLFGNPSVVVTTPETCRKVLTDDEAFQPGWPRAAVELIGEKSFIQMPQEEHKRLRRLTSAPVNGFEALSNYIPYIEKNVLESLEKWSKMGPIEFLTQLRKLTFTVIMYIFLSSESEPVMEMLEKEYTRLNYGVRDMRINLPGFAYHKALKARKNLVAALKGIVTERRRQKLDKWAPKRKDMMDQLIDIVDENGRKLDDEEIIDILIMYLNAGHESSGHTMMWATILLNQHPEVLKKAREEQEAIVRNRPAGQTGLTLKECRDMEYLSKVVDETLRYVSFSLVVFREAQMDVNLNGYLIPKGWKVLAWFRSIHYDSEVYPDPKKFEPSRWDGFVPKAGEFLPFGAGSRLCPGNDLAKLEICIFVHYFLLNYNLEWLTPDCEILYLPHSRPKDNCMAKITKKSSVAA

SEQ ID NO: 3890 - protein, 493 aa, Picea sitchensis
  misc_feature (1)..(493): useful for making plants with increased salt and oxidative stress resistance as described in USSN 12/922,143
  misc_feature (1)..(493): Public GI ID no.59800274
  misc_feature (1)..(493): Bit score of 314.1 for HMM based on sequences of FIGURE 7 of USSN 12/922,143.
  misc_feature (52)..(491): Pfam Name: p450 Pfam Description: Cytochrome P450
  misc_feature (1)..(493): Functional Homolog Of Ceres SEEDLINE ID no. ME06336
MVWKEAVSVLQKAQELKEPPLMFTVFLASFIGLAFFFYLISNHRTKAWRGIPPGTFGWPLIGETLEFLGCQRKGNPRDFFDSRTQKYGNVFTTSLVGHPTVVFCSPEGNRFLFSNENKLVVNSWPSSVGNLFRSSLITTVGDDAKRLRRILMTFLRPEALREFVGRVDSMTKRHLAEHWIGKDEVMALPLLKRYTFSLACDLFASINTKDDLDRLWLHFMVFVKGVMQIPIDLPGTRYNKTKHAANAIRQQLGSIINERKIALEAGNASPEQDLLSFLLSNVDEQGESLTDNEIQDNILLLLYAGHDTSSSTLTVLLKFLAENPHCYEEVLREQLNIAGSKEEGQLLEWEDLQRMKYSWRVAQEALRLFPAVQGSFRKAIKEFIYDGFTIPKGWKLHWTVNSTHQKSEYFSNPEKFDPSRFEGEGPPPYTFVPFGGGPRMCPGNEFARMEILIFLHNIVKNFNWNLVNPLEKVIVDPMPAPVNGLPIKLVPHD

SEQ ID NO: 3891 - protein, 482 aa, Medicago truncatula
  misc_feature (1)..(482): useful for making plants with increased salt and oxidative stress resistance as described in USSN 12/922,143
  misc_feature (1)..(482): Public GI ID no.92887507
  misc_feature (1)..(482): Bit score of 315.2 for HMM based on sequences of FIGURE 7 of USSN 12/922,143.
  misc_feature (36)..(464): Pfam Name: p450 Pfam Description: Cytochrome P450
  misc_feature (1)..(482): Functional Homolog Of Ceres SEEDLINE ID no. ME06336
MDSTLAYIIVLFLLTLFSFKFFPKRPKTKQTSAKLPPGSMGWPYIGQTLQLYSQDPNVFFFSKQKRYGEIFKTNILGCKCVMLASPEAARFVLVTQSHLFKPTYPKSKERLIGPCALFFHQGEYHLRLRKLIQRSLSLDSLRNLVPEIEALAVSTIKSWGDDGCMINTFKEMKKFSFEVGILKVFGNLEPRLREELKKNYWIVDNGYNSFPTQIPGTQYKKALLAREKLGSILKEIISERKEKKLLESERDLLSCLLNWKGEGGEILSDDEIGDNIIGVLFAAQDTTATVMTWVIKYLHDQPKLLECVKAEQKAIHMENDGKLQLNWNQTRNMPITYKVVLESMRMASVISFPFREAVADVEYKGFLIPKGWKAMPLFRNIHHNPEFFPEPHKFNPSRFEVSPKPNTFLPFGSGVHACPGNELAKLETLIMIHHLVTKFRLEVVGSQCGIQYGPFPLPLNGLPARCWRESTSIARKRFIGQK

SEQ ID NO: 3892 - protein, 497 aa, Picea sitchensis
  misc_feature (1)..(497): useful for making plants with increased salt and oxidative stress resistance as described in USSN 12/922,143
  misc_feature (1)..(497): Public GI ID no.59800276
  misc_feature (1)..(497): Bit score of 308.8 for HMM based on sequences of FIGURE 7 of USSN 12/922,143.
  misc_feature (52)..(491): Pfam Name: p450 Pfam Description: Cytochrome P450
  misc_feature (1)..(497): Functional Homolog Of Ceres SEEDLINE ID no. ME06336
MVWKEAVSVLQKAQELKEPPLMFTVFLASFIGLAFFFYLISNHRTKAWRGIPPGTFGWPLIGETLEFLGCQRKGNPRDFFDSRTQKYGNVFTTSLVGHPTVVFCSPEGNRFLFSNENKLVVNSWPSSVGNLFRSSLITTVGDDAKRLRRILMTFLRPEALREFVGRVDSMTKRHLAEHWIGKDEVTALPLLKRYTFSLACDLFASINNKDDLGRLWLHFMVFVKGVMQIPIDLPGTRYNKAKHAANAIRQQLGSIINERKIGLEAGNASPEQDLLSFLLSNVDEQGESLTDNEIQDNILLLLYAGHDTSSSTLTVLLKFLAENPHCYEEVLREQLDIAGSKEAGQLLEWEDLQRMKYSWRVAQEALRLFPAAQGSFRKAIKEFIYDGFTIPKGWKMYWTVNSTHRKSEYFSNPETFDPSRFEGEGPPPYTFVPFGGGPRMCPGNEFARLEILVFLHNIVKNCKWNLVNPGEKVIVDPMPAPVNGLPIKLVPHDSVYI

SEQ ID NO: 3893 - DNA, 1779 bp, Glycine max
  misc_feature (1)..(1779): useful for making plants with increased salt and oxidative stress resistance as described in USSN 12/922,143
  misc_feature (1)..(1779): Ceres CLONE ID no.598111
aaatgagcagagctaaaaaatatgctgcaattcttatttttattttcattttttgttttttaagaaaaaaggctaaccttctgactttccaaagaactgagtctagtaatacaccaatggatggaattttcgcttacaccattctcattttgcttaccatattttcatttatgttcttaccaaaaccaaacagaagaagacctcagaaccagacacttgcaaagctccctccaggctcaatggggtggccgtacataggagaaacccttcaactctattcccaagacccaaatgcctacttttccaccaaacataaaaggtatggcgaaatattcaagaccaacatcttgggttgcccctgtgtgatgctgacaagccctgaggctgcacgctttgtgctagtgactcaagctcacttgttcagaccaacatacccgaaaagcaaggagcgtttgattggtccttttgctctgtttttccaccaaggtgaataccacacacgtttgaggaagcttgttcagaggtcactgtctctagaagcacttcgcaacttggtgcctcatattgaagccttagccttatctgccatgaactcttggggtggtgatggccaagtcattaacacatttaaggaaatgaaaatgttttcttttgaagttggaatcctcacaatttttggctatctagagccgcgtttgagggaggagctgaagaagaattaccggattgtggacaatggttacaattcctttccaacgtgcatcccgggaacacaataccaaaaggcactattggctagaaggagacttggcaagattataggtgacataatttgtgagaggaaggagaagaagttgcttgaaagggatctattgagctgcttattgaattggaaaggtgaagggggagaagtgttatctgattaccaaattgcagataacattattggggtgctttttgctgctcaggacaccacagctagtgccatgacatgggttgtaaagtacctgcatgatgaacccaaacttctggagtctgtaaaggctgagcagaaggcaattcacaagtctaatgaaggtaacctaccactgagttgggatcagactagaaacatgcgaattactcacaaggttgtgttagagagtttgagaatggcaagcatcatatcattccctttcagagaagcaatagctgatgtggaatacaagggattcctaataccaaaagggtggaaagcgatgcctctgttcagaaatattcaccacaatccagaatattttccagagcctcagaagttcaacccttcaaggtttgaggtcgcaccaaagcccaatactttcatgccatttggtagtggagtacatgcctgccccggcaatgagcttgctaagctggagacactgattatgatccatcatttggtcaccaagtttcggtgggaagtggtaggatccaagtgtgggattcaatatggcccattccccttgccactgaatggactcccagctagatgttggagagaatctaccagctagaaaagcagcatgggaagaaaacgcatgatatcatatagctgagaagcaatccactttccaaagtcacaaaaaaataattatctttttcttttctatgttgactctgtaatttttactttttatttttccatggtgggggcacttcaatatttacccctctatccttaatccttttctacccctgaaagaaagaagcaacaggggtgtggtgctttatttttcacttcaatcattagtttcaatt

SEQ ID NO: 3894 - protein, 510 aa, Glycine max
  misc_feature (1)..(510): useful for making plants with increased salt and oxidative stress resistance as described in USSN 12/922,143
  misc_feature (1)..(510): Ceres CLONE ID no.598111
  misc_feature (1)..(510): Bit score of 329.2 for HMM based on sequences of FIGURE 7 of USSN 12/922,143.
  misc_feature (76)..(502): Pfam Name: p450 Pfam Description: Cytochrome P450
  misc_feature (1)..(510): Functional Homolog Of Ceres SEEDLINE ID no. ME06336
MSRAKKYAAILIFIFIFCFLRKKANLLTFQRTESSNTPMDGIFAYTILILLTIFSFMFLPKPNRRRPQNQTLAKLPPGSMGWPYIGETLQLYSQDPNAYFSTKHKRYGEIFKTNILGCPCVMLTSPEAARFVLVTQAHLFRPTYPKSKERLIGPFALFFHQGEYHTRLRKLVQRSLSLEALRNLVPHIEALALSAMNSWGGDGQVINTFKEMKMFSFEVGILTIFGYLEPRLREELKKNYRIVDNGYNSFPTCIPGTQYQKALLARRRLGKIIGDIICERKEKKLLERDLLSCLLNWKGEGGEVLSDYQIADNIIGVLFAAQDTTASAMTWVVKYLHDEPKLLESVKAEQKAIHKSNEGNLPLSWDQTRNMRITHKVVLESLRMASIISFPFREAIADVEYKGFLIPKGWKAMPLFRNIHHNPEYFPEPQKFNPSRFEVAPKPNTFMPFGSGVHACPGNELAKLETLIMIHHLVTKFRWEVVGSKCGIQYGPFPLPLNGLPARCWRESTS

SEQ ID NO: 3895 - protein, 478 aa, Nicotiana tabacum
  misc_feature (1)..(478): useful for making plants with increased salt and oxidative stress resistance as described in USSN 12/922,143
  misc_feature (1)..(478): Public GI ID no.71081902
  misc_feature (1)..(478): Bit score of 338.7 for HMM based on sequences of FIGURE 7 of USSN 12/922,143.
  misc_feature (42)..(470): Pfam Name: p450 Pfam Description: Cytochrome P450
  misc_feature (1)..(478): Functional Homolog Of Ceres SEEDLINE ID no. ME06336
MTNFDLFFYISIFLLTILFLYLWFVITRNKKSSPQRKAYKLPPGSMGWPYIGETLQLYSQDPNIFFINRQRRYGEIFKTKILGCPCVMLTSPEAARFVLVNQANLFKPTYPKSKETLIGQSALFFHQGNYHIHVRKLVQTSLNPEAIHNQIPHIEELAISALNSWAGGHVVNTYHEMKKYSFEVGILAIFGHLDAHLKDQLKKNYIIVDKGYNSFPTNLPGSPYRKSLQARKRLGKILSEIINERKEKKLIEKGLLNCFLNAKDEKGLVLNEDQIADNIIGVLFAAQDTTASVLTWILKYLHDNPKLLKNVKAEQKAICQSNEQENHGLTWTQTRKMPITNKVVLETLRLASIISFTFREAVADVEYKGYLIPKGWKVMPLFRNIHQNPEFFPNPQNFDPSRFENVQKPNTFMPFDSGVHACPGNELAKLEMLIMTHHLVTKFRWEAEGSNSGIQYGPFPVPMGGLPARFWKESTTST

SEQ ID NO: 3896 - protein, 496 aa, Phaseolus vulgaris
  misc_feature (1)..(496): useful for making plants with increased salt and oxidative stress resistance as described in USSN 12/922,143
  misc_feature (1)..(496): Public GI ID no.38194919
  misc_feature (1)..(496): Bit score of 357.4 for HMM based on sequences of FIGURE 7 of USSN 12/922,143.
  misc_feature (211)..(394): Pfam Name: p450 Pfam Description: Cytochrome P450
  misc_feature (1)..(496): Functional Homolog Of Ceres SEEDLINE ID no. ME06336
MALFMAILGVLVLLLCFCSALLKWNEVRFRRKGLPPGAMGWPVFGETTEFLKQGPNFMKNKRARYGSFFKSHILGCPTIVSMDPELNRFILMNEAKGLVPGYPQSMLDILGTRNIAAVHGSTHKYMRGALLSIISPTLIRDQLLPKIDEFMRTHLMDWDNKVINIQEKTKEMAFLSSLKQIAGMESSSIAQPFMTEFFKLVLGTLSLPINLPRTNYRGGLQARKSIISILSQLLEERKASQDVHVDMLGCLMKKDENRYKLSDEEIIDLVITIMYSGYETVSTTSMMAVKYLHDHPKVLEEIRKEHFAIRERKKPEDPIDCNDLKSMRFTRAVIFETSRLATIVNGVLRKTTHDMELNGYLIPKGWRIYVYTREINYDPFLYHDPLTFNPWRWLVCNTTYTFFHFNMKPRKVESRIINEKLQMQGNSLESQSHFLIFGGGTRQCPGKELGIAEISTFLHYFVTRYRWEEVGGDKLMKFPRVVAPNGLHIRVSSFSN

SEQ ID NO: 3897 - protein, 506 aa, Hordeum vulgare subsp. vulgare
  misc_feature (1)..(506): useful for making plants with increased salt and oxidative stress resistance as described in USSN 12/922,143
  misc_feature (1)..(506): Public GI ID no.81362336
  misc_feature (1)..(506): Bit score of 323.4 for HMM based on sequences of FIGURE 7 of USSN 12/922,143.
  misc_feature (43)..(455): Pfam Name: p450 Pfam Description: Cytochrome P450
  misc_feature (1)..(506): Functional Homolog Of Ceres SEEDLINE ID no. ME06336
MAFFLLLCILVSVAIVSYAHHAIRRRRQGCAHGRHEQAALKLPPGSMGLPYVGETLQLYSQDPSVFLSSKQKRYGEIFKTHLLGCPCVMLASPEAARFVLVSRAHLFKPTYPRSKERLIGPSALFFHQGDYHLRLRRLVQGPLGPEALRKLVPDIEAAVRSTLAAWADGDVASTFHAMKRLSFDVGIVTIFGGRLDERRKEELRRNYAVVEKGYNSFPNSFPGTLYYKAIQARRRLNGVLSDVVHERRERGEHGDDLLGCLMRSRAGGDDADDEGALLTDEQVADNVIGVLFAAQDTTASVLTWIVKYLHDRPKLLEAVRAEHAAIHEANDGGRRPLTWAQTRSMTLTHRVILESLRMASIISFTFREAVADVEYKGFLIPKGWKVMPLFRNIHHSPDYFQDPHKFDPSRFKVAPRPNTFTPFGSGVHACPGNELAKLEMLVLIHHLVTGYRWEVVGSSDDVEYSPFPVPRHGLLARVRRDDGVCAGRKGCPTDEDDNYDDDEVIV

SEQ ID NO: 3898 - DNA, 1673 bp, Triticum aestivum
  misc_feature (1)..(1673): useful for making plants with increased salt and oxidative stress resistance as described in USSN 12/922,143
  misc_feature (1)..(1673): Ceres CLONE ID no.703821
caaagaccacacgaggcgctaggccgctagcaaagctctcggccaaacaggcatcacgcgtgctgtagcaccaccggttggttcgttcgccggcgacggcaccgcggtgatcagcgatgggggagttggcgtgggcggcgctggcggggcttctggtgccgctggccgcggtggcgctggacgccgcggtgcgggcggcgcacgcgtggtactggacggcgtcgctgggcgccgggcggcgcggcaggctgccgccgggagacatggggtggccgctcgtcggcggcatgtgggccttcctctgcgccttcaagtccggcaggccggactccttcatcgactccttcgcccgacggttcgggcgggcggggctgtacagggcgttcatgttcagcagcccgacgatcatggtgacgacgccggacgcgtgcaagcaggtgctcatggacgacgacacgttcgtcaccggctggcccaaggccacggtggcgctcatcgggcccaagtccttcatcaacatgggctacgacgagcaccgccggctgcgcaagctcacggcggcgcccatcaacggcttcgacgcgctcacctcctacctgggcttcatcgaccacaccgtggtgaccacgctccggggctggtcggaccggggctccgacttcgagttcctcacggagctgcgccggatgacgttccggatcatcgtgcagatcttcatgggcggcgccgacgagcgcacggcggccgagctggagagcacctacacggagctcaactacggcatgcgcgccatggccatcgacctaccagggttcgcctaccacaaggccatccgcgcgcgccgcaggctcgtggcggcgctgcagcgcgtgctcgacgagcgccgggccaggggagccaagacggccggggtggacatgatggaccggctgatcgccgcggaggacgagggcgggcggcggctgcaggacgacgagatcatcgacgtgcttgtcatgtacctgaacgccggccacgagtcctccggccacatcaccatgtgggccaccgtcttcctgcaggagaaccccgacatcctcgccaaggccaaggcggagcaggaggcgatcatgaggagcatcccgccggggcagaaggggctcaccctccgggacttcaggaagatggagtacctctcacaggtggtcgacgagacgctgcggttcgtcaacatctccttcgtgtcgttccgccaggcgacccgcgacgtcttcgtcaacggttatctgatacccaaggggtggaaggtgcagctgtggtacaggagcgtgcacatggaccctcaggtgtaccctgaccccaagaagttcgacccttcaagatgggagggcccgccgccgagggccggaacgttccttcctttcgggctcggcacgaggctgtgcccgggcaacgatctcgccaagcttgagatctctgtcttcctccaccatttcctccttggatacaagctgacaaggaaaaatccaaattgccgggtgaggtacctgccgcacccccggccggtggacaattgcctggccaagatcaccagagtctcctcctcccattgacgatgatgaaaacagagaatccaaaaccctagacggcgtcgcccagaagcgccaaatttaggaaaactcatgtgtccagac

SEQ ID NO: 3899 - protein, 491 aa, Triticum aestivum
  misc_feature (1)..(491): useful for making plants with increased salt and oxidative stress resistance as described in USSN 12/922,143
  misc_feature (1)..(491): Ceres CLONE ID no.703821
  misc_feature (1)..(491): Bit score of 243.5 for HMM based on sequences of FIGURE 7 of USSN 12/922,143.
  misc_feature (230)..(459): Pfam Name: p450 Pfam Description: Cytochrome P450
  misc_feature (1)..(491): Functional Homolog Of Ceres SEEDLINE ID no. ME06336
MGELAWAALAGLLVPLAAVALDAAVRAAHAWYWTASLGAGRRGRLPPGDMGWPLVGGMWAFLCAFKSGRPDSFIDSFARRFGRAGLYRAFMFSSPTIMVTTPDACKQVLMDDDTFVTGWPKATVALIGPKSFINMGYDEHRRLRKLTAAPINGFDALTSYLGFIDHTVVTTLRGWSDRGSDFEFLTELRRMTFRIIVQIFMGGADERTAAELESTYTELNYGMRAMAIDLPGFAYHKAIRARRRLVAALQRVLDERRARGAKTAGVDMMDRLIAAEDEGGRRLQDDEIIDVLVMYLNAGHESSGHITMWATVFLQENPDILAKAKAEQEAIMRSIPPGQKGLTLRDFRKMEYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRVSSSH

SEQ ID NO: 3900 - protein, 476 aa, Oryza sativa subsp. indica
  misc_feature (1)..(476): useful for making plants with increased salt and oxidative stress resistance as described in USSN 12/922,143
  misc_feature (1)..(476): Public GI ID no.125558547
  misc_feature (1)..(476): Bit score of 259.4 for HMM based on sequences of FIGURE 7 of USSN 12/922,143.
  misc_feature (29)..(467): Pfam Name: p450 Pfam Description: Cytochrome P450
  misc_feature (1)..(476): Functional Homolog Of Ceres SEEDLINE ID no. ME06336
MPFALLLALLVPTLLHFVIRCKYSSYNLPPGSLGFPLIGQSISLLRALRSNTDYQWYQDRIKKYGPVFKMSLFGSPTVLMAGPAANHFVFSNQDLIFTQTKAINTILGRSILTLSGEELKQVRSALQGYLRLEMVTKYMCKMDEEVRRHIDLNWVGHKTVKAAPLAKRLTFDIICSVVFGQGIGPIREALATDFETLVQALLSLPVNMPFTKFNKGLRASRRIRKVLRQIAREREAALQQGHSSSADDFFTYMLVLRSEGTHSLTVEDIVDNAIVILTAGYGTTAVLITFLLRYLANDPDILGKITEEQEEIARREGPNEPLTWNDVSRMKYTWKVALETLRTVPPIFGSFRTAVKDIEYHGYHIPKGWQVFTAQSITHLDGNFFNDPVKFDPTRFDNQTSLPPYCFVPFGGGPRMCPGNEFARTETLVTMHYLVRQFRWKLCCEEEGYRKDPVPIPVLGLPIELETRSPPEYAHA

SEQ ID NO: 3901 - protein, 468 aa, Hordeum vulgare subsp. vulgare
  misc_feature (1)..(468): useful for making plants with increased salt and oxidative stress resistance as described in USSN 12/922,143
  misc_feature (1)..(468): Public GI ID no.81362266
  misc_feature (1)..(468): Bit score of 328.6 for HMM based on sequences of FIGURE 7 of USSN 12/922,143.
  misc_feature (41)..(464): Pfam Name: p450 Pfam Description: Cytochrome P450
  misc_feature (1)..(468): Functional Homolog Of Ceres SEEDLINE ID no. ME06336
MGAFILLLCLLVPLVLVCAVRARKGAGGRSSSGGGKKGRLPPGSMGWPYVGETTQLYSSKNPNVFFARKRNKYGPIFKTHILGCPCVMVSSPEAAKFVLVTQAHLFKPTFPASKERMLGRQAIFFQQGDYHTHLRRLVSRAFSPEAIRGSVSSIEAIALRSLGSWEGHEVNTFQEMKTYALNVALLSIFGEEEMQYIEELKQCYLTLEKGYNSMPVNLPGTLFHKAMKARKRLGAIVAHIISARRERERGSDLLGSFMDGREALTDDQIADNAIGVIFAARDTTASVLTWMVKFLGDNPAVLKAVTEEHAEIAREKALSGEPLSWADTRRMRVTGRVIQETMRVASILSFTFREAVEDVEYQGYLIPKGWKVLPLFRNIHHNPDHFPSPEKFDPSRFEVAPKPNTFMPFGNGTHSCPGNELAKLEMLVLCHHLATKYRWSTSKSESGVQFGPFALPINGLPMTFTRKA

SEQ ID NO: 3902 - protein, 506 aa, Oryza sativa subsp. indica
  misc_feature (1)..(506): useful for making plants with increased salt and oxidative stress resistance as described in USSN 12/922,143
  misc_feature (1)..(506): Public GI ID no.114329478
  misc_feature (1)..(506): Bit score of 315.1 for HMM based on sequences of FIGURE 7 of USSN 12/922,143.
  misc_feature (52)..(485): Pfam Name: p450 Pfam Description: Cytochrome P450
  misc_feature (1)..(506): Functional Homolog Of Ceres SEEDLINE ID no. ME06336
MAFLLFFVFVTAAVLCFVVPAFLLLCTSVQRRRDVGQGGGRDWQKKKKLRLPPGSMGWPYVGETLQLYSQDPNVFFASKQKRYGEIFKTNLLGCPCVMLASPEAARFVLVSQARLFKPTYPPSKERMIGPSALFFHQGEYHLRLRRLVQAALAPDSLRALVPDVDAAVAATLAAWSGGHVASTFHAMKKLSFDVGVVTIFGGRLGRRHREELRTNYSVVERGYNCFPNRFPGTLYHKAIQARKRLRAILSEIVAERRARGGGGDDLLGGLMRSRDDGTAGAVALLTDDQIADNVVGVLFAAQDTTASVLTWILKYLHDSPKLLEAVKAEQMAIYVANEGGKRPLTWTQTRSMTLTHQVILESLRMASIISFTFREAVADVEYKGFLIPKGWKVMPLFRNIHHNPDYFQDPQKFDPSRFKVAPRPSTFLPFGSGVHACPGNELAKLEMLVLVHRLVTAYRWEIVGASDEVEYSPFPVPRGGLNAKLWKQEAEEDMYMAMGTITAAGA

SEQ ID NO: 3903 - protein, 555 aa, Oryza sativa subsp. indica
  misc_feature (1)..(555): useful for making plants with increased salt and oxidative stress resistance as described in USSN 12/922,143
  misc_feature (1)..(555): Public GI ID no.125561872
  misc_feature (1)..(555): Bit score of 315.1 for HMM based on sequences of FIGURE 7 of USSN 12/922,143.
  misc_feature (52)..(485): Pfam Name: p450 Pfam Description: Cytochrome P450
  misc_feature (1)..(555): Functional Homolog Of Ceres SEEDLINE ID no. ME06336
MAFLLFFVFVTAAVLCFVVPAFLLLCTSVQRRRDVGQGGGRDWQKKKKLRLPPGSMGWPYVGETLQLYSQDPNVFFASKQKRYGEIFKTNLLGCPCVMLASPEAARFVLVSQARLFKPTYPPSKERMIGPSALFFHQGEYHLRLRRLVQAALAPDSLRALVPDVDAAVAATLAAWSGGHVASTFHAMKKLSFDVGVVTIFGGRLGRRHREELRTNYSVVERGYNCFPNRFPGTLYHKAIQARKRLRAILSEIVAERRARGGGGDDLLGGLMRSRDDGTAGAVALLTDDQIADNVVGVLFAAQDTTASVLTWILKYLHDSPKLLEAVKAEQMAIYVANEGGKRPLTWTQTRSMTLTHQVILESLRMASIISFTFREAVADVEYKGFLIPKGWKVMPLFRNIHHNPDYFQDPQKFDPSRFKVAPRPSTFLPFGSGVHACPGNELAKLEMLVLVHRLVTAYRWEIVGASDEVEYSPFPVPRGGLNAKLWKQEAEEDMYMAMGTITAAVVMSLLSSLTVTPVSATLKCCHMPEVCGYQGLASSFKEISLSFLKEIEESV

SEQ ID NO: 3904 - DNA, 1881 bp, Triticum aestivum
  misc_feature (1)..(1881): useful for making plants with increased salt and oxidative stress resistance as described in USSN 12/922,143
  misc_feature (1)..(1881): Ceres CLONE ID no.860408
accattcgaaagatccaccgaagatttttctcctcactctcctcgacctcacagctctcctctgccagcagcgcagatttatagacacaagctagcacacagcaagctcagagcacctcgctggtctaagtgatccttctcaaggatcatttggatggcctcttcctcctcctcctgtgcatcctcatttctgcggccatcgtgtcctacgcccaccacgtaatccggcggcaacgccagggctgcgctcatggccgccatgagcaagccgccctcaagctgccccctggctccatgggcctgccttacatcggcgagaccctccagctctactcccaggaccccagcgtcttcctctcctccaagcagaagcggtacggcgagatcttcaagacgcacctcctcggctgcccgtgcgtgatgctggcgagcccggaggcggcgcggttcgtgctggtgtcgcgggcaaacctgttcaagccgacgtacccgcggagcaaggagcgcctcatcggcccgtcggcgctcttcttccaccagggcgactaccacctccgtctccgcaggctcgtccagggcccgctcggccccgaggccctgcgcaagctcgtgccggacatcgaggccgccgtgcgggcaaccctcgcggcctgggcggacggcgacgtcgccagcaccttccacgccatgaagaggctctcgttcgacgtcggcatcgtgacgatcttcggcgggcggctggacgagcggcggaaggaggagctccggcggaactacgccgtcgtggagaaaggctacaactccttccccaacagcttccccgggacgctatactacaaggcgatccaggcgaggcggcggctgaacggcgtgctgagcgacatcctgcacgagaggagggagcggggcgagcccggcgacgacctgctcggctgcctcatgcggtcgcgggccggcggcgacgacggcgacgagggcgcgctgttgacggacgagcaggtcgccgacaacgtcatcggcgtgctgttcgcggcgcaggacacgacggccagcgtgctcacctggatcgtcaagtacctccacgaccggccgaagctgctggaggccgtgagggcggagcacgccgcgatccacgaggccaacgacggcgggaggcggccgctgacatgggcgcagacgaggagcatgacgctgacgcacagggtgattttggagagcctgaggatggcgagcatcatctccttcacgttcagggaggccgtggccgacgtggagtacaaagggtttcttatccccaaggggtggaaggtgatgccgctcttcaggaacatccatcacagcccggactacttccaggatccacagaagttcgacccttcgagattcaaggtggcgccgcggccgagcaccttcacgccgttcgggagcggggtgcacgcgtgccccgggaacgagctggccaagctcgagatgctggtgctcatccaccacctggtcaccggctacaggtgggaggttgttggatcgagcgacgacgtcgagtacagcccattccctgttccccagaacggcctgctcgccaggttacggcgggatgacagcgtctgcgtgggtaggaaggggtgcccgactgatgacaactacgacgacgaagacgaagtgatagtgtgattagtcaacgtagatagctagagggctcttctctccctttttgttgttattgttgttgttgttgttgtggcattcttctctaggaaaatcattagagaagaaacaacagaacgactttttaggatgacgatgatcatgtaccgtagtggttatgttgtcaatgatgtattgtcattgatacacgcataaaatgacgcttcctttttccgg

SEQ ID NO: 3905 - protein, 458 aa, Triticum aestivum
  misc_feature (1)..(458): useful for making plants with increased salt and oxidative stress resistance as described in USSN 12/922,143
  misc_feature (1)..(458): Ceres CLONE ID no.860408
  misc_feature (1)..(458): Bit score of 264.4 for HMM based on sequences of FIGURE 7 of USSN 12/922,143.
  misc_feature (2)..(408): Pfam Name: p450 Pfam Description: Cytochrome P450
  misc_feature (1)..(458): Functional Homolog Of Ceres SEEDLINE ID no. ME06336
MGLPYIGETLQLYSQDPSVFLSSKQKRYGEIFKTHLLGCPCVMLASPEAARFVLVSRANLFKPTYPRSKERLIGPSALFFHQGDYHLRLRRLVQGPLGPEALRKLVPDIEAAVRATLAAWADGDVASTFHAMKRLSFDVGIVTIFGGRLDERRKEELRRNYAVVEKGYNSFPNSFPGTLYYKAIQARRRLNGVLSDILHERRERGEPGDDLLGCLMRSRAGGDDGDEGALLTDEQVADNVIGVLFAAQDTTASVLTWIVKYLHDRPKLLEAVRAEHAAIHEANDGGRRPLTWAQTRSMTLTHRVILESLRMASIISFTFREAVADVEYKGFLIPKGWKVMPLFRNIHHSPDYFQDPQKFDPSRFKVAPRPSTFTPFGSGVHACPGNELAKLEMLVLIHHLVTGYRWEVVGSSDDVEYSPFPVPQNGLLARLRRDDSVCVGRKGCPTDDNYDDEDEVIV

SEQ ID NO: 3906 - protein, 489 aa, Oryza sativa subsp. indica
  misc_feature (1)..(489): useful for making plants with increased salt and oxidative stress resistance as described in USSN 12/922,143
  misc_feature (1)..(489): Public GI ID no.125558542
  misc_feature (1)..(489): Bit score of 295.6 for HMM based on sequences of FIGURE 7 of USSN 12/922,143.
  misc_feature (225)..(485): Pfam Name: p450 Pfam Description: Cytochrome P450
  misc_feature (1)..(489): Functional Homolog Of Ceres SEEDLINE ID no. ME06336
MEFSLVVALIAVASSCVFVHFLARGATKKRRSPAAKKLPPGSLGLPVIGQSLGLLRAMRSNSGERWVRRRIDRYGAVSKLSLFGKPTVLVAGAAANRFVFFSGALALQQPRSVQRILGDRSILDLVGADHRRVRGALSEFLRPEMLRMYVGKIDGEARRHVAGCWSGRAAVTVMPLMKRLTFDIIASLLFGLGPGAAARDALAGDFERVMGGMWAVPVDLPFTAFRRSLRAAARARRLLAGITRERKAALERGAATRSSDLIACLLSLTDDRGGAPLLSEEEIVDTAMVALVAGHDTSSILMTFMVRHLANDPDTLAAMHEEIARSKRDGEALTWEDLTRMKLTWRVAQETLRMVPPVFGNFRRALEDIELDGYVIPKGWQVFWVASVTHMDAAIFHDPDKFLPSRFDSQSSSPSTAKAAPPCSYVAFGGGPRICPGIEFARIETLVMMHHLVRKFRWKLCCKEDTFARDPMPTPLHGLPIEIEPRISP

SEQ ID NO: 3907 - protein, 519 aa, Zea mays
  misc_feature (1)..(519): useful for making plants with increased salt and oxidative stress resistance as described in USSN 12/922,143
  misc_feature (1)..(519): Public GI ID no.5915847
  misc_feature (1)..(519): Bit score of 218.4 for HMM based on sequences of FIGURE 7 of USSN 12/922,143.
  misc_feature (257)..(489): Pfam Name: p450 Pfam Description: Cytochrome P450
  misc_feature (1)..(519): Functional Homolog Of Ceres SEEDLINE ID no. ME06336
MLGVGMAAAVLLGAVALLLADAAARRAHWWYREAAEAVLVGAVALVVVDAAARRAHGWYREAALGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 3908 - protein, 499 aa, Hordeum vulgare
  misc_feature (1)..(499): useful for making plants with increased salt and oxidative stress resistance as described in USSN 12/922,143
  misc_feature (1)..(499): Public GI ID no.50401144
  misc_feature (1)..(499): Bit score of 235.3 for HMM based on sequences of FIGURE 7 of USSN 12/922,143.
  misc_feature (272)..(466): Pfam Name: p450 Pfam Description: Cytochrome P450
  misc_feature (1)..(499): Functional Homolog Of Ceres SEEDLINE ID no. ME06336
MGEGAWWAVAAVVAALAVVALDAAVRAAHAWYWTASLGAGRRGRLPPGDMGWPLVGGMWAFLRAFKSGRPDSFIDSFARRFGRAGLYRAFMFSSPTIMATTPEACKQVLMDDDAFVTGWPKATVALIGPKSFVNMGYDEHRRLRKLTAAPINGFDALTSYLGFIDDTVVTTLRGWSERGGDGHFEFLTELRRMTFRIIVQIFMGGADERTAAELERTYTELNYGMRAMAIDLPGFAYHKAIRARRRLVAALQRVLDERRARGGKTAAGAAAPVDMMDRLIAVEDEGGRRLQDDEIIDVLVMYLNAGHESSGHITMWATVFLQENPEILAKAKAEQEAIMRSIPPGQKGLTLRDFRKMAYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRLSSSHG

SEQ ID NO: 3909 - DNA, 1569 bp, Triticum aestivum
  misc_feature (1)..(1569): useful for making plants with increased salt and oxidative stress resistance as described in USSN 12/922,143
  misc_feature (1)..(1569): Ceres CLONE ID no.892452
atcactctccaatggattatctggccatagtcgtggcacccgttgtcgccattgccatccacctcctcagcagggccaagaaaagacggccggccaacctgcctccgggctccctcggcctgccggtgatcgggcagagcctcggcctcctccgggccatgcgcggcgccgacggcggcaaccggtgggtacaggaccggatcgacaggtacgggcccgtgtcgaagctatcgctgttcggcacgccgacggtgctcctggccggaccggcggccaacaagtttttgttcttcagcagcgcgctttcgacgcggcagccccggtccgtgcagcggatacttggcgagaacagcatcctggacctccacggcgccgaccaccggcgcgtccgcggtgctctgctcgagttcctcaggccggacatgctcaagatgtacgtgggcgggatcgacgccgaggtgcggcgccacgtcgaggagaactgggccggccgcgggacggtgacggtgctgccgctgatgaagcggctgacgttcgacatcatctccgcgctgctcttcggcctggagaggggcgccgttcgggacgcgctggccggcgacttcgcgcacatgatggagggcatgtgggcgatcccggtgaacttgccgttcacggcgttcagccggagcctcaaggccagcgggagagcccgtcgggtgctagcggggatcacgcaggagaagaaggccggccggtgccagccggagcacggcaaggcgccgcggagtaacgacctcataacctgcctgctcggcctgacggacggccatggcgagcggctgctgagcgacgaggagatcgtggacaacgccatggtcgccctcatcgccggccacgacacctcgtccatcctgatgaccttcatggtccgccacctcgccaacgatgacaccaccctcgccgccatggtccaagagcacgaggagatcgccatgaacaaaggcgacggagaggctctcacctgggaggatctgacgaagatgaagttcacatggcgagtcgcgcaggagatccttcgcaccgtccctccgatcttcggcaacttcagaagagcgctggaggacgtcgagttcgacggctacctcatcccaaaaggatggcaggtgttctggacggcgaacgtgacgcacatggacgcgagcatcttccacgagccggccaagttcgacccgtcccggttcgagaaccaggccgcgtcggcggcgccgccgtgctccttcgtcgccttcgggggcggcccgaggatatgccccgggatagagttctcccggatcgagacgctggtgacgatgcaccacctcgtgaggcggttcagatggaagctctgctgcaaggagaacaccttcgtgagggaccccatgccgtcgccgctgcgtggcctgcccatccaaatcgagcgtaggacctccccgccgccgtgatcgagcttgacggcaatctcagtgtcatggtcggtcgcatttcattagaaaatatagctgctcctgcacgtgtatgtgtgatgagtaataaatggccatcactacc

SEQ ID NO: 3910 - protein, 483 aa, Triticum aestivum
  misc_feature (1)..(483): useful for making plants with increased salt and oxidative stress resistance as described in USSN 12/922,143
  misc_feature (1)..(483): Ceres CLONE ID no.892452
  misc_feature (1)..(483): Bit score of 303.3 for HMM based on sequences of FIGURE 7 of USSN 12/922,143.
  misc_feature (31)..(477): Pfam Name: p450 Pfam Description: Cytochrome P450
  misc_feature (1)..(483): Functional Homolog Of Ceres SEEDLINE ID no. ME06336
MDYLAIVVAPVVAIAIHLLSRAKKRRPANLPPGSLGLPVIGQSLGLLRAMRGADGGNRWVQDRIDRYGPVSKLSLFGTPTVLLAGPAANKFLFFSSALSTRQPRSVQRILGENSILDLHGADHRRVRGALLEFLRPDMLKMYVGGIDAEVRRHVEENWAGRGTVTVLPLMKRLTFDIISALLFGLERGAVRDALAGDFAHMMEGMWAIPVNLPFTAFSRSLKASGRARRVLAGITQEKKAGRCQPEHGKAPRSNDLITCLLGLTDGHGERLLSDEEIVDNAMVALIAGHDTSSILMTFMVRHLANDDTTLAAMVQEHEEIAMNKGDGEALTWEDLTKMKFTWRVAQEILRTVPPIFGNFRRALEDVEFDGYLIPKGWQVFWTANVTHMDASIFHEPAKFDPSRFENQAASAAPPCSFVAFGGGPRICPGIEFSRIETLVTMHHLVRRFRWKLCCKENTFVRDPMPSPLRGLPIQIERRTSPPP

SEQ ID NO: 3911 - DNA, 1866 bp, Zea mays
  misc_feature (1)..(1866): useful for making plants with increased salt and oxidative stress resistance as described in USSN 12/922,143
  misc_feature (1)..(1866): Ceres CLONE ID no.1628466
aacagcctgctgctgtgcagtgtgcaccaccaacatctgacatctccaatggattcttctcttgtcctagcgcttatcgccgtcgccttgcccgtgctcctccatctcctaaagaggggaaagacgccatggcggccggccgcggccaagctgccgccgggctcccttggcctgccggtgatcggccagagcatcggtcttctccgcgccatgcgcgccaacactgccgagcggtggatcctggaccggatacaccggtacggtccggtgtccaagctgtcgctgttcggcaggccgacggtgctcgtcgcggggtcggcggccaacaggttcatcttcttcagcagcgccttagcgatgcagcagcctcggtcagtgcagcggatcctgggggacaagagcatcctggagctcacgggcgccgaccacaagcggatccgcggcgcgctggtcgagttcctcaagccggacatgctgaggctgtacgtgggcaagatcgacggcgaggttcggcgccacctcgacgagtgctgggccggccgctgcaccgtcacggtgatgccgcacatgaagaggctcacgttcgacatcatctccctgctgctcttcggcctcgagcggagcccgctccaggacgccctcgcgggcgacttcgcccgcgtcatggatggcatatgggccgtcccggtgaacctgccgttcacggcgttcagccggagcctcagggccagcgccagggctcgccggctgatcgcggggatcgcgcgggagaccagggccaagctggaaaggggcgaggcctcccgtagcagcgacctcatcgcgtgcctgctcagtctgaccgaccacagcggcgcgcggctgctgagcgaggaggagatcgtggacaactccatggtggccctcgtcgccggtcacgacacgtcgtcagttctcatgacgttcatggtccgccacctcgccaacgacccggacaccctcgccgccatggtccaagagcacgacgagatcgcaaagaacaagggcgacggccagaccctggactgggaggacctggcgaagatgaagtacacgtggcgcgtcgcgctggagacccttcgcttggtgcctcccatcttcggcaacttccggcgagcgatgcaggacatcgagttcgacggctacctcatcccaaaaggatggcaggtgttctgggcggcgagcgtgacgcacatggacacgggcatcttccacgagccggcaaagttcgacccgtcccggttcgagaaccagtcggcggcatcggcgccgccgtgctcgttcgtcgcgttcggcgggggtccgaggatctgcgtcggcatggagttcgccaggatcgagacgctggtgacgatgcattaccttgtcaggcggtttaggtggaagctctgctgcaagaacgataccttcgccagggaccccatgccatcgccgctgcacggactgcccatagaacttgagcagaaggcatcgccatgatcgtgacaaaattcggcggcagatatacatggcagtgctttttaaggatcagggagtggggtggggaggagattagcccctactggaaaataaattaacacgtagaaaaattagctctactgcataaaagaaaaaaacaaatcatgaaaatatatttcataatgcatcaaatgatattaagagcatatataatgtgtgttttgagctgtgtcttcagacgcgtctaaggtgataaatgtaaaaaaaatctaagacatgtctcttgatgaagttattatgtcttgtctctatgctcgagactgaggactgactaattagtcaatttaatttattgaataattgattggtgtaatgaatatagtaagacac

SEQ ID NO: 3912 - protein, 482 aa, Zea mays
  misc_feature (1)..(482): useful for making plants with increased salt and oxidative stress resistance as described in USSN 12/922,143
  misc_feature (1)..(482): Ceres CLONE ID no.1628466
  misc_feature (1)..(482): Bit score of 317.6 for HMM based on sequences of FIGURE 7 of USSN 12/922,143.
  misc_feature (234)..(454): Pfam Name: p450 Pfam Description: Cytochrome P450
  misc_feature (1)..(482): Functional Homolog Of Ceres SEEDLINE ID no. ME06336
MDSSLVLALIAVALPVLLHLLKRGKTPWRPAAAKLPPGSLGLPVIGQSIGLLRAMRANTAERWILDRIHRYGPVSKLSLFGRPTVLVAGSAANRFIFFSSALAMQQPRSVQRILGDKSILELTGADHKRIRGALVEFLKPDMLRLYVGKIDGEVRRHLDECWAGRCTVTVMPHMKRLTFDIISLLLFGLERSPLQDALAGDFARVMDGIWAVPVNLPFTAFSRSLRASARARRLIAGIARETRAKLERGEASRSSDLIACLLSLTDHSGARLLSEEEIVDNSMVALVAGHDTSSVLMTFMVRHLANDPDTLAAMVQEHDEIAKNKGDGQTLDWEDLAKMKYTWRVALETLRLVPPIFGNFRRAMQDIEFDGYLIPKGWQVFWAASVTHMDTGIFHEPAKFDPSRFENQSAASAPPCSFVAFGGGPRICVGMEFARIETLVTMHYLVRRFRWKLCCKNDTFARDPMPSPLHGLPIELEQKASP

SEQ ID NO: 3913 - DNA, 2211 bp, Zea mays
  misc_feature (1)..(2211): useful for making plants with increased salt and oxidative stress resistance as described in USSN 12/922,143
  misc_feature (1)..(2211): Ceres CLONE ID no.1546594
accccagtccccacctcttctcttcctcctcctcgtccgccgttgctgtctgtctcctcctcctccgccgccgcctagctgcttactacgtgcttccaccgcaacaagcacagagtgcgagcaaagacagaaagccatgggcgccctgttgctcttcgccgtctgcctgctggcgccgatcgtgctggcctgcgccgtccgtggcaggaagcggcgggccgccgcgccggcgtccggcaagaaggcgctgccgctgccgctgccgccggggtcgatggggtggccgtacgtgggggagacgctgcagctctactcgtccaagaaccccaacgtgttcttcgcccggaagcagaaccggtacgggccgatcttcaggacccacatcctgggctgcccctgcgtgatggtgtccagcccggaggcggcgcgcttcgtgctcgtcacgcaggctcacctcttcaagcccaccttcccggcgagcaaggagcgcatgctgggcccgcaggccatcttcttccagcagggcgactaccacgcccgcctccgccgcctcgtctcccgggctttctcaccccaggccatccgcgcctccgtgccggctgtcgaggccgtcgcgctgcgctcgctccgctcctgggacggccgcctcgtcaacaccttccaagagatgaagctgtacgcgctgaatgtggcattgctgtccatcttcggcgaggaggagatgcggtacatcgaggagctgaagcagtgctacctgacgctggagaaggggtacaactcgatgccggtgaacctgccgggcaccctgttccacaaggccatgaaggcccgcaagcggctgagcgccatcgtggcccacatcatcgaggcccggcgcgagcggccgcggccgcgcgggagcgacctcctggcctccttcctggacggccgcgaggcgctcaccgacgcccagatctccgacaacgtgatcggcgtcatgttcgccgcccgcgacaccaccgccagcgtgctcacctggatggtcaagttcctcggcgaccacccggcggtcctcaaggcggtcatcgaggagcagcaggagatcgctcggtccaagggctcctccggcgacgaacccctgacgtgggcggacaccaggcggatgcgcgtgacgagccgtgcgatccaggagacgatgcgggtggcgtccatcctgtccttcaccttccgggaggccgtggaggacgtggagtaccaagggtacctgatccccaagggctggaaggtgttgcccctgttccggaacatccaccacagccccgaccacttcccctgcccggacaagttcgacccctcccgattcgaggttgctcccaagcccaacacgttcatgccgttcggcaacgggacccactcgtgcccggggaacgagctcgccaagctggagatgctcgtgctcttccaccacctcgtcaccaaatacaggtggtccacctccaagtccgagagcggcgtgcagttcggccccttcgcgctgccgctcaacggcctgcccatgaccttcgctcgcaaggactgatctatcggagccactgcacggccatggatggtggtatatgctagcactacactactagtaatacccaggaacgcgaaaaccgcttcccgggatcggggcgtcggccgcgttgcggcggcggccatcggacgggacagggaaggtgacggtgacgggcatcaggcgggcgggcatgggccatgggatcgatgatcagagaaagaaagattacgcagctccttgtacagattcttcctcagctagtagggccggatcccaagaagccggaagaggagaccaaacacaaaattaggcatagccgcttaggtgccactcactctaagctactagtactccagtaggcaagcatcagatcacccagctgcgctacaaacaagtggcgtttaattgtaaaaccaaaccattttttttctctatcttcttcttcttctttttccctcccctttagattttttttataagccagccagatagtggcacccataggagagaagaacacaaggaaaccataaaagaaagagagggaggccctgattgggattctaattgtaagctagctaggttgcccacctgaaagcaggctggcagctaggtcgagtaacccacggatggatggattggaatggaatggaatggaatggccagatttattg

SEQ ID NO: 3914 - protein, 473 aa, Zea mays
  misc_feature (1)..(473): useful for making plants with increased salt and oxidative stress resistance as described in USSN 12/922,143
  misc_feature (1)..(473): Ceres CLONE ID no.1546594
  misc_feature (1)..(473): Bit score of 330.5 for HMM based on sequences of FIGURE 7 of USSN 12/922,143.
  misc_feature (43)..(469): Pfam Name: p450 Pfam Description: Cytochrome P450
  misc_feature (1)..(473): Functional Homolog Of Ceres SEEDLINE ID no. ME06336
MGALLLFAVCLLAPIVLACAVRGRKRRAAAPASGKKALPLPLPPGSMGWPYVGETLQLYSSKNPNVFFARKQNRYGPIFRTHILGCPCVMVSSPEAARFVLVTQAHLFKPTFPASKERMLGPQAIFFQQGDYHARLRRLVSRAFSPQAIRASVPAVEAVALRSLRSWDGRLVNTFQEMKLYALNVALLSIFGEEEMRYIEELKQCYLTLEKGYNSMPVNLPGTLFHKAMKARKRLSAIVAHIIEARRERPRPRGSDLLASFLDGREALTDAQISDNVIGVMFAARDTTASVLTWMVKFLGDHPAVLKAVIEEQQEIARSKGSSGDEPLTWADTRRMRVTSRAIQETMRVASILSFTFREAVEDVEYQGYLIPKGWKVLPLFRNIHHSPDHFPCPDKFDPSRFEVAPKPNTFMPFGNGTHSCPGNELAKLEMLVLFHHLVTKYRWSTSKSESGVQFGPFALPLNGLPMTFARKD

SEQ ID NO: 3915 - protein, 478 aa, Arabidopsis thaliana
  misc_feature (1)..(478): useful for making plants with increased salt and oxidative stress resistance as described in USSN 12/922,143
  misc_feature (1)..(478): Public GI ID no.9502380
  misc_feature (1)..(478): Bit score of 442.3 for HMM based on sequences of FIGURE 7 of USSN 12/922,143.
  misc_feature (209)..(473): Pfam Name: p450 Pfam Description: Cytochrome P450
  misc_feature (1)..(478): Functional Homolog Of Ceres SEEDLINE ID no. ME06336
MWALLIWVSLLLISITHWVYSWRNPKCRGKLPPGSMGFPLLGESIQFFKPNKTSDIPPFIKERVKKYGPIFKTNLVGRPVIVSTDADLSYFVFNQEGRCFQSWYPDTFTHIFGKKNVGSLHGFMYKYLKNMVLTLFGHDGLKKMLPQVEMTANKRLELWSNQDSVELKDATASMIFDLTAKKLISHDPDKSSENLRANFVAFIQGLISFPFDIPGTAYHKCLQGRAKAMKMLRNMLQERRENPRKNPSDFFDYVIEEIQKEGTILTEEIALDLMFVLLFASFETTSLALTLAIKFLSDDPEVLKRLTEEHETILRNREDADSGLTWEEYKSMTYTFQFINETARLANIVPAIFRKALRDIKFKEFVNDTDYTIPAGWAVMVCPPAVHLNPEMYKDPLVFNPSRWEGSKVTNASKHFMAFGGGMRFCVGTDFTKLQMAAFLHSLVTKYRWEEIKGGNITRTPGLQFPNGYHVKLHKKRD

SEQ ID NO: 3916 - protein, 495 aa, Oryza sativa subsp. japonica
  misc_feature (1)..(495): useful for making plants with increased salt and oxidative stress resistance as described in USSN 12/922,143
  misc_feature (1)..(495): Public GI ID no.115454431
  misc_feature (1)..(495): Bit score of 431.0 for HMM based on sequences of FIGURE 7 of USSN 12/922,143.
  misc_feature (227)..(475): Pfam Name: p450 Pfam Description: Cytochrome P450
  misc_feature (1)..(495): Functional Homolog Of Ceres SEEDLINE ID no. ME06336
MEGIHAGTVTMACSWLVLTAAMAVLASWLIRLVSLKWNSSHPCKADEGSRLPPGSRGLPLLGESLEFFTSSTSLELPVFFKRRLNRYGPVFRTNMVGQDLIVCLDPEVNSFVFQQEERLFQCWYPDSFMRIIGADNIITTLGSSHKYIRNLILRLFGPENLRRAMLQDVHRTAQASLLSWLDRPSIELKDAVSSMIFSVTAKKLISYDSLASDGKMWKQFDAFIRGLLAFPIGIPGTAFYKCMQGRKNIMKMLKELIDERKEASGRRGSIDFIDVLLEELNEEKPLISENVALDLIFLLLFASFETTASAITAVVRFLTDNPEALQELAEEHDNIQKRRVDLNSEITWEEYKSMKFTSHVIHEALRLANIAPVMFRKATEDVHIKGFFIPKGSKIMICPSTVHLNPMIYKDPNIFNPWRWKDTAEPTGGASKDFMAFGGGLRLCVGADFAKLQTAIFLHCLVTKYRWKAIKGGTMVLGPGLRFPEGFHIQLFPKP

SEQ ID NO: 3917 - protein, 487 aa, Pinus taeda
  misc_feature (1)..(487): useful for making plants with increased salt and oxidative stress resistance as described in USSN 12/922,143
  misc_feature (1)..(487): Public GI ID no.59800266
  misc_feature (1)..(487): Bit score of 533.8 for HMM based on sequences of FIGURE 7 of USSN 12/922,143.
  misc_feature (206)..(483): Pfam Name: p450 Pfam Description: Cytochrome P450
  misc_feature (1)..(487): Functional Homolog Of Ceres SEEDLINE ID no. ME06336
MGSGIMTETLTDSWLVGLLCLVLGFLLLQLYKLVWGASSRAYKLPPGSTGWPLIGETISFFRGINSTAQPRQFIQEREQRYGEIFRSNLFGRSRIVVSVDPEFNKHVLQHEGRQFQANYPKPLRNLIGKYGLLSVHGDLQRKLHGAAVNLLRFERLSVDFMEDIQNLLHITLAKWEAKRDIHLQEECHQLVLNLMAKQLLDLSPSKDTEEICEAFGHFSEALLAVPIKIPGTKYARGFKAREFLIKKIYESIEDRRQHPEAVHNDLLTKLLKEDSFSEEIIADFILFLLFAGHETSSRSMSFAIKFLTDCPRALEELKAEHDALLKRKGNLKNQKLNWDDYQSLKFTQCVIHETLRVGNFGPGVFRETKEDIKTKGGFVIPRGWTVYVFLTGTHLDEKYHSSALKFDPWRWQPHLQDQELLKNPSFMPFGGGARLCPGMHLAKMELALFLHNFVTKFRWEALQDDKISYFPFPRLIKGLPIRLRLRE

SEQ ID NO: 3918 - DNA, 1482 bp, Populus balsamifera subsp. trichocarpa
  misc_feature (1)..(1482): useful for making plants with increased salt and oxidative stress resistance as described in USSN 12/922,143
  misc_feature (1)..(1482): Ceres ANNOT ID no.1543618
atgaatattaacacggacaatttattgtggattgcgttagcaatctcgttgtccagtactgccataatatttctctacaggaacagcagctggtttagtagcagtagtatgatgacgatcagattatcatcatcaaagtacaaaaccccacttcctttaggcactcttggatggccctttatcggtgaaaccatcgacttcgtttcatgtgcttactcagaccgccctgaaagcttcatggataaacgccgtcgcatgtatgggaaggtgttcaagtcacatatatttggaagtccgactatagtatcaacagatgcagaagtgagcaaatttatactacaaagtgatgcaaaggtgttcgttccttcttacccgaaatctctaaccgagttgatgggaaaatcttccattttgctcatcaatgggagcttacaaaggagaattcatggtctcataggtgccttcttcaaatcccctcatctcaaagctcaaatcacccgagacatgcaaagttatgttcaagaatcaatggagaaatggagagaagaccagcccattttcatacaagatgaaaccaagaatattgcctttcaagtattagtcaaggcattgattagtttggatcctggtgaagaaatggagctgctaaagaaacagttccaagaattcattgctggtctcatgtccttacctttaaacatccctggaagtcaactttatcgatcattacaggcaaagaagaaaatggtgaagttagtgcagaaaatcatccaatctaaaagagaaggtagagctgggattgtttcaatggcaccaaaggatgtagcggaagtgttgcttaatgatgcaagtgaacagttaacagatgatttaatagctgataatatgatcgatatgatgatacctggtgaggattcagtgccggtcctcatgactcttgctgttaagtacctttcagattgccctgctgctctgcaacaattgacgaaggagaacatgaaattgaaaagtctcaaagctcagcatggggagccattgtgctggactgattatttatctctaccctttactcaaacggtgatcacagaaactctaagaatgggaaacataataatcggggtgatgagaaaggcgatgaaggacacagaaattaaagggtatttgatacccaaaggatggtgtgcttttgcatatttcaggtcagttcatcttgatgaaaacaactatgagtggccttacgaattcaatccatggaggtggcaagacaaggatatgagcattaatggcagcttcactccatttggaggaggacaaagattatgtcctggacttgacctcgccaggctggaagcttcaatcttcttgcaccactttgtcacccagttcaggtgggtggctgaggaggatactgtagtgaatttccctactgtaagaatgaagagaagaatgccgatttgggtcaaaaggggaggagaaaattaa

SEQ ID NO: 3919 - protein, 456 aa, Populus balsamifera subsp. trichocarpa
  misc_feature (1)..(456): useful for making plants with increased salt and oxidative stress resistance as described in USSN 12/922,143
  misc_feature (1)..(456): Ceres ANNOT ID no.1543618
  misc_feature (1)..(456): Bit score of 761.8 for HMM based on sequences of FIGURE 7 of USSN 12/922,143.
  misc_feature (307)..(427): Pfam Name: p450 Pfam Description: Cytochrome P450
  misc_feature (1)..(456): Functional Homolog Of Ceres SEEDLINE ID no. ME06336
MTIRLSSSKYKTPLPLGTLGWPFIGETIDFVSCAYSDRPESFMDKRRRMYGKVFKSHIFGSPTIVSTDAEVSKFILQSDAKVFVPSYPKSLTELMGKSSILLINGSLQRRIHGLIGAFFKSPHLKAQITRDMQSYVQESMEKWREDQPIFIQDETKNIAFQVLVKALISLDPGEEMELLKKQFQEFIAGLMSLPLNIPGSQLYRSLQAKKKMVKLVQKIIQSKREGRAGIVSMAPKDVAEVLLNDASEQLTDDLIADNMIDMMIPGEDSVPVLMTLAVKYLSDCPAALQQLTKENMKLKSLKAQHGEPLCWTDYLSLPFTQTVITETLRMGNIIIGVMRKAMKDTEIKGYLIPKGWCAFAYFRSVHLDENNYEWPYEFNPWRWQDKDMSINGSFTPFGGGQRLCPGLDLARLEASIFLHHFVTQFRWVAEEDTVVNFPTVRMKRRMPIWVKRGGEN

SEQ ID NO: 3920 - protein, 491 aa, Arabidopsis thaliana
  misc_feature (1)..(491): useful for making plants with increased salt and oxidative stress resistance as described in USSN 12/922,143
  misc_feature (1)..(491): Public GI ID no.18400142
  misc_feature (1)..(491): Bit score of 700.8 for HMM based on sequences of FIGURE 7 of USSN 12/922,143.
  misc_feature (356)..(490): Pfam Name: p450 Pfam Description: Cytochrome P450
  misc_feature (1)..(491): Functional Homolog Of Ceres SEEDLINE ID no. ME06336
MDTSSSLLFFSFFFFIIIVIFNKINGLRSSPASKKKLNDHHVTSQSHGPKFPHGSLGWPVIGETIEFVSSAYSDRPESFMDKRRLMYGRVFKSHIFGTATIVSTDAEVNRAVLQSDSTAFVPFYPKTVRELMGKSSILLINGSLHRRFHGLVGSFLKSPLLKAQIVRDMHKFLSESMDLWSEDQPVLLQDVSKTVAFKVLAKALISVEKGEDLEELKREFENFISGLMSLPINFPGTQLHRSLQAKKNMVKQVERIIEGKIRKTKNKEEDDVIAKDVVDVLLKDSSEHLTHNLIANNMIDMMIPGHDSVPVLITLAVKFLSDSPAALNLLTEENMKLKSLKELTGEPLYWNDYLSLPFTQKVITETLRMGNVIIGVMRKAMKDVEIKGYVIPKGWCFLAYLRSVHLDKLYYESPYKFNPWRWQERDMNTSSFSPFGGGQRLCPGLDLARLETSVFLHHLVTRFRWIAEEDTIINFPTVHMKNKLPIWIKRI

SEQ ID NO: 3921 - protein, 483 aa, Medicago truncatula
  misc_feature (1)..(483): useful for making plants with increased salt and oxidative stress resistance as described in USSN 12/922,143
  misc_feature (1)..(483): Public GI ID no.92890903
  misc_feature (1)..(483): Bit score of 440.9 for HMM based on sequences of FIGURE 7 of USSN 12/922,143.
  misc_feature (225)..(475): Pfam Name: p450 Pfam Description: Cytochrome P450
  misc_feature (1)..(483): Functional Homolog Of Ceres SEEDLINE ID no. ME06336
MWVLCLGALVTICIITRWVYRWRNPSCNGKLPPGSMGLPLLGESLQFFSPNTSCDIPPFIRKRMKRYGPIFKTNLVGRPVVVSTDPDLNYFIFQQEGKIFQSWYPDTFTEIFGQQNVGSLHGFMYKYLKNMMLNLFGPESLKKMISEVEQAACRTLQQASCQDSVELKEATETMIFDLTAKKLISYDPTESSENLRENFVAFIQGLISFPLNIPGTAYNKCLQGRKKAMKMLKNMLQERREMPRKQQMDFFDYVIEELRKEGTLLTEAIALDLMFVLLFASFETTSQALTYAIKLLSDNPLVFKQLQEEHEAILERRENPNSGVTWQEYKSMTFTFQLITETARLANIVPGIFRKALREINFKGYTIPAGWAIMVCPPAVHLNPAKYQDPLVFNPSRWEGMEPSGATKHFLAFGGGMRFCVGTEFAKVQMAVFLHCLVTKYRWRPIKGGNIVRTPGLQFPNGFHVQITEKDQKKHESECTTTY

SEQ ID NO: 3922 - protein, 473 aa, Oryza sativa subsp. japonica
  misc_feature (1)..(473): useful for making plants with increased salt and oxidative stress resistance as described in USSN 12/922,143
  misc_feature (1)..(473): Public GI ID no.55733866
  misc_feature (1)..(473): Bit score of 656.9 for HMM based on sequences of FIGURE 7 of USSN 12/922,143.
  misc_feature (334)..(471): Pfam Name: p450 Pfam Description: Cytochrome P450
  misc_feature (1)..(473): Functional Homolog Of Ceres SEEDLINE ID no. ME06336
MQPLAAGGGVSWPLYAATVAAALLVTAIVLRLAARSTAAACKARPPAGSLGWPLVGETLQFISAAYSSRPESFVEKRCRRYGKVFRSHLWGSPAVVSADAEASRAVLQSDASAFVPWYPRSLMELMGESSILVLGGALQRRVHGLAGAFFKSPELKARVTADMRSRLAAAMDAWRATAATGAGAAVRVQDEAKLIVFEILVRALIGLEQGQEMNYLRQQFHIFIAGLISLPIKLPGTQLYRSLKAKKRMTSLIQNIIQEKRRRIFEGKDLCAVSRDLIDVLMSNGSDELSLTDELISDNMIDFMIPAEDSVPVLITLAIKYLSECPLALQQLEVITETLRIGNIISGIMRKAVRDVEVKGQGDVVIPKGWCVLVYFRSVHLDANIYDDPYAFNPWRWKERDMAAATANSGSGFTPFGGGQRLCPGLDLARLQTSIFLHHLVTNFTWVAQGDVVVNFPTVRLKRGMPIKVTPKT

SEQ ID NO: 3923 - protein, 490 aa, Oryza sativa subsp. japonica
  misc_feature (1)..(490): useful for making plants with increased salt and oxidative stress resistance as described in USSN 12/922,143
  misc_feature (1)..(490): Public GI ID no.115435078
  misc_feature (1)..(490): Bit score of 819.6 for HMM based on sequences of FIGURE 7 of USSN 12/922,143.
  misc_feature (341)..(460): Pfam Name: p450 Pfam Description: Cytochrome P450
  misc_feature (1)..(490): Functional Homolog Of Ceres SEEDLINE ID no. ME06336
MVSAAAGWAAPAFAVAAVVIWVVLCSELLRRRRRGAGSGKGDAAAAARLPPGSFGWPVVGETLEFVSCAYSPRPEAFVDKRRKLHGSAVFRSHLFGSATVVTADAEVSRFVLQSDARAFVPWYPRSLTELMGKSSILLINGALQRRVHGLVGAFFKSSHLKSQLTADMRRRLSPALSSFPDSSLLHVQHLAKSVVFEILVRGLIGLEAGEEMQQLKQQFQEFIVGLMSLPIKLPGTRLYRSLQAKKKMARLIQRIIREKRARRAAASPPRDAIDVLIGDGSDELTDELISDNMIDLMIPAEDSVPVLITLAVKFLSECPLALHQLEEENIQLKRRKTDMGETLQWTDYMSLSFTQHVITETLRLGNIIGGIMRKAVRDVEVKGHLIPKGWCVFVYFRSVHLDDTLYDEPYKFNPWRWKEKDMSNGSFTPFGGGQRLCPGLDLARLEASIFLHHLVTSFRWVAEEDHIVNFPTVRLKRGMPIRVTAKEDDD

SEQ ID NO: 3924 - protein, 490 aa, Oryza sativa subsp. indica
  misc_feature (1)..(490): useful for making plants with increased salt and oxidative stress resistance as described in USSN 12/922,143
  misc_feature (1)..(490): Public GI ID no.125524776
  misc_feature (1)..(490): Bit score of 815.7 for HMM based on sequences of FIGURE 7 of USSN 12/922,143.
  misc_feature (341)..(460): Pfam Name: p450 Pfam Description: Cytochrome P450
  misc_feature (1)..(490): Functional Homolog Of Ceres SEEDLINE ID no. ME06336
MVSAAAGWAAPAFAVAAVVIWVVLCGELLRRRRRGAGSGKGDAAAAARLPPGSFGWPVVGETLEFVSCAYSPRPEAFVDKRRKLHGSAVFRSHLFGSATVVTADAEVSRFVLQSDARAFVPWYPRSLTELMGKSSILLINGALQRRVHGLVGAFFKSSHLKSQLTADMRRRLSPALSSFPDSSLLHVQHLAKSVVFEILVRGLIGLEAGEEMQQLKQQFQEFIVGLMSLPIKLPGTRLYRSLQAKKKMARLIQRIIREKRARRAAASLPRDAIDMLIGDGSDELTDELISDNMIDLMIPAEDSVPVLITLAVKFLSECPLALHQLEEENIQLKRRKTDMGETLQWTDYMSLSFTQHVITETLRLGNIIGGIMRKAVRDVEVKGHLIPKGWCVFVYFRSVHLDDTLYDEPYKFNPWRWKEKDMSNGSFTPFGGGQRLCPGLDLARLEASIFLHHLVTSFRWVAEEDHIVNFPTVRLKRGMPIRVTAKEDDD

SEQ ID NO: 3925 - DNA, 1416 bp, Populus balsamifera subsp. trichocarpa
  misc_feature (1)..(1416): useful for making plants with increased salt and oxidative stress resistance as described in USSN 12/922,143
  misc_feature (1)..(1416): Ceres ANNOT ID no.1491583
atgtgggctttgttctttggagctttgattattataagcattacacattgggtttaccgctggagaaaccccagatgcaatggcactctcccaccaggttcaatgggattgccacttattggcgagacccttcagttcttcgctccaaatacttcttgtgacatttctccatttgtcagagacaggatgaaaagatatggaccaatattccggactaatttggtcggaaggccagttgtagtatcaacagatccggatctcaattactttatcttccaacaagaaggaaaattgttccagagctggtatccggatacattcacggagatctttggaaggcaaaatgttggttcgttacatgggttcatgtacaagtatcttaagaatatggtgcttaatctcttcggtcctgaaagccttaaaaaaatgctccctgaagttgaacagacagcatcaaatagattacaactatggtctcatcaggaatcagttgaattgaaagaagcaactgcaactatgatatttgatctgacggcgaagaagctgataagttatgatcaagaaaattcttcagagaatctaagggagaactttgttgcattcatacaaggattaatctccttccctttggacattccaggaacagcatatcacgaatgcttacagggtaggaaaaaggcaatgagaatgctaaagaacctgctacaggaaagacaagcaaatccgagaaagcacgaaactgatttttttgattatgtgcttgaagaacttcaaaagaacaaaacaatccttacagaggaaatcgctctggatttaatgtttgtgctgctatttgccagctttgaaacaacttccctgggtctaactttagctgtcaagtttatatcggaccacccattggtgctaaaggaattgacggaagagcacgagggaattctaaaaaatcgggaaaatgccaactctggtcttacatggaaggaatacaaatcaatgaaattcacgtttcaggtcattaatgaaactgttagactggcaaacatagttccagggatcttcagaaaaacacttagagatatccagtttaagggctgggcagtaatggtctgtccccccgctgtacacttaaacccagcaaaatatgaagatccacttgccttcaatccatggagatggaagggtatggaagtaaatggtgcatccaaaactttcatggcctttggtggtggcatgagattttgtgttggaacagagtttaccaaggtgcagatggctgtatttctacattgcttggtcacaaagtccaggtggcaagcaatcaaaggaggaaatattgttcgaactcctggtttacaatttcccagtggttatcacattcagctcacggagagagacaaaagatataactctactacataa

SEQ ID NO: 3926 - protein, 471 aa, Populus balsamifera subsp. trichocarpa
  misc_feature (1)..(471): useful for making plants with increased salt and oxidative stress resistance as described in USSN 12/922,143
  misc_feature (1)..(471): Ceres ANNOT ID no.1491583
  misc_feature (1)..(471): Bit score of 447.9 for HMM based on sequences of FIGURE 7 of USSN 12/922,143.
  misc_feature (224)..(431): Pfam Name: p450 Pfam Description: Cytochrome P450
  misc_feature (1)..(471): Functional Homolog Of Ceres SEEDLINE ID no. ME06336
MWALFFGALIIISITHWVYRWRNPRCNGTLPPGSMGLPLIGETLQFFAPNTSCDISPFVRDRMKRYGPIFRTNLVGRPVVVSTDPDLNYFIFQQEGKLFQSWYPDTFTEIFGRQNVGSLHGFMYKYLKNMVLNLFGPESLKKMLPEVEQTASNRLQLWSHQESVELKEATATMIFDLTAKKLISYDQENSSENLRENFVAFIQGLISFPLDIPGTAYHECLQGRKKAMRMLKNLLQERQANPRKHETDFFDYVLEELQKNKTILTEEIALDLMFVLLFASFETTSLGLTLAVKFISDHPLVLKELTEEHEGILKNRENANSGLTWKEYKSMKFTFQVINETVRLANIVPGIFRKTLRDIQFKGWAVMVCPPAVHLNPAKYEDPLAFNPWRWKGMEVNGASKTFMAFGGGMRFCVGTEFTKVQMAVFLHCLVTKSRWQAIKGGNIVRTPGLQFPSGYHIQLTERDKRYNSTT

SEQ ID NO: 3927 - protein, 460 aa, Vitis vinifera
  misc_feature (1)..(460): useful for making plants with increased salt and oxidative stress resistance as described in USSN 12/922,143
  misc_feature (1)..(460): Public GI ID no.81239117
  misc_feature (1)..(460): Bit score of 418.7 for HMM based on sequences of FIGURE 7 of USSN 12/922,143.
  misc_feature (207)..(456): Pfam Name: p450 Pfam Description: Cytochrome P450
  misc_feature (1)..(460): Functional Homolog Of Ceres SEEDLINE ID no. ME06336
MAVFGVVLIGLCICTALLRWNEVRYRKKGLPPGTMGWPVFGETTEFLKQGPSFMKNQRARYGKFFKSHLLGCPTTVSMDPELNRYILMNEAKGLVPGYPQSMLDILGKCNIAAVHGSTHKYMRGALLALISPTMIRGQLLPKIDEFMRSHLNKWDTKIINIQEKTKEMALLSSLKQIAGIESGTISKEFMPEFFKLVLGTISLPIDLPGTNYRRGFQARKNIVGMLRQLIEERKASQETHNDMLGCLMRTNENRYKLSDEEIIDLIITILYSGYETVSTTSMMAVKYLHDHPRVLDELRKEHLAIRERKRPEDPIDWNDYKLMRFTRAVIFETSRLATIVNGVLRKTTKDMELNGFVIPKGWRIYVYTREINYDPLLYPDPLAFNPWRWLDKSLESQNYFLLFGGGTRQCPGKELGIAEISTFLHYFVTRYRWEEVGGDKLMKFPRVEAPNGLHIRVSAY

SEQ ID NO: 3928 - DNA, 1888 bp, Triticum aestivum
  misc_feature (1)..(1888): useful for making plants with increased salt and oxidative stress resistance as described in USSN 12/922,143
  misc_feature (1)..(1888): Ceres CLONE ID no.703807
  misc_feature (446)..(446): r is g or a
  misc_feature (596)..(596): r is g or a
  misc_feature (726)..(726): m is a or c
  misc_feature (1061)..(1061): s is g or c
acaaacccacacacaacccctctgtctcctcctccttggctttgctagcttcctgctcccttcgcttcccacatgcagccatatcttgagctagcttctctccgcatcaccgccaccatcccgctgtccccaagaatatatagcaccatcttcctcgaggccatggctgccatggcctatatagccctccggggcgcggcattggccgccatcgtcgccctcatccattgggtgtacaggtggcgccaccccaaatgcgccggcacgctcccgccgggatccatgggcatccccatcatcggcgagacgctgcagttcttcgcccccaacccgacctgcggcctctcccccttcgtccgggacagggtgaagaggtacgggagcatgttcaagacgagcatcgtggggcggccggtggtggtgtcggcggacccggacgtgaaccrctacgtgttccagaacgaggggaagctgttcgagagctggtacccggacaccttcaccgagatcttcggccgcgacaacgtcggctccctgcacggcttcatctacaagtaccctcaagaccctcgtgctccgcctctacggccagccargagaacctcaaggcggtgctcctcgccgagaccgacgccgcctgccgcggcagcctcgccgcgtgggcggcgcagccctgtgtcgacatcaaagacgggctctccactatgatatttgatcttactgccmagaagctgatcggctacgagccgaccaagtcctcggagagcctgcgggagaatttcacggcgttcattcgcggcctgatctcgttccccctcaacattcccggcacggcctatcacgaatgcatggaggggaggaagaaagcgatgaaggtgctcaagggcatgatgcaggagaggatggcggatccggagaggaagtgcgaggacttcttcgaccacgtgatccaggaactgaggagggagaagccgcttctgacggagaccatcgcgctggacctcatgttcgtgctcctcttcgccagcttcgagaccacggcgctcgccctcaccctcggsgtcaagctgctcaccgagaaccccagagtcgtcgacgcgctaacggaggaacacgaagcgatcgtgaggaacagggaggacccagatgccgcgatcacgtgggccgagtacaagtcgatgaccttcacagctcatgtcatcatggagatcgtcagactcgccaacatcgtgccggggattttccggaaggccttgcaagacgttgagatcaaaggctacacggttccagcgggatggggtatcatggtgtgtccgccggcggtgcacctaaaccctgacatatacgaagatccgctggcgttcaacccatggaggtggcaggacaaacctgaaatcaccggcggaacgaagcatttcatggcgttcggaggcgggcttcggttctgcgtcggaaccgatctcaccaaggtcttgatggcaacattcattcacaatcttgttacgaaatacagatggaagacagtaaaaggagggaacatagtccggacgccgggcctcggcttcccggatggctttgacatccagctcttccctaagaactgacccttttttgatgatatctcgacagtttagtggttgcagttaaacacaagattgttcctgcaaaagatcacattttaggatggaaaaccatatacttagtctagtggtaggatacacattcctagttataactacagtcatattgccgggtaccacctctcatggatccagaatgggttttttgtacttttggctgttcgttttccatgtggttagtcatctatccatgtgttgtgtgtaaatcaatcccatacatctcaaatgagaaagagagcatattaact

SEQ ID NO: 3929 - protein, 508 aa, Triticum aestivum
  misc_feature (1)..(508): useful for making plants with increased salt and oxidative stress resistance as described in USSN 12/922,143
  misc_feature (1)..(508): Ceres CLONE ID no.703807
  misc_feature (1)..(508): Bit score of 440.9 for HMM based on sequences of FIGURE 7 of USSN 12/922,143.
  misc_feature (245)..(504): Pfam Name: p450 Pfam Description: Cytochrome P450
  misc_feature (1)..(508): Functional Homolog Of Ceres SEEDLINE ID no. ME06336
MQPYLELASLRITATIPLSPRIYSTIFLEAMAAMAYIALRGAALAAIVALIHWVYRWRHPKCAGTLPPGSMGIPIIGETLQFFAPNPTCGLSPFVRDRVKRYGSMFKTSIVGRPVVVSADPDVNHYVFQNEGKLFESWYPDTFTEIFGRDNVGSLHGFIYKYLKTLVLRLYGQENLKAVLLAETDAACRGSLAAWAAQPCVDIKDGLSTMIFDLTAKKLIGYEPTKSSESLRENFTAFIRGLISFPLNIPGTAYHECMEGRKKAMKVLKGMMQERMADPERKCEDFFDHVIQELRREKPLLTETIALDLMFVLLFASFETTALALTLGVKLLTENPRVVDALTEEHEAIVRNREDPDAAITWAEYKSMTFTAHVIMEIVRLANIVPGIFRKALQDVEIKGYTVPAGWGIMVCPPAVHLNPDIYEDPLAFNPWRWQDKPEITGGTKHFMAFGGGLRFCVGTDLTKVLMATFIHNLVTKYRWKTVKGGNIVRTPGLGFPDGFDIQLFPKN

SEQ ID NO: 3930 - protein, 480 aa, Oryza sativa
  misc_feature (1)..(480): useful for making plants with increased salt and oxidative stress resistance as described in USSN 12/922,143
  misc_feature (1)..(480): Public GI ID no.116310012
  misc_feature (1)..(480): Bit score of 446.1 for HMM based on sequences of FIGURE 7 of USSN 12/922,143.
  misc_feature (217)..(476): Pfam Name: p450 Pfam Description: Cytochrome P450
  misc_feature (1)..(480): Functional Homolog Of Ceres SEEDLINE ID no. ME06336
MASSMAYIALLCAALAAVVALLRWAYRWSHPRSNGRLPPGSLGLPVIGETLQFFAPNPTCDLSPFVKERIKRYGSIFKTSVVGRPVVVSADPEMNYYVFQQEGKLFESWYPDTFTEIFGRDNVGSLHGFMYKYLKTLVLRLYGQENLKSVLLAETDAACRGSLASWASQPSVELKEGISTMIFDLTAKKLIGYDPSKPSQVNLRKNFGAFIRGLISFPLNIPGTAYHECMEGRKNAMKVLRGMMKERMAEPERPCEDFFDHVIQELRREKPLLTETIALDLMFVLLFASFETTALALTIGVKLLTENPKVVDALREEHEAIIRNRKDPNSGVTWAEYKSMTFTSQVIMEIVRLANIVPGIFRKALQDVEIKGYTIPAGWGIMVCPPAVHLNPEIYEDPLAFNPWRWQGKPEITGGTKHFMAFGGGLRFCVGTDLSKVLMATFIHALVTKYSWRTVKGGNIVRTPGLSFPDGFHIQLFPKN

SEQ ID NO: 3931 - DNA, 1692 bp, Triticum aestivum
  misc_feature (1)..(1692): useful for making plants with increased salt and oxidative stress resistance as described in USSN 12/922,143
  misc_feature (1)..(1692): Ceres CLONE ID no.822001
tagctagctagtgttatccgttagccgatgccgttggctggctttcgatcgatcacacgagacatgtggaaaccacgggcggccatgtattcagttcgtcgttagcgcgcgcgtagcagatagaagatggacgccttggcggggctctcggcccttgccgcggtggcgctgctgctgctgtacagcgtgcaccggtggaggagccctcggtgcaacggccggctcccgccggggtctatgggcctcccgctcgtcggcgagacgttccagttcttctccccggacgcctccttggacatccctcgcttcatccgacacaggctcacgaggtacggcccgatcttcaagacgagcgtggtggggcacccgatggtggtgtcggcggaccaggagctgaaccacatggtgttccagcaggagggggagctgttccagagctggtacccggactcgttcgtggagatcctcggccgcgataacgtcggggagcagaagggcaccatgttcaagtacctcaagaacatagttctcaggtacttcggcccggagagccttaaggagtccatccttggcgacgtcgagcgcgccgtctgcagctcgctctgcacctggtccaccctgccggccgtcgagctcaaagaagccgtctccaccatggtgtttgaactttccgcgagcaagctgctgggcctggagccgtcgaggtccaaggttctacggaagagcttcttcgacttcgtcagagggctcatctccttcccgctctacttgccaggaacagcctactacgcatgcatgcagggacggatgagtgtaatggaggtgctgcagcaggtgctggaggagaggacgagatcggctgaggcggccggaggacgggaagcacggtgccacggcgacttcctggactacgtcgtgcaggagatcaccaaggagaagcctgtcctgacggagggaatggcgctggacctcctgtttgtgctcctcttcgccagcttccacacgacgtcgctggccatcaccctggccgtcaagctcctcaccgagcaccctcgcgtcctggaggagctcacggtggagcatgaaacgattctgaacgagcgtgaggcaggcggcgagtctgatggcgacagagttacatggaaagagtacaaatccatgacattcacatcccaggtgataaacgagacggtccgactggccaacattgcgcctggcatcttcagaaagacactgaaagatgtacagttcagaggatacacaattccagctggatggggagtgatggtctgccctctcgcggtgcaccttaatccagatatttaccctgaccccctcaccttcaatccttcaaggttcaaggataaactagaggcaaaccgtgggttaagacacttcatggctttcggaggaggtctccggtcctgtgttggggcagacttcagcaagctacaaatggccattttccttcactttcttgtcaccaaatataggtggatacaactaggtggaggcaagatagtccggtgtccagggctggaatttcctgatggttacctcattcagatcagacagagagattaatcagcacctgctttcaagtcatgctagcagtaggaaaagcttatatctcacgtgtacaattgttctagcatgttgtttgatgaaataacacttgtgcagaagtattac

SEQ ID NO: 3932 - protein, 485 aa, Triticum aestivum
  misc_feature (1)..(485): useful for making plants with increased salt and oxidative stress resistance as described in USSN 12/922,143
  misc_feature (1)..(485): Ceres CLONE ID no.822001
  misc_feature (1)..(485): Bit score of 446.4 for HMM based on sequences of FIGURE 7 of USSN 12/922,143.
  misc_feature (213)..(457): Pfam Name: p450 Pfam Description: Cytochrome P450
  misc_feature (1)..(485): Functional Homolog Of Ceres SEEDLINE ID no. ME06336
MDALAGLSALAAVALLLLYSVHRWRSPRCNGRLPPGSMGLPLVGETFQFFSPDASLDIPRFIRHRLTRYGPIFKTSVVGHPMVVSADQELNHMVFQQEGELFQSWYPDSFVEILGRDNVGEQKGTMFKYLKNIVLRYFGPESLKESILGDVERAVCSSLCTWSTLPAVELKEAVSTMVFELSASKLLGLEPSRSKVLRKSFFDFVRGLISFPLYLPGTAYYACMQGRMSVMEVLQQVLEERTRSAEAAGGREARCHGDFLDYVVQEITKEKPVLTEGMALDLLFVLLFASFHTTSLAITLAVKLLTEHPRVLEELTVEHETILNEREAGGESDGDRVTWKEYKSMTFTSQVINETVRLANIAPGIFRKTLKDVQFRGYTIPAGWGVMVCPLAVHLNPDIYPDPLTFNPSRFKDKLEANRGLRHFMAFGGGLRSCVGADFSKLQMAIFLHFLVTKYRWIQLGGGKIVRCPGLEFPDGYLIQIRQRD

SEQ ID NO: 3933 - protein, 404 aa, Arabidopsis thaliana
  misc_feature (1)..(404): useful for making plants with increased salt and oxidative stress resistance as described in USSN 12/922,143
  misc_feature (1)..(404): Public GI ID no.79327045
  misc_feature (1)..(404): Bit score of 655.1 for HMM based on sequences of FIGURE 7 of USSN 12/922,143.
  misc_feature (205)..(395): Pfam Name: p450 Pfam Description: Cytochrome P450
  misc_feature (1)..(404): Functional Homolog Of Ceres SEEDLINE ID no. ME06336
MAFTAFLLLLSSIAAGFLLLLRRTRYRRMGLPPGSLGLPLIGETFQLIGAYKTENPEPFIDERVARYGSVFMTHLFGEPTIFSADPETNRFVLQNEGKLFECSYPASICNLLGKHSLLLMKGSLHKRMHSLTMSFANSSIIKDHLMLDIDRLVRFNLDSWSSRVLLMEEAKKITFELTVKQLMSFDPGEWSESLRKEYLLVIEGFFSLPLPLFSTTYRKAIQARRKVAEALTVVVMKRREEEEEGAERKKDMLAALLAADDGFSDEEIVDFLVALLVAGYETTSTIMTLAVKFLTETPLALAQLKEEHEKIRAMKSDSYSLEWSDYKSMPFTQCVVNETLRVANIIGGVFRRAMTDVEIKGYKIPKGWKVFSSFRAVHLDPNHFKDARTFNPWRWQQLGNDRPF

SEQ ID NO: 3934 - protein, 480 aa, Oryza sativa subsp. japonica
  misc_feature (1)..(480): useful for making plants with increased salt and oxidative stress resistance as described in USSN 12/922,143
  misc_feature (1)..(480): Public GI ID no.125591255
  misc_feature (1)..(480): Bit score of 458.1 for HMM based on sequences of FIGURE 7 of USSN 12/922,143.
  misc_feature (224)..(476): Pfam Name: p450 Pfam Description: Cytochrome P450
  misc_feature (1)..(480): Functional Homolog Of Ceres SEEDLINE ID no. ME06336
METLVCVAVWAVAMAMVVASVMWAYRWSHPRANGRLPPGSLGLPLLGETLQFFAPNTTCDISPFVKERLNRYGSIFKTSVVGRPVVVTADPEMNYYVFQQEGKLFESWYPDTFTEIFGRDNVGSLHGFMYKYLKSLVLRLYGQENLRAVLLDETDRACRTSLASWAAQPSVELKDSISAMIFDLTAKKLISYEPSKSSENLRKNFVAFIRGLISFPVDIPGTAYHECMKGRRNAMKVLKKMMRERMEEPGRQCEDFFDVLIEELGREKPVLTEGIALDLMFVLLFASFETTSLALTLGVRLLAENPTVLDALTEEHEAIVRGRKEGCDAAGLTWADYKSMTFTSQVTLEMVRLANIVPGIFRKALQDIEFKGYTIPAGWGVMVCPPAVHLNPEIYEDPLAFNPWRWQDKVEITGGSKHFMAFGGGLRFCVGTDLSKVLIATFIHHLVTKYRWKTVKGGNIVRTPGLSFPDGFHVQFFPKN

SEQ ID NO: 3935 - protein, 514 aa, Oryza sativa subsp. japonica
  misc_feature (1)..(514): useful for making plants with increased salt and oxidative stress resistance as described in USSN 12/922,143
  misc_feature (1)..(514): Public GI ID no.115459998
  misc_feature (1)..(514): Bit score of 442.1 for HMM based on sequences of FIGURE 7 of USSN 12/922,143.
  misc_feature (251)..(510): Pfam Name: p450 Pfam Description: Cytochrome P450
  misc_feature (1)..(514): Functional Homolog Of Ceres SEEDLINE ID no. ME06336
MQPYLQLASLRLATTIPLAPRLYDANLLAASGAAMASSMAYIALLCAALAAVVALLRWAYRWSHPRSNGRLPPGSLGLPVIGETLQFFAPNPTCDLSPFVKERIKRYGSIFKTSVVGRPVVVSADPEMNYYVFQQEGKLFESWYPDTFTEIFGRDNVGSLHGFMYKYLKTLVLRLYGQENLKSVLLAETDAACRGSLASWASQPSVELKEGISTMIFDLTAKKLIGYDPSKPSQVNLRKNFGAFICGLISFPLNIPGTAYHECMEGRKNAMKVLRGMMKERMAEPERPCEDFFDHVIQELRREKPLLTETIALDLMFVLLFASFETTALALTIGVKLLTENPKVVDALREEHEAIIRNRKDPNSGVTWAEYKSMTFTSQVIMEIVRLANIVPGIFRKALQDVEIKGYTIPAGWGIMVCPPAVHLNPEIYEDPLAFNPWRWQGKPEITGGTKHFMAFGGGLRFCVGTDLSKVLMATFIHSLVTKYSWRTVKGGNIVRTPGLSFPDGFHIQLFPKN

SEQ ID NO: 3936 - protein, 480 aa, Oryza sativa subsp. japonica
  misc_feature (1)..(480): useful for making plants with increased salt and oxidative stress resistance as described in USSN 12/922,143
  misc_feature (1)..(480): Public GI ID no.38567920
  misc_feature (1)..(480): Bit score of 442.1 for HMM based on sequences of FIGURE 7 of USSN 12/922,143.
  misc_feature (217)..(476): Pfam Name: p450 Pfam Description: Cytochrome P450
  misc_feature (1)..(480): Functional Homolog Of Ceres SEEDLINE ID no. ME06336
MASSMAYIALLCAALAAVVALLRWAYRWSHPRSNGRLPPGSLGLPVIGETLQFFAPNPTCDLSPFVKERIKRYGSIFKTSVVGRPVVVSADPEMNYYVFQQEGKLFESWYPDTFTEIFGRDNVGSLHGFMYKYLKTLVLRLYGQENLKSVLLAETDAACRGSLASWASQPSVELKEGISTMIFDLTAKKLIGYDPSKPSQVNLRKNFGAFICGLISFPLNIPGTAYHECMEGRKNAMKVLRGMMKERMAEPERPCEDFFDHVIQELRREKPLLTETIALDLMFVLLFASFETTALALTIGVKLLTENPKVVDALREEHEAIIRNRKDPNSGVTWAEYKSMTFTSQVIMEIVRLANIVPGIFRKALQDVEIKGYTIPAGWGIMVCPPAVHLNPEIYEDPLAFNPWRWQGKPEITGGTKHFMAFGGGLRFCVGTDLSKVLMATFIHSLVTKYSWRTVKGGNIVRTPGLSFPDGFHIQLFPKN

SEQ ID NO: 3937 - DNA, 1655 bp, Triticum aestivum
  misc_feature (1)..(1655): useful for making plants with increased salt and oxidative stress resistance as described in USSN 12/922,143
  misc_feature (1)..(1655): Ceres CLONE ID no.923599
acccgatgcgcctggctggctttcgattgatcacacgagacatgtagaaaccacatgcgtttccaacctagttagatagaaggatggacgccttggcggggctctcggcctttgccgcggtggcgctgccgctcctcctgctgtacagcgtgcaccggtggaggaaccctcggtgcaacggccggctcccgccggggtccatgggcctcccgctcgtcggcgagacgttccagttcttctccccggacgcctccttggacgtccctcgcttcatccgagacaggctcacgaggtacggcccgatcttcaagacgagcgtggtggggcacccggtggtggtgtcggcggacgaggagctgaaccacatggtgttccagcaggagggggagctgttccagagctggtacccggactcgttcgtggagatcctcggccgcgacaacgtcggggagcagaagggcaccatgttcaagtacctcaagaacatggtgctcaggttcttcggcccggagagcctcaaggagtccatcctccgcgacgtccagcgcgccgtctgcagctcgctctgcacctggtccaccctgccggccgtcgacctcaaagaagccgtctccaccatggtgtttgaactttcggcgagcaagctgctcggcctggagccgtcgaggtccaaggttctacggaagagcttcttcgacttcgttctagggctcatctccttcccgctctacctgccaggaacagcctactacgcatgcatgcagggacggatgagtgtaatggaggtgctgcagcaggtgttggaggagaggacgagatcagctgaggcggccggaggaggggaagcacggtgccacggcgacttcctggactacgtcgtccaggagatcaccaaggagaagccggtcctgacggagggaatggcgctggacctcctgtttgtgctcctcttcgccagcttccacaccacgtcgctggccatcaccctggccgtcaagctcctcaccgacaaccctcgcgtcctggaggaactcacggtggagcatgaaacgattctgaacgagcgtgaggcaggcggtgagactgatggcgacagacttacatggaaagagtacaaatccatgacattcacatcccaggtgataaacgagacggtccgactggccaacattgcgcctggcatcttcagaaagacactgaaagatgtacagttcagagtctacacaattccagctggatggggagtgatggtctgccctctcgcggtgcacctgaatccagatatttaccctgaccccctcaccttcaatccttcaaggtttaaggataaactagaggcaaaccgtgggtcaagacacttcatggctttcggaggaggtctccggtcctgtgttggagcagacttcagcaagctacaaatggccattttccttcactttcttgtcaccaaatataggtggatacaactaggtggaggcaagatagtccggtgtccagggctggaatttcctgatggttacctcattcagattagacagagagactaatcaacacctgctttcaagtcatgctagcagtaggaaaagcttatatcacacgtgtacaattgttctagcatgttgtttgatgaaataacagttgtgcagaagtattat

SEQ ID NO: 3938 - protein, 487 aa, Triticum aestivum
  misc_feature (1)..(487): useful for making plants with increased salt and oxidative stress resistance as described in USSN 12/922,143
  misc_feature (1)..(487): Ceres CLONE ID no.923599
  misc_feature (1)..(487): Bit score of 449.2 for HMM based on sequences of FIGURE 7 of USSN 12/922,143.
  misc_feature (202)..(459): Pfam Name: p450 Pfam Description: Cytochrome P450
  misc_feature (1)..(487): Functional Homolog Of Ceres SEEDLINE ID no. ME06336
MDALAGLSAFAAVALPLLLLYSVHRWRNPRCNGRLPPGSMGLPLVGETFQFFSPDASLDVPRFIRDRLTRYGPIFKTSVVGHPVVVSADEELNHMVFQQEGELFQSWYPDSFVEILGRDNVGEQKGTMFKYLKNMVLRFFGPESLKESILRDVQRAVCSSLCTWSTLPAVDLKEAVSTMVFELSASKLLGLEPSRSKVLRKSFFDFVLGLISFPLYLPGTAYYACMQGRMSVMEVLQQVLEERTRSAEAAGGGEARCHGDFLDYVVQEITKEKPVLTEGMALDLLFVLLFASFHTTSLAITLAVKLLTDNPRVLEELTVEHETILNEREAGGETDGDRLTWKEYKSMTFTSQVINETVRLANIAPGIFRKTLKDVQFRVYTIPAGWGVMVCPLAVHLNPDIYPDPLTFNPSRFKDKLEANRGSRHFMAFGGGLRSCVGADFSKLQMAIFLHFLVTKYRWIQLGGGKIVRCPGLEFPDGYLIQIRQRD

SEQ ID NO: 3939 - protein, 469 aa, Oryza sativa subsp. japonica
  misc_feature (1)..(469): useful for making plants with increased salt and oxidative stress resistance as described in USSN 12/922,143
  misc_feature (1)..(469): Public GI ID no.115454045
  misc_feature (1)..(469): Bit score of 418.6 for HMM based on sequences of FIGURE 7 of USSN 12/922,143.
  misc_feature (218)..(465): Pfam Name: p450 Pfam Description: Cytochrome P450
  misc_feature (1)..(469): Functional Homolog Of Ceres SEEDLINE ID no. ME06336
MVLVAIGVVVAAAVVVSSLLLRWNEVRYSRKRGLPPGTMGWPLFGETTEFLKQGPSFMKARRLRYGSVFRTHILGCPTVVCMEAELNRRALASEGRGFVPGYPQSMLDILGRNNIAAVQGPLHRAMRGAMLSLVRPAMIRSSLLPKIDAFMRSHLAAWSSSSSSAVVDIQAKTKEMALLSALRQIAGVSAGPLSDALKAELYTLVLGTISLPINLPGTNYYQGFKARKKLVAMLEQMIAERRSSGQVHDDMLDALLTGVEGTREKLTDEQIIDLIITLIYSGYETMSTTSMMAVKYLSDHPKALEQLRKEHFDIRKGKAPEDAIDWNDFKSMTFTRAVIFETLRLATVVNGLLRKTTQDVEMNGYVIPKGWRIYVYTREINYDPFLYPDPMTFNPWRWLEKNMESHPHFMLFGGGSRMCPGKEVGTVEIATFLHYFVTQYRWEEEGNNTILKFPRVEAPNGLHIRVQDY

SEQ ID NO: 3940 - protein, 484 aa, Oryza sativa
  misc_feature (1)..(484): useful for making plants with increased salt and oxidative stress resistance as described in USSN 12/922,143
  misc_feature (1)..(484): Public GI ID no.116310273
  misc_feature (1)..(484): Bit score of 421.9 for HMM based on sequences of FIGURE 7 of USSN 12/922,143.
  misc_feature (234)..(480): Pfam Name: p450 Pfam Description: Cytochrome P450
  misc_feature (1)..(484): Functional Homolog Of Ceres SEEDLINE ID no. ME06336
MYAYVGLVGAAAALVLLLRHQARRWRNPRCGGQLPPGSMGLPLVGETFQFFSSDASLDIPPFIRHRLARYGPIFKTSLVGHPVVVSADEELNHMVFQQEGQLFQSWYPDSFVEILGKDNVGEQQGAMFRYLKNMVLRYFGPESLKEGIIRDVERAVSSSLCTWSTLPAVELKEAVSTMVFDLAASKLLGLEPSRSKILRKSFFDFVRGLISFPLYLPGTAYYSCMQGRRRAMVVLEQVLEERKQSTGLQRGGEAQQHGDFLDYVIQEITKEKPVMTEKMALDLMFVLLFASFHTTSLALTLAVKLLADHPLVLEELTVEHETILKDREAGSELDRITWKEYKSMAFTSQVINETVRLANIAPVIFRKALKDIRFNGYTIPAGWGVMVCPPAVHLNPYIYPDPLTFIPSRFKDKPEINRGSKHFMAFGGGLRFCVGADFSKLQLAIFLHFLVTKYRWIPLGASRVVRTPGLEFPDGYRIKVIQRH

SEQ ID NO: 3941 - DNA, 1350 bp, Populus balsamifera subsp. trichocarpa
  misc_feature (1)..(1350): useful for making plants with increased salt and oxidative stress resistance as described in USSN 12/922,143
  misc_feature (1)..(1350): Ceres ANNOT ID no.1540583
atggtgatgatgatgatcaaatcatcatcaatgtacgaaaaaaccttacttcctttaggcgctcttggatggccctttatcggcgaaaccatcgacttcgtttcctgtgcttactcagaccgccctgaaagcttcatggataaacgtcgtcgcatgtatgggaaggtgttcaagtcacatatatttggaagtcctacaatagtatcaacagatgcagaagtgagcaaatttatactacaaagtgatgcaaggttgttcgttccttcttacccgaaatctctcactgagttgatgggaaaatcttcaattttgctcatcaatgggagcttacaaaggagaattcatggactcataggtgccttcttcaagtcacctcatctcaaagctcaaatcactcgagacatgcaaagttatgttcaagaatcaatggagaaatggagagaagaccaccccattttcatacaagatgaaaccaagaatgcattgattagtttggatcctggtgaagaaatggagttgctaaaaaaacagttccaagaattcattgcagggctcatgtctttacctttaaaaaacattcctggaagccaactttatcgatcattacaggcaaagaaaaaaatggtgaagttagtgcaaaaaattatcaaatctaagagagatcatgggatgatttcaatggtaccaaaagatttagtgcaagtgttgcttaacgatgcaagcgaacaactaacagatgatttgatagctgataatatgatcgacatgatgatacctggcgaagattcagtcccagtccttatgactcttgctgttaaatacctttcagactgccctcctgcgctacaccaattgacggaggagaacatgaaattgaaaagtctcaaagctcagcatggggagccgatgtgctggagtgattatttatctctaccctttacacaaacagtgattacagaaaccctaagaatggggaacattataattggggtgatgagaaaggcgatgaaggacatagagattaaagggtatttgatacccaaaggatggtgtgcttttgcatacttcagatcagttcatcttgatgaaaacaactatgagtggccttaccagttcaatccatggaggtggcaagacaaggatatgagcaatagtagcttcactccatttggaggaggacaaagattatgtcctggacttgacttggccaggctggaagcttcaattttcttgcaccactttgtcacccagtttagatgggtggctgaggacgatactattgtaaatttccctactgtgaggatgaagagaagaatgccgatttgggtcaaaaggagaggagaaaattaa

SEQ ID NO: 3942 - protein, 446 aa, Populus balsamifera subsp. trichocarpa
  misc_feature (1)..(446): useful for making plants with increased salt and oxidative stress resistance as described in USSN 12/922,143
  misc_feature (1)..(446): Ceres ANNOT ID no.1540583
  misc_feature (1)..(446): Bit score of 717.1 for HMM based on sequences of FIGURE 7 of USSN 12/922,143.
  misc_feature (301)..(417): Pfam Name: p450 Pfam Description: Cytochrome P450
  misc_feature (1)..(446): Functional Homolog Of Ceres SEEDLINE ID no. ME06336
MMIKSSSMYEKTLLPLGALGWPFIGETIDFVSCAYSDRPESFMDKRRRMYGKVFKSHIFGSPTIVSTDAEVSKFILQSDARLFVPSYPKSLTELMGKSSILLINGSLQRRIHGLIGAFFKSPHLKAQITRDMQSYVQESMEKWREDHPIFIQDETKNALISLDPGEEMELLKKQFQEFIAGLMSLPLKNIPGSQLYRSLQAKKKMVKLVQKIIKSKRDHGMISMVPKDLVQVLLNDASEQLTDDLIADNMIDMMIPGEDSVPVLMTLAVKYLSDCPPALHQLTEENMKLKSLKAQHGEPMCWSDYLSLPFTQTVITETLRMGNIIIGVMRKAMKDIEIKGYLIPKGWCAFAYFRSVHLDENNYEWPYQFNPWRWQDKDMSNSSFTPFGGGQRLCPGLDLARLEASIFLHHFVTQFRWVAEDDTIVNFPTVRMKRRMPIWVKRRGEN

SEQ ID NO: 3943 - protein, 486 aa, Oryza sativa subsp. japonica
  misc_feature (1)..(486): useful for making plants with increased salt and oxidative stress resistance as described in USSN 12/922,143
  misc_feature (1)..(486): Public GI ID no.115460002
  misc_feature (1)..(486): Bit score of 424.5 for HMM based on sequences of FIGURE 7 of USSN 12/922,143.
  misc_feature (236)..(482): Pfam Name: p450 Pfam Description: Cytochrome P450
  misc_feature (1)..(486): Functional Homolog Of Ceres SEEDLINE ID no. ME06336
MYAYVGLVGGAAALVLLLLLRHQARRWRNPRCGGQLPPGSMGLPLVGETFQFFSSDASLDIPPFIRHRLARYGPIFKTSLVGHPVVVSADEELNHMVFQQEGQLFQSWYPDSFVEILGKDNVGEQQGAMFRYLKNMVLRYFGPESLKEGIIRDVERAVSSSLCTWSTLPAVELKEAVSTMVFDLAASKLLGLEPSRSKILRKSFFDFVRGLISFPLYLPGTAYYSCMQGRRRAMVVLEQVLEERKQSTGLQRGGEAQQHGDFLDYVIQEITKEKPVMTEKMALDLMFVLLFASFHTTSLALTLAVKLLADHPLVLEELTVEHETILKDREAGSELDRITWKEYKSMAFTSQVINETVRLANIAPVIFRKALKDIRFNGYTIPAGWGVMVCPPAVHLNPYIYPDPLTFIPSRFKDKPEINRGSKHFMAFGGGLRFCVGADFSKLQLAIFLHFLVTKYRWIPLGASRVVRTPGLEFPDGYRIKVIQRH

SEQ ID NO: 3944 - DNA, 1476 bp, Populus balsamifera subsp. trichocarpa
  misc_feature (1)..(1476): useful for making plants with increased salt and oxidative stress resistance as described in USSN 12/922,143
  misc_feature (1)..(1476): Ceres ANNOT ID no.1536422
atgagagaaatttattcggcaacacttatgatctcgtccatcttattcatcgtttttcttgtacaattgcttgtatgcaagaagaagagcaaggaaaagacatcgtacaaattgccaccaggtagaagaggctggccattgattggtgatagcttcaactggttcaatgctgttgctggttctcatccccctcaatttgttcaccaacaagtcaataggtttggtaagatattctcatgcagtttgttcggaaaatgggctgtggtatcagcagacccgacctttaaccggtttataatgcaaaatgaaggcaaattgtttcaatcaagttatccaaaatcttttagagatttggttgggaaaaatggggtgatcacagtccacggagagcaacaacgaaaacttcatggaattgcatctaatatgatgcgtctagagaagctcaagttccatttcttggataatattcaattgattatgcttcaaactttgaacaaacttgacaacaaccaagtcattcttctccaagatgtttgcagaaaggcgagtagtgctctagtagctattaatctgatggtgaatcaactacttggggcatcaagtgagacagaaattaacgagatggctcacttcttctctgactttgtcgatggttgtctatctcttcccataaatattcctggttttgcctaccacactgccatgaaggcaagggagaaaattataagaaagataaacaagacaatagagaagcacgggcaagaagagtcatcagaaggtagtaatggggtgcttggaaggcttttagaggaagaaagtttgcctgataatgcagtagcagactttattatcaatctcctttttgctgggaatgaaacaacagctaaaaccatgctttttgctgtttatttcctcactcggtgtccaaaagcaatgcagcaactactggatgaacaagatagtataaggagtaattctagtggagagggaatgctaacatggcaagattacaaagcaatgtcttttactcagtgtgttattgatgaaacgcttcgactcggggggattgcaatatggctaatgagggaggccaagcaagatgtggtataccaagattatgtaattccgaaagggtgctttgtggttccatttctttcagcggttcacttggatgaaaatttgtacaagggagctagcaccttccatccttggagatggatggagcctgaaaatcaagaaaagagaaattggagaagtagcccattctactgtccctttggaggaggtgctcggttttgtccaggagcagagttgtctcgtctccaaattgctatctttcttcactactttgttactacatttacatggacgcagctcaaggaagacaggatgtccttctttccatcagctcgcttggttaatggtttccaaattcgtttgacaagccgccatcatctcgactcagaatcgttgtaa

SEQ ID NO: 3945 - protein, 491 aa, Populus balsamifera subsp. trichocarpa
  misc_feature (1)..(491): useful for making plants with increased salt and oxidative stress resistance as described in USSN 12/922,143
  misc_feature (1)..(491): Ceres ANNOT ID no.1536422
  misc_feature (1)..(491): Bit score of 450.8 for HMM based on sequences of FIGURE 7 of USSN 12/922,143.
  misc_feature (270)..(480): Pfam Name: p450 Pfam Description: Cytochrome P450
  misc_feature (1)..(491): Functional Homolog Of Ceres SEEDLINE ID no. ME06336
MREIYSATLMISSILFIVFLVQLLVCKKKSKEKTSYKLPPGRRGWPLIGDSFNWFNAVAGSHPPQFVHQQVNRFGKIFSCSLFGKWAVVSADPTFNRFIMQNEGKLFQSSYPKSFRDLVGKNGVITVHGEQQRKLHGIASNMMRLEKLKFHFLDNIQLIMLQTLNKLDNNQVILLQDVCRKASSALVAINLMVNQLLGASSETEINEMAHFFSDFVDGCLSLPINIPGFAYHTAMKAREKIIRKINKTIEKHGQEESSEGSNGVLGRLLEEESLPDNAVADFIINLLFAGNETTAKTMLFAVYFLTRCPKAMQQLLDEQDSIRSNSSGEGMLTWQDYKAMSFTQCVIDETLRLGGIAIWLMREAKQDVVYQDYVIPKGCFVVPFLSAVHLDENLYKGASTFHPWRWMEPENQEKRNWRSSPFYCPFGGGARFCPGAELSRLQIAIFLHYFVTTFTWTQLKEDRMSFFPSARLVNGFQIRLTSRHHLDSESL

SEQ ID NO: 3946 - protein, 464 aa, Arabidopsis thaliana
  misc_feature (1)..(464): useful for making plants with increased salt and oxidative stress resistance as described in USSN 12/922,143
  misc_feature (1)..(464): Public GI ID no.9294019
  misc_feature (1)..(464): Bit score of 616.8 for HMM based on sequences of FIGURE 7 of USSN 12/922,143.
  misc_feature (356)..(464): Pfam Name: p450 Pfam Description: Cytochrome P450
  misc_feature (1)..(464): Functional Homolog Of Ceres SEEDLINE ID no. ME06336
MDTSSSLLFFSFFFFIIIVIFNKINGLRSSPASKKKLNDHHVTSQSHGPKFPHGSLGWPVIGETIEFVSSAYSDRPESFMDKRRLMYGRVFKSHIFGTATIVSTDAEVNRAVLQSDSTAFVPFYPKTVRELMGKSSILLINGSLHRRFHGLVGSFLKSPLLKAQIVRDMHKFLSESMDLWSEDQPVLLQDVSKTVAFKVLAKALISVEKGEDLEELKREFENFISGLMSLPINFPGTQLHRSLQAKKNMVKQVERIIEGKIRKTKNKEEDDVIAKDVVDVLLKDSSEHLTHNLIANNMIDMMIPGHDSVPVLITLAVKFLSDSPAALNLLTEENMKLKSLKELTGEPLYWNDYLSLPFTQKVITETLRMGNVIIGVMRKAMKDVEIKGYVIPKGWCFLAYLRSVHLDKLYYESPYKFNPWRWQERDMNTSSFSPFGGGQRLCPGLDLARLETSVFLHHLVTRFR

SEQ ID NO: 3947 - protein, 482 aa, Oryza sativa
  misc_feature (1)..(482): useful for making plants with increased salt and oxidative stress resistance as described in USSN 12/922,143
  misc_feature (1)..(482): Public GI ID no.116310272
  misc_feature (1)..(482): Bit score of 398.2 for HMM based on sequences of FIGURE 7 of USSN 12/922,143.
  misc_feature (288)..(479): Pfam Name: p450 Pfam Description: Cytochrome P450
  misc_feature (1)..(482): Functional Homolog Of Ceres SEEDLINE ID no. ME06336
MEKSELLLGSYSYAALCGVTLIIGWLAHWIYKWMNPPCIGRLPPGSMGFPIIGETFQFFRASPSIDMPSYYKQRLERYGPLFKTSLVGRPVIISLDPEVNRFIFQQEGKLFQSWYPETAINIFGKKSLTTYNGTIHKFIRGVAAKLFGLENLKESLLPELENSMRESFASWTGKPSVEVQDGVSDMIFDLVAKKLIGLDVTNSRELRKNFQDFFQGMVSFPIYFPGTSFYRSMQGRRNVRNTLTDIMKERLSAPGKKYGDLVDLIVEELQSEKPMIDENFAIDALAALLFTSFATLSSTLTVAFKYLTDNPKVVEELKEEHGTILKKREGVNSGFTWEEYRSLKFSTQVMNEITRISNVTPGVFRKTLTDVQVKGYTIPSGWLVMISPMAVHLNPKLFEDPLKFDPWRWREEKRSSMLKNYMPFGGGVRLCLGAEFSKLFIALFLHILVTEYSWTEIEGGEVLRISEIMFPQGYHIQLVPQT

SEQ ID NO: 3948 - protein, 482 aa, Oryza sativa subsp. japonica
  misc_feature (1)..(482): useful for making plants with increased salt and oxidative stress resistance as described in USSN 12/922,143
  misc_feature (1)..(482): Public GI ID no.115460000
  misc_feature (1)..(482): Bit score of 398.0 for HMM based on sequences of FIGURE 7 of USSN 12/922,143.
  misc_feature (288)..(479): Pfam Name: p450 Pfam Description: Cytochrome P450
  misc_feature (1)..(482): Functional Homolog Of Ceres SEEDLINE ID no. ME06336
MEKSELLLGSYSYAALCGVTLIIGWLAHWVYKWMNPPCIGRLPPGSMGFPIIGETFQFFRASPSIDMPSYYKQRLERYGPLFKTSLVGRPVIISLDPEVNRFIFQQEGKLFQSWYPETAINIFGKKSLTTYNGTIHKFIRGVAAKLFGLENLKESLLPELENSMRESFASWTGKPSVEVQDGVSDMIFDLVAKKLIGLDVTNSRELRKNFQDFFQGMVSFPIYFPGTSFYRSMQGRRNVRNTLTDIMKERLSAPGKKYGDLVDLIVEELQSEKPMIDENFAIDALAALLFTSFATLSSTLTVAFKYLTDNPKVVEELKEEHGTILKKREGVNSGFTWEEYRSLKFSTQVMNEITRISNVTPGVFRKTLTDVQVKGYTIPSGWLVMISPMAVHLNPKLFEDPLKFDPWRWREEKRSSMLKNYMPFGGGVRLCLGAEFSKLFIALFLHILVTEYSWTEIEGGEVLRISEIMFPQGYHIQLVPQT

SEQ ID NO: 3949 - protein, 464 aa, Solanum lycopersicum
  misc_feature (1)..(464): useful for making plants with increased salt and oxidative stress resistance as described in USSN 12/922,143
  misc_feature (1)..(464): Public GI ID no.5921933
  misc_feature (1)..(464): Bit score of 406.5 for HMM based on sequences of FIGURE 7 of USSN 12/922,143.
  misc_feature (211)..(461): Pfam Name: p450 Pfam Description: Cytochrome P450
  misc_feature (1)..(464): Functional Homolog Of Ceres SEEDLINE ID no. ME06336
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYLMNEEATRFKLTDDEMIDLIITILYSGYETVSTTSMMAVKYLHDHPKVLEELRKEHMAIREKKKPEDPIDYNDYRSMRFTRAVILETSRLATIVNGVLRKTTQDMEINGYIIPKGWRIYVYTRELNYDPRLYPDPYSFNPWRWMDKSLEHQNSFLVFGGGTRQCPGKELGVAEISTFLHYFVTKYRWEEIGGDKLMKFPRVEAPNGLRIRVSAH

SEQ ID NO: 3950 - protein, 490 aa, Oryza sativa subsp. indica
  misc_feature (1)..(490): useful for making plants with increased salt and oxidative stress resistance as described in USSN 12/922,143
  misc_feature (1)..(490): Public GI ID no.125549395
  misc_feature (1)..(490): Bit score of 407.4 for HMM based on sequences of FIGURE 7 of USSN 12/922,143.
  misc_feature (240)..(486): Pfam Name: p450 Pfam Description: Cytochrome P450
  misc_feature (1)..(490): Functional Homolog Of Ceres SEEDLINE ID no. ME06336
MYAYVGLVGAAAALVLLLRHQARRWRNPRCGGQLPPGSMGLPLVGETFQFFSSDASLDIPPFIRHRLASLGCKFRYGPIFKTSLVGHPVVVSADEELNHMVFQQEGQLFQSWYPDSFVEILGKDNVGEQQGAMFRYLKNMVLRYFGPESLKEGIIRDVERAVSSSLCTWSTLPAVELKEAVSTMVFDLAASKLLGLEPSRSKILRKSFFDFVRGLISFPLYLPGTAYYSCMQGRRRAMVVLEQVLEERKQSTGLQRGGEAQQHGDFLDYVIQEITKEKPVMTEKMALDLMFVLLFASFHTTSLALTLAVKLLADHPLVLEELTVEHETILKDREAGSELDRITWKEYKSMAFTSQVINETVRLANIAPVIFRKALKDIRFNGYTIPAGWGVMVCPPAVHLNPYIYPDPLTFIPSRFKDKPEINRGSKHFMAFGGGLRFCVGADFSKLQLAIFLHFLVTKYRWIPLGASRVVRTPGLEFPDGYRIKVIQRH

SEQ ID NO: 3951 - DNA, 1833 bp, Zea mays
  misc_feature (1)..(1833): useful for making plants with increased salt and oxidative stress resistance as described in USSN 12/922,143
  misc_feature (1)..(1833): Ceres CLONE ID no.460186
gcaaccaaagcacacccctcctccttgctctgccgtgctcggagttgggagttggagcaccaccaccaccactcttcccctctcctctccctcctcgctcgtcctgttggaagcagcacacacacgagagagaaagagagacacaaggagatggcgctgctgttgctcctgctggccgtgctcggcgtggtgctggcgagcagcctgctgctgcggtggaacgagctgcggtacagccgccgccggggcctgccgccgggcacaatggggtggccgctcttcggcgagaccaccgagttcctcaagcaggggcctagcttcatgaagcagaggaggctcaggtacgggagcctgttccggacgcacatcctgggctgccccacggtggtgtgcatggagccggagctgaaccggcgggcgctggccagcgagggcgccggcttcgtcccgggctacccgcagtccatgctcgacatcctggggcccaacaacatcgccgccgtgcacggcccgctccaccgcgccatgcggggcgccatgctcgcgctcacgcggccacacatgatccgcgccgcgctcctccccaagatcgacgccttcatgcgcgcccacctccacggctgggccggacgccgcgtcgacatccaggagatgaccaaggagatggctttgctctcggctctcaggcagatcgctggcatctctgcgggcccacactccgacgccctaaaggcagagctgtacacccttgtacttggcaccttctccctgccaatcaacgtcccaggaaccaactacagcaaagggctccaggcaaggaagaagctcgtggcaatgctgcggcagatgatcgctgaccggaggtcctctggctgcgcccgagacgacatgctggacgcgctgctcagcggcaacgagggtaccagggcgaagctcagcgacgaccagatcatcgaccttctcatcaccctcatatactctgggtacgagactgtgtcgaccacctcgatgatggcggtgaagtacctgtcggacaaccccaaagctctcggacagatcaggaaagagcaccttgacatcaggaaggctaagtcaccggaggatccccttgactggaacgactacaagtccatgaccttcaccaaagctgtcatttatgagactctaaggctagctacagtagtcaacgggctgctgaggaaaactacccatgacgtagaaatgaatgggtatgttattccaaaaggctggagaatttatgtatacacaagggagataaactacgacccgttcctgtacccggaacccatggttttcaacccatggagatggatggagacgaacctggaatcacatccgcacttcatgctgttcggaggaggtgcccgcatgtgcccagggaaggaagtaggaacagttgaaatcgcaacgttccttcactatttcgtgacgcgttacagatgggaggaggagggaaacaacacaatatcgaagttccccagagtggcggctcccaatgggctacatatccgagttcaagattactgaacttcgtgaggcgttttgtgaagtttaggtagggattcagacagatagaaataacccatgcgatgctgatgctgctggcctcttcgaaaggactagaacagccattagtgcctgtaaaatgtgtccatgccgatagtaatgttattatagggaggatataggtatcataggtttattagaaatttgatgtagaaagccaacagatgctcctgtattcttttgctccatcaaaacagaggtatcatttggcttctatgcttttgaatcgaacatggtacagaaccc

SEQ ID NO: 3952 - protein, 465 aa, Zea mays
  misc_feature (1)..(465): useful for making plants with increased salt and oxidative stress resistance as described in USSN 12/922,143
  misc_feature (1)..(465): Ceres CLONE ID no.460186
  misc_feature (1)..(465): Bit score of 412.5 for HMM based on sequences of FIGURE 7 of USSN 12/922,143.
  misc_feature (211)..(461): Pfam Name: p450 Pfam Description: Cytochrome P450
  misc_feature (1)..(465): Functional Homolog Of Ceres SEEDLINE ID no. ME06336
MALLLLLLAVLGVVLASSLLLRWNELRYSRRRGLPPGTMGWPLFGETTEFLKQGPSFMKQRRLRYGSLFRTHILGCPTVVCMEPELNRRALASEGAGFVPGYPQSMLDILGPNNIAAVHGPLHRAMRGAMLALTRPHMIRAALLPKIDAFMRAHLHGWAGRRVDIQEMTKEMALLSALRQIAGISAGPHSDALKAELYTLVLGTFSLPINVPGTNYSKGLQARKKLVAMLRQMIADRRSSGCARDDMLDALLSGNEGTRAKLSDDQIIDLLITLIYSGYETVSTTSMMAVKYLSDNPKALGQIRKEHLDIRKAKSPEDPLDWNDYKSMTFTKAVIYETLRLATVVNGLLRKTTHDVEMNGYVIPKGWRIYVYTREINYDPFLYPEPMVFNPWRWMETNLESHPHFMLFGGGARMCPGKEVGTVEIATFLHYFVTRYRWEEEGNNTISKFPRVAAPNGLHIRVQDY

SEQ ID NO: 3953 - DNA, 2095 bp, Triticum aestivum
  misc_feature (1)..(2095): useful for making plants with increased salt and oxidative stress resistance as described in USSN 12/922,143
  misc_feature (1)..(2095): Ceres CLONE ID no.570049
gcccactagcactggagtattttggtgccttgcgtgtaaaatttctggtgctcccgtcttcttgatcccctccctccatggtcaagacctcaccttggaatggggaccctcatcggaaaagtaatggtcgtccatttttacaacgaggggtggataatcttctcctccttctcctcctccctgtataaaagggcctcctcctctgcccaactcatccagagcaacacttgttgccaagacagacaccagtctgctctgccctgcctcttgaaccaaaacagagcatccaagaggaggcagagagaggtagaagaagaagtagaagatggcgctcctcctccttgtgctggtcggcgttgtggtcggcgtggtgctggcgagcagcctgctgctgcgctggaacgaggtcaggtacggcaacggcaggaggaaggatggcgatggctgcttgccgccggggacaatgggctggccgctgttcggcgagaccaccgagttcctcaagcagggccccagcttcatgaagcagaggaggctcaggtacgggaggctgttccggacgcacatcctggggtgccccacggtggtgtgcatggacccggagctcaaccgccgcatgctgctgcagggcgagtccggcggcctcgtccccggctacccgcagtccatgctcgacatcctcggccgcaacaacatcgccgccgtgcacggcccgctccaccgcctcatgcgcggcgccatgctcggcctcgtccgccccgccgcgctccgcaccagcctcctccccaagatcgacgccttcatgcgcgaccacctccatggatgggcaggcagtgtcgtcgacgtccaggccaagaccaaggagatggccttgctgtccgcactccagcagatcgccggcatcacggctggcccactctctgacgccctcaaaacagagctatgcagcctggtgctcggcaccatctcgttgccgatcaaccttccgggaaccagctactaccagggcttccaggcaaggacgaagcttgtgtccatgctagagcagatgatcgcggagcggcggtcctctggtgatgctcacgatgacatgctggatgctctcttgagaagcggcgacgatgggacccgggagaaactcactgatgagcagatcatcgacttgctcatcgccctcatctactctggatacgagacgatgtcgaccacttcgatgatggctgtcaagtacctgtcggaccacccgcgagctcttgatgaactcaggagagagcatcttgatatcaggaaggggaaatcgccggaggaagccatcagttatgaagatttgaagtccatggccttcactcgagctgtcatttctgagacactaagattagctacagtcgtcaatgggctcctgaggaaaacaactcaggatgtggaaatgaatgggtatgtcattccaaaagggtggagaatctatgtttacaccagggagataaactacgacccattcatgtatcctgacccgatgactttcaatccgtggaggtggctggagaagaacatggaatcgcacccgcacttcatgttgttcggaggaggcggccggatgtgccccggaaaggaggtgggcacggccgagatcgcgacttttctccactatttcgtgacccgatacagatggcaggaagaaggcaagaacacgatcttgaaattcccccgggtggaggctcccaacgggttacatatccgagttcaagattactgattttgcaacatacattttgcagagtttaggtagatagggcccagactgaggcgacgagagtgcgattctgcaccgacggaaagattagatcagccttgtaagaaaataggaaacataggtatagtgtaggtattataggtttagtaggcaattgacgtagaaggccacaagaggcaactatgttcttccttgtgatcaattacatatgcatgataagcatcacaaaatatatgtgatatgtctggtgacttgaatctgataagcagttatacatatatgtgtatatctggtgccttgaatcgatgataagcagcaccatatatacgagatatgaggtgactt

SEQ ID NO: 3954 - protein, 475 aa, Triticum aestivum
  misc_feature (1)..(475): useful for making plants with increased salt and oxidative stress resistance as described in USSN 12/922,143
  misc_feature (1)..(475): Ceres CLONE ID no.570049
  misc_feature (1)..(475): Bit score of 396.4 for HMM based on sequences of FIGURE 7 of USSN 12/922,143.
  misc_feature (223)..(471): Pfam Name: p450 Pfam Description: Cytochrome P450
  misc_feature (1)..(475): Functional Homolog Of Ceres SEEDLINE ID no. ME06336
MALLLLVLVGVVVGVVLASSLLLRWNEVRYGNGRRKDGDGCLPPGTMGWPLFGETTEFLKQGPSFMKQRRLRYGRLFRTHILGCPTVVCMDPELNRRMLLQGESGGLVPGYPQSMLDILGRNNIAAVHGPLHRLMRGAMLGLVRPAALRTSLLPKIDAFMRDHLHGWAGSVVDVQAKTKEMALLSALQQIAGITAGPLSDALKTELCSLVLGTISLPINLPGTSYYQGFQARTKLVSMLEQMIAERRSSGDAHDDMLDALLRSGDDGTREKLTDEQIIDLLIALIYSGYETMSTTSMMAVKYLSDHPRALDELRREHLDIRKGKSPEEAISYEDLKSMAFTRAVISETLRLATVVNGLLRKTTQDVEMNGYVIPKGWRIYVYTREINYDPFMYPDPMTFNPWRWLEKNMESHPHFMLFGGGGRMCPGKEVGTAEIATFLHYFVTRYRWQEEGKNTILKFPRVEAPNGLHIRVQDY

SEQ ID NO: 3955 - protein, 492 aa, Oryza sativa subsp. japonica
  misc_feature (1)..(492): useful for making plants with increased salt and oxidative stress resistance as described in USSN 12/922,143
  misc_feature (1)..(492): Public GI ID no.38567916
  misc_feature (1)..(492): Bit score of 410.0 for HMM based on sequences of FIGURE 7 of USSN 12/922,143.
  misc_feature (242)..(488): Pfam Name: p450 Pfam Description: Cytochrome P450
  misc_feature (1)..(492): Functional Homolog Of Ceres SEEDLINE ID no. ME06336
MYAYVGLVGGAAALVLLLLLRHQARRWRNPRCGGQLPPGSMGLPLVGETFQFFSSDASLDIPPFIRHRLASLGCKFRYGPIFKTSLVGHPVVVSADEELNHMVFQQEGQLFQSWYPDSFVEILGKDNVGEQQGAMFRYLKNMVLRYFGPESLKEGIIRDVERAVSSSLCTWSTLPAVELKEAVSTMVFDLAASKLLGLEPSRSKILRKSFFDFVRGLISFPLYLPGTAYYSCMQGRRRAMVVLEQVLEERKQSTGLQRGGEAQQHGDFLDYVIQEITKEKPVMTEKMALDLMFVLLFASFHTTSLALTLAVKLLADHPLVLEELTVEHETILKDREAGSELDRITWKEYKSMAFTSQVINETVRLANIAPVIFRKALKDIRFNGYTIPAGWGVMVCPPAVHLNPYIYPDPLTFIPSRFKDKPEINRGSKHFMAFGGGLRFCVGADFSKLQLAIFLHFLVTKYRWIPLGASRVVRTPGLEFPDGYRIKVIQRH

SEQ ID NO: 3956 - DNA, 1599 bp, Glycine max
  misc_feature (1)..(1599): useful for making plants with increased salt and oxidative stress resistance as described in USSN 12/922,143
  misc_feature (1)..(1599): Ceres CLONE ID no.624504
  misc_feature (1143)..(1143): s is g or c
  misc_feature (1215)..(1215): y is t/u or c
  misc_feature (1286)..(1286): y is t/u or c
  misc_feature (1433)..(1433): m is a or c
  misc_feature (1582)..(1582): y is t/u or c
  misc_feature (1585)..(1585): y is t/u or c
aactacaacacaagagactgtaccttctttttgaagtctctgtgggttggggttttggagtgggagcaccaatggctttcttgatggcaattgtagtagtaggtgttgtcttggtgctctgtttttgctctgctctcttgaggtggaatgaagtaaggtacaggaagaaaggtttgcctcctggcacaatgggttggccactttttggggagacaactgagtttcttaagcagggtccaaacttcatgaaaacccagagagcaaggtatggcagttttttcaaatcccacatactgggttgtcctaccattgtttccatggatccagagcttaacagatacatcctaatgaatgaggcaaaagggcttgttcctggttaccctcaatccatgttagatatcttaggcaaatgcaacattgcagctgttcatggctccactcacaagtacatgagaggagcactgctttccatcattagccccaccttgatcagagatcagcttttgccaaaaattgatcagttcatgagagcccaccttagcaactggggtgacaaagtcatcaacattcaagagaaaaccaaagagatggccttcttatcatctctgaagcagattgctggcatggaatctggctcattatctgactcattcatggcagagttctttaagctagttctaggaaccctttctctccctattgatcttcctggcacaaattaccacagtggattccaggcaaggaagactatagtgaacattctgagtaagctcttagaggaaagaagagcatcacatgaaacctaccatgacatgcttggttgcttgatgggaagagatgaaagtagatacaaactaagtgatgaagaaatcattgatctagtgattacaatcatgtattctggctatgaaactgtttcaactacatcaatgatggcagtcaagtacctccatgaccatcccaaagctcttgaggaactcagaaaagaacatttggccataagagagaggaaaaagccagatgaaccacttgactgcaatgatctcaagtcaatgaggttcactcgcgcggtgatttttgagacctctagattggccacaatagttaatggggtcctaaggaaaaccactcaagacatggaastaaacggctatttgatccccaaaggatggagaatatatgtgtatacaagagagatcaattatgacccttttytatatcctgatccactaacattcaacccatggagatggatggacaagagtttagaatcaaagaactacttyttcatatttggaggaggcacccgacagtgtccaggaaaagagttgggaataaccgaaatttccactttcttacactactttgtaactagatacaggtgggaagaagtaggaggagataaagtaatgaaatttcctagagttgaggcmcctaatggactgcacataagggtgacatcttactaactaggccgtgactgtatgtacagtaatgagatgagatgtaacagattgtagggtatgtgtgtatgacaattatctaacaaatatatttagtaaaagaaagaaattaaattttyttyttcctcttcctttc

SEQ ID NO: 3957 - protein, 465 aa, Glycine max
  misc_feature (1)..(465): useful for making plants with increased salt and oxidative stress resistance as described in USSN 12/922,143
  misc_feature (1)..(465): Ceres CLONE ID no.624504
  misc_feature (1)..(465): Bit score of 418.2 for HMM based on sequences of FIGURE 7 of USSN 12/922,143.
  misc_feature (212)..(461): Pfam Name: p450 Pfam Description: Cytochrome P450
  misc_feature (1)..(465): Functional Homolog Of Ceres SEEDLINE ID no. ME06336
  misc_feature (358)..(358): Xaa is any aa, unknown or other
  misc_feature (382)..(382): Xaa is any aa, unknown or other
  misc_feature (405)..(405): Xaa is any aa, unknown or other
  misc_feature (454)..(454): Xaa is any aa, unknown or other
MAFLMAIVVVGVVLVLCFCSALLRWNEVRYRKKGLPPGTMGWPLFGETTEFLKQGPNFMKTQRARYGSFFKSHILGCPTIVSMDPELNRYILMNEAKGLVPGYPQSMLDILGKCNIAAVHGSTHKYMRGALLSIISPTLIRDQLLPKIDQFMRAHLSNWGDKVINIQEKTKEMAFLSSLKQIAGMESGSLSDSFMAEFFKLVLGTLSLPIDLPGTNYHSGFQARKTIVNILSKLLEERRASHETYHDMLGCLMGRDESRYKLSDEEIIDLVITIMYSGYETVSTTSMMAVKYLHDHPKALEELRKEHLAIRERKKPDEPLDCNDLKSMRFTRAVIFETSRLATIVNGVLRKTTQDMEXNGYLIPKGWRIYVYTREINYDPFXYPDPLTFNPWRWMDKSLESKNYXFIFGGGTRQCPGKELGITEISTFLHYFVTRYRWEEVGGDKVMKFPRVEXPNGLHIRVTSY

SEQ ID NO: 3958 - DNA, 1620 bp, Populus balsamifera subsp. trichocarpa
  misc_feature (1)..(1620): useful for making plants with increased salt and oxidative stress resistance as described in USSN 12/922,143
  misc_feature (1)..(1620): Ceres ANNOT ID no.1482951
atgagagaaatttattcggcaacacttatgatctcgtccatcttattcatcgtttttcttgtacaattgcttgtatgcaagaagaagagcaaggaaaagacatcgtacaaattgccaccaggtagaagaggctggccattgattggtgatagcttcaactggttcaatgctgttgctggttctcatccccctcaatttgttcaccaacaagtcaataggtttggtaagatattctcatgcagtttgttcggaaaatgggctgtggtatcagcagacccgacctttaaccggtttataatgcaaaatgaaggcaaattgtttcaatcaagttatccaaaatcttttagagatttggttgggaaaaatggggtgatcacagtccacggagagcaacaacgaaaacttcatggaattgcatctaatatgatgcgtctagagaagctcaagttccatttcttggataatattcaattgattatgcttcaaactttgaacaaacttgacaacaaccaagtcattcttctccaagatgtttgcagaaaggcgagtagtgctctagtagctattaatctgatggtgaatcaactacttggggcatcaagtgagacagaaattaacgagatggctcacttcttctctgactttgtcgatggttgtctatctcttcccataaatattcctggttttgcctaccacactgccatgaaggcaagggagaaaattataagaaagataaacaagacaatagagaagcacgggcaagaagagtcatcagaaggtagtaatggggtgcttggaaggcttttagaggaagaaagtttgcctgataatgcagtagcagactttattatcaatctcctttttgctgggaatgaaacaacagctaaaaccatgctttttgctgtttatttcctcactcggtgtccaaaagcaatgcagcaactactggatgaacaagatagtataaggagtaattctagtggagagggaatgctaacatggcaagattacaaagcaatgtcttttactcagtgtgttattgatgaaacgcttcgactcggggggattgcaatatggctaatgagggaggccaagcaagatgtggtataccaagattatgtaattccgaaagggtgctttgtggttccatttctttcagcggttcacttggatgaaaatttgtacaagggagctagcaccttccatccttggagatggatggagcctgaaaatcaagaaaagagaaattggagaagtagcccattctactgtccctttggaggaggtgctcggttttgtccaggagcagagttgtctcgtctccaaattgctatctttcttcactactttgttactacatttaccttaggtagattaggagaacaaaaacacagcagctatagacctccacaaacgcagttgcaatccctagaagcaactctcttcacaacagagaaaatcacagcagcctctattgaagaatcagatctttcccgtgcaaagaaaaaacacgagcgcagcagtagcatctccgacagcagccctcaatcacgtcaacagagttctcccttccacaacattagaaaaacacgcgtagcagcagcaacacatatgctctga

SEQ ID NO: 3959 - protein, 530 aa, Populus balsamifera subsp. trichocarpa
  misc_feature (1)..(530): useful for making plants with increased salt and oxidative stress resistance as described in USSN 12/922,143
  misc_feature (1)..(530): Ceres ANNOT ID no.1482951
  misc_feature (1)..(530): Bit score of 396.2 for HMM based on sequences of FIGURE 7 of USSN 12/922,143.
  misc_feature (261)..(447): Pfam Name: p450 Pfam Description: Cytochrome P450
  misc_feature (1)..(530): Functional Homolog Of Ceres SEEDLINE ID no. ME06336
MISSILFIVFLVQLLVCKKKSKEKTSYKLPPGRRGWPLIGDSFNWFNAVAGSHPPQFVHQQVNRFGKIFSCSLFGKWAVVSADPTFNRFIMQNEGKLFQSSYPKSFRDLVGKNGVITVHGEQQRKLHGIASNMMRLEKLKFHFLDNIQLIMLQTLNKLDNNQVILLQDVCRKASSALVAINLMVNQLLGASSETEINEMAHFFSDFVDGCLSLPINIPGFAYHTAMKAREKIIRKINKTIEKHGQEESSEGSNGVLGRLLEEESLPDNAVADFIINLLFAGNETTAKTMLFAVYFLTRCPKAMQQLLDEQDSIRSNSSGEGMLTWQDYKAMSFTQCVIDETLRLGGIAIWLMREAKQDVVYQDYVIPKGCFVVPFLSAVHLDENLYKGASTFHPWRWMEPENQEKRNWRSSPFYCPFGGGARFCPGAELSRLQIAIFLHYFVTTFTLGRLGEQKHSSYRPPQTQLQSLEATLFTTEKITAASIEESDLSRAKKKHERSSSISDSSPQSRQQSSPFHNIRKTRVAAATHML

SEQ ID NO: 3960 - protein, 466 aa, Phaseolus vulgaris
  misc_feature (1)..(466): useful for making plants with increased salt and oxidative stress resistance as described in USSN 12/922,143
  misc_feature (1)..(466): Public GI ID no.68565030
  misc_feature (1)..(466): Bit score of 387.6 for HMM based on sequences of FIGURE 7 of USSN 12/922,143.
  misc_feature (211)..(460): Pfam Name: p450 Pfam Description: Cytochrome P450
  misc_feature (1)..(466): Functional Homolog Of Ceres SEEDLINE ID no. ME06336
MALFMAILGVLVLLLCFCSALLKWNEVRFRRKGLPPGAMGWPVFGETTEFLKQGPNFMKNKRARYGSFFKSHILGCPTIVSMDPELNRFILMNEAKGLVPGYPQSMLDILGTRNIAAVHGSTHKYMRGALLSIISPTLIRDQLLPKIDEFMRTHLMDWDNKVINIQEKTKEMAFLSSLKQIAGMESSSIAQPFMTEFFKLVLGTLSLPINLPRTNYRGGLQARKSIISILSQLLEERKASQDVHVDMLGCLMKKDENRYKLSDEEIIDLVITIMYSGYETVSTTSMMAVKYLHDHPKVLEEIRKEHFAIRERKKPEDPIDCNDLKSMRFTRAVIFETSRLATIVNGVLRKTTHDMELNGYLIPKGWRIYVYTREINYDPFLYHDPLTFNPWRWLGNSLESQSHFLIFGGGTRQCPGKELGIAEISTFLHYFVTRYRWEEVGGDKLMKFPRVVAPNGLHIRVSSFSN

SEQ ID NO: 3961 - protein, 467 aa, Solanum lycopersicum
  misc_feature (1)..(467): useful for making plants with increased salt and oxidative stress resistance as described in USSN 12/922,143
  misc_feature (1)..(467): Public GI ID no.68565099
  misc_feature (1)..(467): Bit score of 380.4 for HMM based on sequences of FIGURE 7 of USSN 12/922,143.
  misc_feature (225)..(453): Pfam Name: p450 Pfam Description: Cytochrome P450
  misc_feature (1)..(467): Functional Homolog Of Ceres SEEDLINE ID no. ME06336
MAIFLIIFVVFFGFCILSTPLFRWIDIVYNKKNLPPGTMGWPIFGETREFLNQGPNFMKNQRARYGNFFKSHILGCPTVVSMDAGLNVYILNNEAKGLIPGYPQSMLDILGKCNIAAVHGATHKYIRGALLSLINPTMIKDHILPKIDKFMRSHLSGWDNCNVIDIQQMTKEMAFFSSLDQIGGFATSSSIAQEFRAGFLNIALGTISLPINFPTTNYYRGLQGRKTIVKLLRKIIEDRRGSKKIQQDMLGLMMNEEAKNRYTLSDEELIDQIITIMYSGFETVSTTSMMAVKYLHDHPKALEEIRKEHFAIREKKSLEDPIDYNDFKAMRFTRAVIYETLRLATIVNGVLRKTTQDMELNGYMIPKGWRIYVYTRELNYDPLIYPDPYTFNPWRWLENNLDHQSSFLMFGGGTRLCPGKELGVAEISTFLHYFVTRYRWEEVGGNKLMKFPRVEALNGLWIKVSAY

SEQ ID NO: 3962 - DNA, 1749 bp, Triticum aestivum
  misc_feature (1)..(1749): useful for making plants with increased salt and oxidative stress resistance as described in USSN 12/922,143
  misc_feature (1)..(1749): Ceres CLONE ID no.756140
agagcaatacttgttgccaacacagacaccgctctgcctcttgaacccaagcagagcatcaaagaaaccagaggaggcggaggcagaggaagaagatggcgctcctccttgtgcttgtcggcgttgtggtcggcgtggtgctcgcgagcagcctgctgctgcggtggaacgaggtcaggtacggccggaggaaggagggccgcttgccgccggggacaatggggtggccgctcttcggcgagaccaccgagttcctcaagcagggcccgagcttcatgaagcagaggaggctcaggtacgggaggctgttccggacgcacatcctgggttgccccacggtggtgtgcatggacccggagctcaaccgccggatgctgctgcagggcgaggccggcggcctggtgcccggctacccgcagtccatgctcgacatcctcggccgcaacaatatcgccgccgtgcacggccagctgcaccgcgtcatgcgtggtgccatggtcggcctcgtccgccccgccgcgctccggcaaagcctcctccccaagatcgacgccttcatgcgcgaccacctctgcggctgggccggcaccgttgtcgacgtccaggccaagaccaaggagatggccttgctgtctgcactcaggcagatcgccggcgtcacggccggcccactctctgacgccctcaagacggagctgtacacgcttgtgctcggcaccatctccttgcccatcaacctcccagggaccagctactaccaaggctttcaggcaaggaagaagctcgtgtccattctagagcagatgatcgcggaacggcgatcctctggtgatgctcacgatgacatgttggatgctctcttgagaagcggcgatgacggcaccagggaaaagattagcgatgagcagatcattgacttgctcatcgccctcatctactctgggtacgagaccatgtcgacgacctcaatgatggctgtcaagtacctgtcagaacatccgcgggccctcgaagaacttaggagagagcatcttgatatcaggaagggaaaatcgccggacgaagccatcagctacgatgatgtcaagtccatgactttcactcgagctgccatttttgagacgctaagattagccacagttgtgaatggactgctgaggaaaactattaaggatgtagaaatgaatgggtatgtcattccaaaaggctggagaatctatgtttacacaagggagataaactacgatccgttcatgtatcctgacccgatgacctttaatccgtggagatggctggagaagaacatggaatcgcacccgcacttcatgttgttcggagggggcggccggatgtgccccgggaaggaggtgggaacggtggagatcacgactttcctccactatttcgtgacccgatacagatgggaggaagaaggcaagaacaccatcttgaaattcccccgggtggaagctcccaacgggctgcatatccgagttcaagattactgaactcttccaagaaacattttgcagagtttagatagatatgacaaagacaaagacgatgagagcgcgattctgcgccgatgaatagattagattagaaatttgatacctgtataaacataggaaaatagcgatagtatagatgttataggttcactaggtagccgggataataggcaacaacatgctcctgtgttcttttgttctaccaattccgaaatgaacaaaggcgtatgatgtgggt

SEQ ID NO: 3963 - protein, 470 aa, Triticum aestivum
  misc_feature (1)..(470): useful for making plants with increased salt and oxidative stress resistance as described in USSN 12/922,143
  misc_feature (1)..(470): Ceres CLONE ID no.756140
  misc_feature (1)..(470): Bit score of 401.8 for HMM based on sequences of FIGURE 7 of USSN 12/922,143.
  misc_feature (218)..(466): Pfam Name: p450 Pfam Description: Cytochrome P450
  misc_feature (1)..(470): Functional Homolog Of Ceres SEEDLINE ID no. ME06336
MALLLVLVGVVVGVVLASSLLLRWNEVRYGRRKEGRLPPGTMGWPLFGETTEFLKQGPSFMKQRRLRYGRLFRTHILGCPTVVCMDPELNRRMLLQGEAGGLVPGYPQSMLDILGRNNIAAVHGQLHRVMRGAMVGLVRPAALRQSLLPKIDAFMRDHLCGWAGTVVDVQAKTKEMALLSALRQIAGVTAGPLSDALKTELYTLVLGTISLPINLPGTSYYQGFQARKKLVSILEQMIAERRSSGDAHDDMLDALLRSGDDGTREKISDEQIIDLLIALIYSGYETMSTTSMMAVKYLSEHPRALEELRREHLDIRKGKSPDEAISYDDVKSMTFTRAAIFETLRLATVVNGLLRKTIKDVEMNGYVIPKGWRIYVYTREINYDPFMYPDPMTFNPWRWLEKNMESHPHFMLFGGGGRMCPGKEVGTVEITTFLHYFVTRYRWEEEGKNTILKFPRVEAPNGLHIRVQDY

SEQ ID NO: 3964 - DNA, 1692 bp, Populus balsamifera subsp. trichocarpa
  misc_feature (1)..(1692): useful for making plants with increased salt and oxidative stress resistance as described in USSN 12/922,143
  misc_feature (1)..(1692): Ceres ANNOT ID no.1457317
atggaacaaaagagtggagtgcttccaaagggaagctttggctggcctctgataggagaaactcttgacttcattgctgctggctacacttctcaacctgttagtttcatggagaaacgcagatcactgccaaaatgttcttttgaatacacatatgtgcctacaacaccttcaccagtaacaattaattaccttcaagccaatctaagctcacaatgccgacaagtttttcatggtctagaggccatagatagacatgccgattgccgaaggtacgggaaggtgttcaaaacacacatcctggggacacccatcatagtatccacggatccagcagtgaacaaagttgttttacaaaaccatggcaacatttttattcctgcttatcctaaatcagtcagggaaatatttggagaatattctatacttcaaaccaatggaactctacagaagaaggtccatgcacttattggtggtttcttgaggtcaccacagttcaaaactagaattaccaaagacattgagcaccatgtcaaactcaccttgacttcttggaaggacctgccccttctattcgtccaagaagaaacccaaaagttcacgttcaaagtcttggttaaagcattgctaagtcttgatccaagtgatgatttggattttcttaagagagaattcgatgaattcatcaaagggttgatatgtctgccgatcaaattaccaggaacaagattatacaaatccttaaaggctaaagagagaatattcaagctagtaaaaaagattgttgagcaaagaaaattgggcttggagaaatcagaagatcaagaacatcaaaatacaatccctaatgatgcggtggacgtgcttttacgtgacatttctggtgaacaaaatgacaagcaatctctatcgttggatttcatcatttcacatattattgagctgatgatccctggagaagaaaccgtgcctatgtccatgaccttagctgtcaaattcctcagtgactgccctgtcgctctagagctattaacggaagtgcatgaagacatgtccctgccatctctgaacttgacactagaagcaaagataagagcagaaaagtttgtactaagacaatggaatgttttaaaagaactgcctgaaataaacgaacgtgaactggctagctgctggttgaagcaggatttggaggagaacatgaaattgaagaggcagaagactgattctggtgatgattattgttggactgattacatgtccttgcaatttactcagaatgtgataaatgaaactcttagagtagcaaacataatcaatgcagtttggaggaaagctctcaaggatgtagagatcaaaggaattctgattcccgaaggatggtgtgtcctgacatctttcagctctgtacatatggatgaagaaaattatgaaaacccacatgagtttgatccatggagatgggagaaaacaggagcttctgttaagaacaattgctttacaccttttggaggtggacaaaggctatgccctggtctagaactatccaggcttgaaatctccatcttccttcaccatcttgtcacaacttacagatggattgctgaaaaggatgacattatttactttccaacagtgaagttaaagaaaaagctgcctatcagagtcacctccataggcaactcttcatga

SEQ ID NO: 3965 - protein, 563 aa, Populus balsamifera subsp. trichocarpa
  misc_feature (1)..(563): useful for making plants with increased salt and oxidative stress resistance as described in USSN 12/922,143
  misc_feature (1)..(563): Ceres ANNOT ID no.1457317
  misc_feature (1)..(563): Bit score of 501.9 for HMM based on sequences of FIGURE 7 of USSN 12/922,143.
  misc_feature (415)..(558): Pfam Name: p450 Pfam Description: Cytochrome P450
  misc_feature (1)..(563): Functional Homolog Of Ceres SEEDLINE ID no. ME06336
MEQKSGVLPKGSFGWPLIGETLDFIAAGYTSQPVSFMEKRRSLPKCSFEYTYVPTTPSPVTINYLQANLSSQCRQVFHGLEAIDRHADCRRYGKVFKTHILGTPIIVSTDPAVNKVVLQNHGNIFIPAYPKSVREIFGEYSILQTNGTLQKKVHALIGGFLRSPQFKTRITKDIEHHVKLTLTSWKDLPLLFVQEETQKFTFKVLVKALLSLDPSDDLDFLKREFDEFIKGLICLPIKLPGTRLYKSLKAKERIFKLVKKIVEQRKLGLEKSEDQEHQNTIPNDAVDVLLRDISGEQNDKQSLSLDFIISHIIELMIPGEETVPMSMTLAVKFLSDCPVALELLTEVHEDMSLPSLNLTLEAKIRAEKFVLRQWNVLKELPEINERELASCWLKQDLEENMKLKRQKTDSGDDYCWTDYMSLQFTQNVINETLRVANIINAVWRKALKDVEIKGILIPEGWCVLTSFSSVHMDEENYENPHEFDPWRWEKTGASVKNNCFTPFGGGQRLCPGLELSRLEISIFLHHLVTTYRWIAEKDDIIYFPTVKLKKKLPIRVTSIGNSS

SEQ ID NO: 3966 - protein, 512 aa, Arabidopsis thaliana
  misc_feature (1)..(512): useful for making plants with increased salt and oxidative stress resistance as described in USSN 12/922,143
  misc_feature (1)..(512): Public GI ID no.15219454
  misc_feature (1)..(512): Bit score of 461.1 for HMM based on sequences of FIGURE 7 of USSN 12/922,143.
  misc_feature (230)..(502): Pfam Name: p450 Pfam Description: Cytochrome P450
  misc_feature (1)..(512): Functional Homolog Of Ceres SEEDLINE ID no. ME06336
MAESAGESYRLLSVSSSTTFLAFIIIFLLAGIARRKRRAPHRLPPGSRGWPLIGDTFAWLNAVAGSHPSSFVEKQIKKFVSLLCSVLLLILKRPDNSGFNEIRYGRIFSCSLFGKWAVVSADPDFNRFIMQNEGKLFQSSYPKSFRDLVGKDGVITVHGDQQRRLHSIASSMMRHDQLKTHFLEVIPVVMLQTLSNFKDGEVVLLQDICRKVAIHLMVNQLLGVSSESEVDEMSQLFSDFVDGCLSVPIDLPGFTYNKAMKARKEIIRKINKTIEKRLQNKAASDTAGNGVLGRLLEEESLPNESMADFIINLLFAGNETTSKTMLFAVYFLTHCPKAMTQLLEEHDRLAGGMLTWQDYKTMDFTQCVIDETLRLGGIAIWLMREAKEDVSYQDYVIPKGCFVVPFLSAVHLDESYYKESLSFNPWRWLDPETQQKRNWRTSPFYCPFGGGTRFCPGAELARLQIALFLHYFITTYKWTQLKEDRISFFPSARLVNGFKIQLNRRDSDPPNQ

SEQ ID NO: 3967 - DNA, 1813 bp, Zea mays
  misc_feature (1)..(1813): useful for making plants with increased salt and oxidative stress resistance as described in USSN 12/922,143
  misc_feature (1)..(1813): Ceres CLONE ID no.240663
cccgtgatgttttaaatttcggatcctgtgttgcagctttgaagtgcatgaacgagacatgcagagccgcgtgacgtgagttctccccataccgcccgatctcggagatgtgcgcgtaccacatgaggctcaccggcggcgcggcctttgtgctccttatggttctcctcttgctgctgtatgcggtgcacaggtggaggaaccctcgatgcagcggccgcctgccgccgggctccatgggcctgccgctcgtcggagagacgctgcagttcttctcccctgaagcttccttggacgtcccgcgtttcgtccgacacagactgcaaaggtacggcccgatcttcaagacgagcctggtgggccacccggtcgtcgtctccgcggacgaggagctgaactacatggtgttccagcaggaggggcagctgttccagagctggtacccggactccttcgtggagatcctaggcagggacaacgtcggggagcagcagggcgccatgttcaagtacctcaagaacatggtgctccgctacttcggcccggagagcctcagggagtccatgctccgcgacgtcgagcacgccgtcagcagctcgctctgtacctggtcaaccttgccgtcggtcgagctgaaagaggccgtctccacgatggtgttcgatctttcagcgaacaagcttctcagcttggagccgtcgaggtccaagattctgaggaggagcttcttcgacttcgttcgagggctcatctcgttccctctgtatttgccaggaacagcatactactcatgcatgaagggccggcagagcgcaatggaggtgctgcaggaagtgctagcggagaggaagagactggtacaggtgcccggagcaggaggaggcgccatggaaacgatacgtcgccatggcggcgacttcttggacctcgtcatccaggaagtcacgaaggagaagccgctcgtgacggacagaatggcgctcgacctgatgttcgtgctcctgttcgccagcttccacacgacgtcgctagcgctcactctggctgtcaagctgcttgcagaccaccctcgcgtcctggaagagctcacggtggagcatgaagcgattctgaatgaacgtaacgcgcgccatggatctgatggaatcacatggatggagtacaagtctatgacgttcacatcccaggtcatcaacgagactgtccgattagccaatattgcgcctggcatcttcagaaaggcactgaaagatatacagttcagagggttcacaattccagcaggatggggagtgatggtctgtcctccagcagtgcacttgaacccagtcatttacccagatcccctcatctttaaccctacaaggttcaaggataaaccggagataaaccgtgggtcaagacacttcatggcattcggaggaggcctccgatcctgtgttggagcagacttcagcaagttgcaaatgtctattttcctccatttccttgtcactagatacaggtggagaagtcttgggggtggcaaggtagtccgaaatccggggctagaattccctgatggctaccacattcaaatacggcactggaattaattctgctaatactacagagtcaatctcgttgtgcattcaagccaagaaacggacggagggaaagaattactgttaggctctatttggatcttttgaattgaatttcattctaataattataattcaaacacagattaattagaataatataattttatgtgagatatatttttatagtactgttggtcaccatataaatttattataagcttatatcc

SEQ ID NO: 3968 - protein, 495 aa, Zea mays
  misc_feature (1)..(495): useful for making plants with increased salt and oxidative stress resistance as described in USSN 12/922,143
  misc_feature (1)..(495): Ceres CLONE ID no.240663
  misc_feature (1)..(495): Bit score of 399.4 for HMM based on sequences of FIGURE 7 of USSN 12/922,143.
  misc_feature (270)..(467): Pfam Name: p450 Pfam Description: Cytochrome P450
  misc_feature (1)..(495): Functional Homolog Of Ceres SEEDLINE ID no. ME06336
MCAYHMRLTGGAAFVLLMVLLLLLYAVHRWRNPRCSGRLPPGSMGLPLVGETLQFFSPEASLDVPRFVRHRLQRYGPIFKTSLVGHPVVVSADEELNYMVFQQEGQLFQSWYPDSFVEILGRDNVGEQQGAMFKYLKNMVLRYFGPESLRESMLRDVEHAVSSSLCTWSTLPSVELKEAVSTMVFDLSANKLLSLEPSRSKILRRSFFDFVRGLISFPLYLPGTAYYSCMKGRQSAMEVLQEVLAERKRLVQVPGAGGGAMETIRRHGGDFLDLVIQEVTKEKPLVTDRMALDLMFVLLFASFHTTSLALTLAVKLLADHPRVLEELTVEHEAILNERNARHGSDGITWMEYKSMTFTSQVINETVRLANIAPGIFRKALKDIQFRGFTIPAGWGVMVCPPAVHLNPVIYPDPLIFNPTRFKDKPEINRGSRHFMAFGGGLRSCVGADFSKLQMSIFLHFLVTRYRWRSLGGGKVVRNPGLEFPDGYHIQIRHWN

SEQ ID NO: 3969 - protein, 472 aa, Hordeum vulgare subsp. vulgare
  misc_feature (1)..(472): useful for making plants with increased salt and oxidative stress resistance as described in USSN 12/922,143
  misc_feature (1)..(472): Public GI ID no.110832074
  misc_feature (1)..(472): Bit score of 400.8 for HMM based on sequences of FIGURE 7 of USSN 12/922,143.
  misc_feature (220)..(468): Pfam Name: p450 Pfam Description: Cytochrome P450
  misc_feature (1)..(472): Functional Homolog Of Ceres SEEDLINE ID no. ME06336
MALLLLALVVVGVVASSLLLRWNEVRYGNGRRKHGDACLPPGTMGWPLFGETTEFLKQGPSFMKQRRLRYGRLFRTHILGCPTVVCMDPELNRRMLLQGEAGGRVPGYPQSMLDILGRNNIAAVHGPLHRVMRGAMLGLVRPAALRQSLLPKMDAFMRHHLAGWAGTVVDVQAKTKEMALLSALRQIAGITAGPLSDALQTELYTLVLGTISLPINLPGTSYYQGFQARTKLVSMLEQMIAERRSSGEAHDDMLDALLRSGDDGTREKISDEQIIDLLIALIYSGYETMSTTSMMAVKYLSEHPRALQELRREHLDIRKGKLPEEAIGYDDFKSMSFTRAVIFETLRLATVVNGLLRKTTQDVEMNGYVIPKGWRIYVYTREINYDPFMYPDPMTFNPWRWLEKNMESHPHFMLFGGGSRMCPGKEVGTAEIATFLHRFVTQYRWEEEGKNTILKFPRVEAPNGLHIRVQDY

SEQ ID NO: 3970 - DNA, 1425 bp, Populus balsamifera subsp. trichocarpa
  misc_feature (1)..(1425): useful for making plants with increased salt and oxidative stress resistance as described in USSN 12/922,143
  misc_feature (1)..(1425): Ceres ANNOT ID no.1461443
atgtgggcaattggattggttgttgtcgcattggttgtggtatactatagtcatttgattagcaaatggaagaatcctaaaattgacggggttctccctccaggctccatgggctggcccctcatcggagaaactctgcagttcattattcctggaagatctctagacctccatccattcgtcaagaaaaggatgcaaaagtatggaccgatctttaaaaccagcttagttggtaggcctatcattgtgtccactgactatgaaatgaacaagtacatcttgcaacatgaaggaactctggttgagctatggtatttggattcatttgccaaggttttcgctcttgagggtgaaacgagggtgaacgccatcggcaaagttcaccgatacttgagaagcataactttgaaccactttggcgttgagagcctgaaggaatcattgcttcctaaaatagaagacatgctgcacaccagcttagcaaagtgggctactcaaggacctgttgacgtcaaacaagttatttcagttatggttttcaattttactgcgaacaaaatatttggttatgatgctgaaaactcgagagagaagctaagtgagaattacacaaggatcttgaacagtttcatctccttgcccttgaatatccctggcacttccttccaccagtgcatgcaggaccgagagaagatgttgaaaatgttgaagaatacactgatggagagactcaacgatccatcaaagcgtcggggagattttcttgatcaagccattgatgatatggagacagagaagttcttgacagtggatttcatcccccaactcatgttcgggatcttatttgccagcttcgaatctatgtcaaccactctaactctaacattcaagtttctttcagagaacccccgagtagttgaggaattagcagctgagcacgacgcaattgtgaagaacagagaaaatccaaactcccgcctcacttgggaagagtacagatcgatgacttttacccaaatggtcgtcaatgaaacacttagaatttccaacatcccacctggtctgttccgaaaggcattgaaagatttccaggtcaaaggatacactgttccagctggttggacagtaatgattgttactcctgctattcaattaaatcctgagacattcaaggatccagttacattcaacccatggcggtggaaggaacttgaccaagttaccatttccaaaaacttcatgccattcggtggcggcacaaggcaatgcgccggggcggagtacagcaagctggtcttgtcgacttttcttcatatcttggtcaccaaatacaggtttaccaaggtcaagggaggagacgtatctcgcactcctatcatttcatttggcgatggcatccagattaagtttacagccaagaactga

SEQ ID NO: 3971 - protein, 474 aa, Populus balsamifera subsp. trichocarpa
  misc_feature (1)..(474): useful for making plants with increased salt and oxidative stress resistance as described in USSN 12/922,143
  misc_feature (1)..(474): Ceres ANNOT ID no.1461443
  misc_feature (1)..(474): Bit score of 369.2 for HMM based on sequences of FIGURE 7 of USSN 12/922,143.
  misc_feature (33)..(470): Pfam Name: p450 Pfam Description: Cytochrome P450
  misc_feature (1)..(474): Functional Homolog Of Ceres SEEDLINE ID no. ME06336
MWAIGLVVVALVVVYYSHLISKWKNPKIDGVLPPGSMGWPLIGETLQFIIPGRSLDLHPFVKKRMQKYGPIFKTSLVGRPIIVSTDYEMNKYILQHEGTLVELWYLDSFAKVFALEGETRVNAIGKVHRYLRSITLNHFGVESLKESLLPKIEDMLHTSLAKWATQGPVDVKQVISVMVFNFTANKIFGYDAENSREKLSENYTRILNSFISLPLNIPGTSFHQCMQDREKMLKMLKNTLMERLNDPSKRRGDFLDQAIDDMETEKFLTVDFIPQLMFGILFASFESMSTTLTLTFKFLSENPRVVEELAAEHDAIVKNRENPNSRLTWEEYRSMTFTQMVVNETLRISNIPPGLFRKALKDFQVKGYTVPAGWTVMIVTPAIQLNPETFKDPVTFNPWRWKELDQVTISKNFMPFGGGTRQCAGAEYSKLVLSTFLHILVTKYRFTKVKGGDVSRTPIISFGDGIQIKFTAKN

SEQ ID NO: 3972 - DNA, 1395 bp, Populus balsamifera subsp. trichocarpa
  misc_feature (1)..(1395): useful for making plants with increased salt and oxidative stress resistance as described in USSN 12/922,143
  misc_feature (1)..(1395): Ceres ANNOT ID no.1450198
atggctgttttcttcgtggttcttgtggtagttctctttttgttcggtatctcctctgctttgttgaggtggaatgaggtgagatataggaagaaagggttgcctccaggcaccatgggatggccaatctttggagagaccactgagtttctaaagcaaggcccgaacttcatgaaaaatcagagcgcaaggtatgggagttttttcaaatcccacattctggggtgtcctaccattgtttccatggatccagagctcaacaggtacatactaatgaatgaggcaaaaggccttgttcctggttaccctcagtccatgttggatatcttaggcaattgcaacattgcagcagttcatggctccactcacaagtacatgagaggggcattgttatccctcatcagccccaccatgatcagagaacaacttttgccaacaattgatgagttcatgagaacccacctcagcgattgggattccaaaattattgacattcaacaaatgactaaagagatggcccttctttctgcactcaaacaaattgttggcattgattctagctcaatatctcaagcattcatgcctgagtttttcaagctggttttaggcactttgtcattgccgattgaccttcctggcactaattatacgcgtggagtccaggcgagaaaaaaaatcataagcatgtttaggaaggtaatacaagagaggagggcgtcaaaattatcgcaccaggacatgcttggtaaactgatgagaactcaagaaaataaatacaaattaacagatgaagaaataattgatcagataatcacaattctgtactctggctacgaaacggtttcgactacttcaatgatggcagtcaagtatttgcatgatcacccaacagtccttcaagagctaagaaaagagcatttggcagtaagagaaaagaaaaggcctgaggacccaattgatttgaatgatcttaaaccgatgcgttttactcgtgccgtgattcttgagacctcaagaatggcgacgatagtaaatggggttttgaggaagactactagagaaatggaactgaatggatttgtgattccaaaaggatggaggatctatgtttacacaagagagataaactatgatccacatatatatcctgaccctttatccttcaacccatggagatggctggacaaaagtctggagtctcaaaactatctcttcatttttggaggaggtgctaggcagtgtccagggaaggagctaggaatagctgaaatctcaactttccttcattatttcgtaactcgatacagatgggaagaggttggaggggacacactaatgaaatttccaagagttgaagcaccaaatgggctacacataagggtctcatctcactaa

SEQ ID NO: 3973 - protein, 464 aa, Populus balsamifera subsp. trichocarpa
  misc_feature (1)..(464): useful for making plants with increased salt and oxidative stress resistance as described in USSN 12/922,143
  misc_feature (1)..(464): Ceres ANNOT ID no.1450198
  misc_feature (1)..(464): Bit score of 381.2 for HMM based on sequences of FIGURE 7 of USSN 12/922,143.
  misc_feature (211)..(460): Pfam Name: p450 Pfam Description: Cytochrome P450
  misc_feature (1)..(464): Functional Homolog Of Ceres SEEDLINE ID no. ME06336
MAVFFVVLVVVLFLFGISSALLRWNEVRYRKKGLPPGTMGWPIFGETTEFLKQGPNFMKNQSARYGSFFKSHILGCPTIVSMDPELNRYILMNEAKGLVPGYPQSMLDILGNCNIAAVHGSTHKYMRGALLSLISPTMIREQLLPTIDEFMRTHLSDWDSKIIDIQQMTKEMALLSALKQIVGIDSSSISQAFMPEFFKLVLGTLSLPIDLPGTNYTRGVQARKKIISMFRKVIQERRASKLSHQDMLGKLMRTQENKYKLTDEEIIDQIITILYSGYETVSTTSMMAVKYLHDHPTVLQELRKEHLAVREKKRPEDPIDLNDLKPMRFTRAVILETSRMATIVNGVLRKTTREMELNGFVIPKGWRIYVYTREINYDPHIYPDPLSFNPWRWLDKSLESQNYLFIFGGGARQCPGKELGIAEISTFLHYFVTRYRWEEVGGDTLMKFPRVEAPNGLHIRVSSH

SEQ ID NO: 3974 - protein, 481 aa, Sorghum bicolor
  misc_feature (1)..(481): useful for making plants with increased salt and oxidative stress resistance as described in USSN 12/922,143
  misc_feature (1)..(481): Public GI ID no.18483228
  misc_feature (1)..(481): Bit score of 393.2 for HMM based on sequences of FIGURE 7 of USSN 12/922,143.
  misc_feature (227)..(477): Pfam Name: p450 Pfam Description: Cytochrome P450
  misc_feature (1)..(481): Functional Homolog Of Ceres SEEDLINE ID no. ME06336
MSMHYLAALSVTLLGAILLRWAFKWMNYGRTGGEEGMLLPPGSRGLPFLGETLEFFAASPTLELVPFFKRRLERFGPIFRTNIVGEDMIVSLDPELNARVLQQEERGFQIWYPSSFMRILGADNMVSMLGPLHRHIRNLVLRLFGPEALRLVLLRDVQRSARDELRSWLDRPEVEVRTATSRMIFGVTAKKLISHDDVASGGSLWKCFDAWTKGLMSFPICVPGTAFYRCMQGRKNVMKVLKQQLDERRNGAERKTVDFFDLVIDELDKPNSIMSESIALNLLFLLLFASHETTSMGLTVILKFLTDNPKSLQELTEEHEKIMERRVDPDSDITWEEYKSMKFTSHVIHESLRLANIAPVVFRQANQDVHIKGYTIPEGSKIMICPSAAHLNSKVYEDPLAFNPWRWKDTPEPVGGSKDFMAFGGGLRLCVGAEFAKLQMAMFLHYLVTNYRWKALSKGTMMLYPGLRFPDGFHIQLHKKT

SEQ ID NO: 3975 - protein, 465 aa, Arabidopsis thaliana; identical to SEQ ID NO: 3872
  misc_feature (1)..(465): useful for making plants with increased salt and oxidative stress resistance as described in USSN 12/922,143
  misc_feature (1)..(465): Public GI ID no.18406372
  misc_feature (1)..(465): Bit score of 365.4 for HMM based on sequences of FIGURE 7 of USSN 12/922,143.
  misc_feature (212)..(462): Pfam Name: p450 Pfam Description: Cytochrome P450
  misc_feature (1)..(465): Functional Homolog Of Ceres SEEDLINE ID no. ME06336

SEQ ID NO: 3976 - protein, 462 aa, Arabidopsis thaliana
  misc_feature (1)..(462): useful for making plants with increased salt and oxidative stress resistance as described in USSN 12/922,143
  misc_feature (1)..(462): Public GI ID no.21536828
  misc_feature (1)..(462): Bit score of 365.4 for HMM based on sequences of FIGURE 7 of USSN 12/922,143.
  misc_feature (209)..(459): Pfam Name: p450 Pfam Description: Cytochrome P450
  misc_feature (1)..(462): Functional Homolog Of Ceres SEEDLINE ID no. ME06336
MMMILGLLVIIVCLCTALLRWNQMRYSKKGLPPGTMGWPIFGETTEFLKQGPDFMKNQRLRYGSFFKSHILGCPTIVSMDAELNRYILMNESKGLVAGYPQSMLDILGTCNIAAVHGPSHRLMRGSLLSLISPTMMKDHLLPKIDDFMRNYLCGWDDLETVDIQEKTKHMAFLSSLLQIAETLKKPEVEEYRTEFFKLVVGTLSVPIDIPGTNYRSGVQARNNIDRLLTELMQERKESGETFTDMLGYLMKKEDNRYLLTDKEIRDQVVTILYSGYETVSTTSMMALKYLHDHPKALEELRREHLAIRERKRPDEPLTLDDIKSMKFTRAVIFETSRLATIVNGVLRKTTHDLELNGYLIPKGWRIYVYTREINYDTSLYEDPMIFNPWRWMEKSLESKSYFLLFGGGVRLCPGKELGISEVSSFLHYFVTKYRWEENGEDKLMVFPRVSAPKGYHLKCSPY

SEQ ID NO: 3977 - protein, 438 aa, Solanum lycopersicum
  misc_feature (1)..(438): useful for making plants with increased salt and oxidative stress resistance as described in USSN 12/922,143
  misc_feature (1)..(438): Public GI ID no.89146806
  misc_feature (1)..(438): Bit score of 338.3 for HMM based on sequences of FIGURE 7 of USSN 12/922,143.
  misc_feature (211)..(437): Pfam Name: p450 Pfam Description: Cytochrome P450
  misc_feature (1)..(438): Functional Homolog Of Ceres SEEDLINE ID no. ME06336
MAFFLIFLSSFFGLCIFCTALLRWNQVKYNQKNLPPGTMGWPLFGETTEFLKLGPSFMKNQRARYGSFFKSHILGCPTIVSMDSELNRYILVNEAKGLVPGYPQSMIDILGKCNIAAVNGSAHKYMRGALLSLISPTMIRDQLLPKIDEFMRSHLTNWDNKVIDIQEKTNKMAFLSSLKQIAGIESTSLAQEFMSEFFNLVLGTLSLPINLPNTNYHRGFQARKIIVNLLRTLIEERRASKEIQHDMLGYLMNEEATRFKLTDDEMIDLIITILYSGYETVSTTSMMAVKYLHDHPKVLEELRKEHMAIREKKKPEDPIDYNDYRSMRFTRAVILETSRLATIVNGVLRKTTQDMEINGYIIPKGWRIYVYTRELNYDPRLYPDPYSFNPWRWMDKSLEHQNSFLVFGGGTRQCPGKELGVAEISTFLHYFVTKYRWR

SEQ ID NO: 3978 - protein, 463 aa, Oryza sativa subsp. japonica
  misc_feature (1)..(463): useful for making plants with increased salt and oxidative stress resistance as described in USSN 12/922,143
  misc_feature (1)..(463): Public GI ID no.125602937
  misc_feature (1)..(463): Bit score of 306.1 for HMM based on sequences of FIGURE 7 of USSN 12/922,143.
  misc_feature (288)..(440): Pfam Name: p450 Pfam Description: Cytochrome P450
  misc_feature (1)..(463): Functional Homolog Of Ceres SEEDLINE ID no. ME06336
MEFLSSVSYLFKALCTCGVAFVTGWFAHWVYRWMNPQCDGKLPPGSMGLPLVGETFRFFRASASIDMPSYYKERLKRYGPIFKTSLVGQPLVISLDPEVNRFVFQQEGKLFRSWYPETTNTIFGKKSLTTYSGAVNKFVRSFASKLFGPTNLKESLLPELESAVRESFATWVMNPSIEVKDGISNMIFDLVAKKLIGFNPTKSRELRKNFQEFFQGMVSFPIYFPGTSFYRCMQGRRNVHKTLTDLLKERLSAPGEKYNDLIDQIIEELQSENPVIDVNFAVDVLSALLFASFATLSSTLSVGFKFLTDNPKVVKELKEEHTTILNKRGSLNSGFTWEEYKSLMFTSQVVHEITRISNVAPGIFRKTLADVKVKGYTIPAGWLVMISPMAVDLNPTLFEDPLEFNPWRWTDKTKQSELLRNYMPFGGGIRLCLGAEFSKLFIALFIHVLVTEYRSLIGLYNSN

SEQ ID NO: 3979 - DNA, 1930 bp, Panicum virgatum
  misc_feature (1)..(1930): useful for making plants with increased salt and oxidative stress resistance as described in USSN 12/922,143
  misc_feature (1)..(1930): Ceres CLONE ID no.1868840
ggagagatatagagcagggaacagcagcccgggggtgagctgtgtgaggcttcaacaaagctaagtgaagcattcacacaccataggagtatatacacatacacatatatagacagagatcgagactcttgcaggctccatgcttgggagatgaaacttgggtgtggtggtggccgtcgatgatggcggtggcgggggagctcgcgcttgccgccctggcggcgatcctgctcgcctggctcctggccctggtgctgagccacttcctgcccttgctcctgaaccccaaggcccccaggggtagcttcggatggccgctcgtcggcgagacgctcaggttcctcgcgccccattcttccaacacgctgggcggcttcctggaggatcactgcgccaggtatgggcgggtgttcaagtcccacttgttctgcacccccacggtggtgtcctgcgaccaggacctcaaccacttcatcctgcagaacgaggagcggctgttccagtgcagctacccgaggccgatccatggcatcctgggcaagtcctccatgctcgtggtcctgggcgaggaccacgagcgcctcaggaacctcgccctcgccctcgtcacctccaccaagctaaagcccggctacctcggcgacatcgagaagatcgcgctgcacgtcgtcggctcatggcgccaggacggcggcggcggtagggtcgtcgccttctgcgaggaggcaaggaagttcgcgttcagtgtgatagtgaagcaggtgctggggctgtcaccagaggacccggtcactgccaggatactggaggacttcctggccttcatgaagggcctcatctccttccctctctacatcccagggaccccatatgccaaggctgtccaggctagagagaggatatccagcactgtgaagggcatcatcgaggagcggaggagtccagggtcatgcaagaagggcgatttccttgacgtgctcctgtcaagcaacgagctctccgatgacgagaaagtgagctttgtgctggactccctgctgggaggatacgagaccacctcgctcttgatctccatggtcgtatattttcttgggcagtctgcagaagatctggacctggtcaagagggagcacgacagcataagatccaacaaagggaaggaggagagcttgacttcagaagactacaagaagatggaatatacccaacatgttatcaacgaggctctgagatgcggcaacatagtcaagttcgtccacaggaaggccctcaaagatgtcagatacaaagagtatctgattccatctggctggaaggtcctacccgtcttcagtgctgttcatctgaacccctcgcttcatggaaatgcccaacattttcagccctgtagatgggagggctcaagccaagggacaagcaagaggtttacgccgttcggtggcgggcctcggctctgcccaggatcggagcttgctaaattagaggctgctttctttctccatcaccttgtgctcaattatagatggagaatcgatggcgatgacattccaatggcatacccgtacgtggagtttcagagaggtctgccaatagaaatcgagccaatctgccatgaatcttgacttggcctgaaggcccggtcacggcgagttcatctgttagctagaaggtacctgcacgggaaacatccatgtccatgaacggcgtgaagtttcatgaagtgaagaaacactgggcactagcttgtaagtagctagcatgaggcagctgagactgtgatttatgatgtacatgatgtagatatattttccccatggcaattgctcgaggtggttggttcacttcagtacttcaccctgtaacattctccactgtggctcaaccactgttctatacgagaagtttggactcctgggattcggaaggcttt

SEQ ID NO: 3980 - protein, 480 aa, Panicum virgatum
  misc_feature (1)..(480): useful for making plants with increased salt and oxidative stress resistance as described in USSN 12/922,143
  misc_feature (1)..(480): Ceres CLONE ID no.1868840
  misc_feature (1)..(480): Bit score of 1226.4 for HMM based on sequences of FIGURE 7 of USSN 12/922,143.
  misc_feature (224)..(461): Pfam Name: p450 Pfam Description: Cytochrome P450
  misc_feature (1)..(480): Functional Homolog Of Ceres SEEDLINE ID no. ME06336
MMAVAGELALAALAAILLAWLLALVLSHFLPLLLNPKAPRGSFGWPLVGETLRFLAPHSSNTLGGFLEDHCARYGRVFKSHLFCTPTVVSCDQDLNHFILQNEERLFQCSYPRPIHGILGKSSMLVVLGEDHERLRNLALALVTSTKLKPGYLGDIEKIALHVVGSWRQDGGGGRVVAFCEEARKFAFSVIVKQVLGLSPEDPVTARILEDFLAFMKGLISFPLYIPGTPYAKAVQARERISSTVKGIIEERRSPGSCKKGDFLDVLLSSNELSDDEKVSFVLDSLLGGYETTSLLISMVVYFLGQSAEDLDLVKREHDSIRSNKGKEESLTSEDYKKMEYTQHVINEALRCGNIVKFVHRKALKDVRYKEYLIPSGWKVLPVFSAVHLNPSLHGNAQHFQPCRWEGSSQGTSKRFTPFGGGPRLCPGSELAKLEAAFFLHHLVLNYRWRIDGDDIPMAYPYVEFQRGLPIEIEPICHES

SEQ ID NO: 3981 - protein, 480 aa, Oryza sativa subsp. japonica
  misc_feature (1)..(480): useful for making plants with increased salt and oxidative stress resistance as described in USSN 12/922,143
  misc_feature (1)..(480): Public GI ID no.115458894
  misc_feature (1)..(480): Bit score of 1222.1 for HMM based on sequences of FIGURE 7 of USSN 12/922,143.
  misc_feature (224)..(461): Pfam Name: p450 Pfam Description: Cytochrome P450
  misc_feature (1)..(480): Functional Homolog Of Ceres SEEDLINE ID no. ME06336
MVGGELVLAALVILLALLLTLVLSHFLPLLLNPKAPKGSFGWPLLGETLRFLSPHASNTLGSFLEDHCSRYGRVFKSHLFCTPTIVSCDQELNHFILQNEERLFQCSYPRPIHGILGKSSMLVVLGEDHKRLRNLALALVTSTKLKPSYLGDIEKIALHIVGSWHGKSKDKGMVNVIAFCEEARKFAFSVIVKQVLGLSPEEPVTAMILEDFLAFMKGLISFPLYIPGTPYAKAVQARARISSTVKGIIEERRNAGSSNKGDFLDVLLSSNELSDEEKVSFVLDSLLGGYETTSLLISMVVYFLGQSAQDLELVKREHEGIRSKKEKDEFLSSEDYKKMEYTQHVINEALRCGNIVKFVHRKALKDVRYKEYLIPSGWKVLPVFSAVHLNPLLHGNAQQFQPCRWEGASQGTSKKFTPFGGGPRLCPGSELAKVEAAFFLHHLVLNYRWRIDGDDIPMAYPYVEFQRGLPIEIEPLCSES

SEQ ID NO: 3982 - DNA, 1419 bp, Populus balsamifera subsp. trichocarpa
  misc_feature (1)..(1419): useful for making plants with increased salt and oxidative stress resistance as described in USSN 12/922,143
  misc_feature (1)..(1419): Ceres ANNOT ID no.1472214
atggctggagagctctgggttggtgttttggttggtataactagtggtctgttgggtctaataatgaatcattttctgcccatgttcttgaagcttggtcataatgtcccaaagggctcttttgggtggcctctacttggtgaaaccctcggtttcttgaaacctcacccttctaacacccttggtgcgtttcttcaagatcattgttccaggtacgggaatgtgttcaagtcccatttatttctctctccaacagtggtgtcctgtgaccaggagctgaactatttcattcttcaaaacgaaggcaagttattccagtgcagttatcctaagcctattcacggaattcttggcaatgtctccatgctggtggctgttggtgatactcacaagagactcagaaatgtggctatctctctagttagcattactaaatcaaagccagagttcttgaatgacatagaaagaactgccattcaaatattgagctcctggaaagataaacaacaggtcgtgttctgtgaagaggctagaaagttctcattcaatgtaatagtaaagcaagtgcttggtttaacatcagaggagccggagactagagaaattcttgaagattttcttacttttatgagaggactagtatccatccctctgtatattcctggtactccatatgctagagctgttcaggctagaagcaggatatcttctagagttaaagcaattatagaggaaagaagatcaagaaatagtaggagtttaaggaatgattttcttgaaatacttctaagtgttgataccttatctgaagatgaaaaggtgagctttgtgttggattctcttttgggtgggtatgaaactacctcgctcttaatggccatggtggtgcatcttctaggccagtcacccactgcattagaacagttaaagctagagcatgagcaaataacaagcctgaaggagaaagatgagtgtttgaattgggaagattataagacgatggaattcactcaaaatgtcatcagtgaagcactgagatatggaaacattgtgaaatttgtacaccgaaaggctctcaaagacgtaaagttcagagactacctcattccatctgggtggaaggtcctacctgtttttacagctgtgcatttagactcgtctgtccatgcaaatgctctccagtttcatccttggagatgggagactcaggatcagactagcaagaggtttaccccttttggtggaggatctagatgctgtcccggatctgaacttgccaagattgaggttgccttcttccttcaccaccttgttcagaacttcagatggacagccgaggatgctgaccaacccatggcatatccatacgttgaatttggaaaagggctgttgataaatttggatcgttgttccacctga

SEQ ID NO: 3983 - protein, 472 aa, Populus balsamifera subsp. trichocarpa
  misc_feature (1)..(472): useful for making plants with increased salt and oxidative stress resistance as described in USSN 12/922,143
  misc_feature (1)..(472): Ceres ANNOT ID no.1472214
  misc_feature (1)..(472): Bit score of 1199.0 for HMM based on sequences of FIGURE 7 of USSN 12/922,143.
  misc_feature (218)..(455): Pfam Name: p450 Pfam Description: Cytochrome P450
  misc_feature (1)..(472): Functional Homolog Of Ceres SEEDLINE ID no. ME06336
MAGELWVGVLVGITSGLLGLIMNHFLPMFLKLGHNVPKGSFGWPLLGETLGFLKPHPSNTLGAFLQDHCSRYGNVFKSHLFLSPTVVSCDQELNYFILQNEGKLFQCSYPKPIHGILGNVSMLVAVGDTHKRLRNVAISLVSITKSKPEFLNDIERTAIQILSSWKDKQQVVFCEEARKFSFNVIVKQVLGLTSEEPETREILEDFLTFMRGLVSIPLYIPGTPYARAVQARSRISSRVKAIIEERRSRNSRSLRNDFLEILLSVDTLSEDEKVSFVLDSLLGGYETTSLLMAMVVHLLGQSPTALEQLKLEHEQITSLKEKDECLNWEDYKTMEFTQNVISEALRYGNIVKFVHRKALKDVKFRDYLIPSGWKVLPVFTAVHLDSSVHANALQFHPWRWETQDQTSKRFTPFGGGSRCCPGSELAKIEVAFFLHHLVQNFRWTAEDADQPMAYPYVEFGKGLLINLDRCST

SEQ ID NO: 3984 - protein, 480 aa, Solanum lycopersicum
  misc_feature (1)..(480): useful for making plants with increased salt and oxidative stress resistance as described in USSN 12/922,143
  misc_feature (1)..(480): Public GI ID no.119224822
  misc_feature (1)..(480): Bit score of 1183.9 for HMM based on sequences of FIGURE 7 of USSN 12/922,143.
  misc_feature (224)..(459): Pfam Name: p450 Pfam Description: Cytochrome P450
  misc_feature (1)..(480): Functional Homolog Of Ceres SEEDLINE ID no. ME06336
MGEEGSLLIIVITLVFSFVIGITLNHFWPLFFNNYGTTLHVIPKGTFGWPLLGETLSFLKPHPSNSIGTFLQQHCSRYGKVFKSHLFFSPTVVSCDQDLNYFILQNEDKLFQCSYPKPIHGILGKVSLLVAVGDTHKRLRNVSLSLISTIKSKPEFINDVETLALQILQSWKDKHQVRYWEEARKFSFNVIVKQVLGLTPDNPQSALILQDFLAFMRGLISLPLYIPGTPYARAVQARSRISSTIKAIIEERRRKHVVDGDGKKNDFLEILLCVDTLSEEEKVSFVLDSLLGGYETTSLLMAMVVFFIGQSQTAFDRLKEEHDNIRSTKEKELLNWEDYQKMDFTQKVINEALRYGNVVKFVHRKALKDVKFKDYVIPAGWKVLPVFSAVHLDPSVHPNALHFNPWRWESDEQISKKLTPFGGGSRCCPGFELAKVEVAFFLHHLVQKYRWEVEEGEQPIAYPYVEFKNGLTIRLHKNST

SEQ ID NO: 3985 - DNA, 1422 bp, Populus balsamifera subsp. trichocarpa
  misc_feature (1)..(1422): useful for making plants with increased salt and oxidative stress resistance as described in USSN 12/922,143
  misc_feature (1)..(1422): Ceres ANNOT ID no.1440618
atggctgagttttcgtccattggattagctctcattttaggactagttttggctttatttcttttacgctttttctcaagacaaaatcataaaaatttacctaatggtagcatgggatttccctttgtaggggaaactctttccttactgaagcctcattcatcaaactcaatgggaaccttcctgcaagaacgtgtttccagatatgggaaagttttcaaatcacatctatttggttctccagccatagtttcttgcgaccatgagctcaacatgtttatccttcaaaatgaagagaggttattcgaagccagctaccccaaggccatgcacgatattcttggaaaattctcattacttgttatctccggagacctccataggaagttaagaaattttgttgtcaccttcaacacagtgtccaagtcatccccaagattccttaattttgcagaaaatctagcaatcacaatgctggagtcatggaaaggctgtaaagaaatcgacttccttaaagatatcagaaagtttacacttagtctcatggtgaagagcgttttgagtattgaaccggaagaaccaagagccttgaagatattagatgattttcgaacttacatgaaaggctttgtgtctttgccattaaacttccctggatcatcttattccaaagctgtaaaggcaagaacaagacttgcttccaccatgaaagggattattaatgaaagggaaaaggagaaggtggggcttattacaggagacttcttagacgtgattttgtcaaaacgagggattctaaccgatggacagattgttagcgtggcgttggacatcttgctaggtggctatgagacaacctccatacttatagccttaattgtttactttcttgggcatgtaccgaaggcttttcagaccttaaaggaagaacatgacgcaattagaaaaagtaaacaggcgggggaacccttggacatggaagattacaggaaaatggagttcacgaaaaatgttatatatgagtctatgagatgcgggaatgtggtaaaattcttacaccgtaaagctattcaagatgtcaaatacaaagaatacttcattccatccggttggaaggttatacctgtgttatccggcccacatcttgatccatcccttcatgaaagtcctttgaaattcaatccctggagatggaaaaatcaagagactaggaaaacagtgatgccatttggtggtggaccacggttatgtccaggagccgaacttgccaaagtggagatagcatttttccttcatcatcttgtccttaattataggtggaaagtaaaagaagacgacttcccagttgcttatccttatgtggaattccgaagaggcttgctactggaggttgaaccagcacaggaagagtttagaaaatga

SEQ ID NO: 3986 - protein, 473 aa, Populus balsamifera subsp. trichocarpa
  misc_feature (1)..(473): useful for making plants with increased salt and oxidative stress resistance as described in USSN 12/922,143
  misc_feature (1)..(473): Ceres ANNOT ID no.1440618
  misc_feature (1)..(473): Bit score of 808.3 for HMM based on sequences of FIGURE 7 of USSN 12/922,143.
  misc_feature (192)..(448): Pfam Name: p450 Pfam Description: Cytochrome P450
  misc_feature (1)..(473): Functional Homolog Of Ceres SEEDLINE ID no. ME06336
MAEFSSIGLALILGLVLALFLLRFFSRQNHKNLPNGSMGFPFVGETLSLLKPHSSNSMGTFLQERVSRYGKVFKSHLFGSPAIVSCDHELNMFILQNEERLFEASYPKAMHDILGKFSLLVISGDLHRKLRNFVVTFNTVSKSSPRFLNFAENLAITMLESWKGCKEIDFLKDIRKFTLSLMVKSVLSIEPEEPRALKILDDFRTYMKGFVSLPLNFPGSSYSKAVKARTRLASTMKGIINEREKEKVGLITGDFLDVILSKRGILTDGQIVSVALDILLGGYETTSILIALIVYFLGHVPKAFQTLKEEHDAIRKSKQAGEPLDMEDYRKMEFTKNVIYESMRCGNVVKFLHRKAIQDVKYKEYFIPSGWKVIPVLSGPHLDPSLHESPLKFNPWRWKNQETRKTVMPFGGGPRLCPGAELAKVEIAFFLHHLVLNYRWKVKEDDFPVAYPYVEFRRGLLLEVEPAQEEFRK

SEQ ID NO: 3987 - DNA, 1470 bp, Populus balsamifera subsp. trichocarpa
  misc_feature (1)..(1470): useful for making plants with increased salt and oxidative stress resistance as described in USSN 12/922,143
  misc_feature (1)..(1470): Ceres ANNOT ID no.1510416
atgtctcactcagagcttgttgtctttctccttccatcgattttatcactactcttgctcttcattctcgtgcaaagaaagcaagtaagatttaatctcccaccaggcaacatggggtggccatttcttggagaaaccattggctacctgaagccttactctgctacttcaataggagaattcatggaacagcacatatcaaggtatggaaagatttacaagtccaatttgtttggggagccaacaatagtatccgcagatgctggacttaacagatttatactacagaatgagggaagattatttgaatgcagctatccaaaaagtattggtggaattcttggaaaatggtccatgttggttcttgttggagacatgcatagagacatgaggattatatctcttaactttttgagccatgccaggttaagaactcatctattgaaagaagtggagaagcaaaccctgcttgttcttagctcttggaaggagaattgtacattttcagctcaagatgaagcaaagaagtttaccttcaatttgatggcaaaacatatcatgagcttggatcctggaaagccagagactgagcagctgaaaaaagagtatgttactttcatgaaaggagtagtttcagctcctataaatttgcctggaaccccatatagaaaagccttgaagtctcgatcaatcatcttgaaatttatagagcgaaagatggaggagagaattgctgaaacgaagggtggagtagaaaacttggaagacgatgatcttcttggatgggtcttgaagcattcaaatctttctacggagcaaatccttgacttaatcttaagcttgctctttgctggccacgaaacttcttctgtgtccatagctctagccatctacttcttgcaagcttgtcctggtgctattcaacagttaaaagaagaacatattcaaatctccagagccaagaaacggtcaggagagacggaattgaactgggatgattacaaaaaaatggaattcacccaatgcgttataagcgagacactgaggcttggaaacgtagtcaggtttcttcacagaaaagctctaaaagatgttcggtacaaagggtacgacattccatgtggatggaaagtgctaccagtgatctcagccgtccatttagattcaactcttttcgaccaacctcaacacttcaatccatggagatggcagcagcataacaatgctcgtggtgcttctacaagttcgagtgggacgacgagtagtaattacttcatgccatttgggggaggaccgcgactttgtgcaggatcggaattggcaaaactagaaatggccgtgttcatccaccatttggtcctcaacttccactgggaactggttgataccgatcaagcctttgcctttccttttgtcgattttcccaagggcttgcccataagagtcaagcacctactcacagttacatga

SEQ ID NO: 3988 - protein, 489 aa, Populus balsamifera subsp. trichocarpa
  misc_feature (1)..(489): useful for making plants with increased salt and oxidative stress resistance as described in USSN 12/922,143
  misc_feature (1)..(489): Ceres ANNOT ID no.1510416
  misc_feature (1)..(489): Bit score of 1119.5 for HMM based on sequences of FIGURE 7 of USSN 12/922,143.
  misc_feature (265)..(465): Pfam Name: p450 Pfam Description: Cytochrome P450
  misc_feature (1)..(489): Functional Homolog Of Ceres SEEDLINE ID no. ME06336
MSHSELVVFLLPSILSLLLLFILVQRKQVRFNLPPGNMGWPFLGETIGYLKPYSATSIGEFMEQHISRYGKIYKSNLFGEPTIVSADAGLNRFILQNEGRLFECSYPKSIGGILGKWSMLVLVGDMHRDMRIISLNFLSHARLRTHLLKEVEKQTLLVLSSWKENCTFSAQDEAKKFTFNLMAKHIMSLDPGKPETEQLKKEYVTFMKGVVSAPINLPGTPYRKALKSRSIILKFIERKMEERIAETKGGVENLEDDDLLGWVLKHSNLSTEQILDLILSLLFAGHETSSVSIALAIYFLQACPGAIQQLKEEHIQISRAKKRSGETELNWDDYKKMEFTQCVISETLRLGNVVRFLHRKALKDVRYKGYDIPCGWKVLPVISAVHLDSTLFDQPQHFNPWRWQQHNNARGASTSSSGTTSSNYFMPFGGGPRLCAGSELAKLEMAVFIHHLVLNFHWELVDTDQAFAFPFVDFPKGLPIRVKHLLTVT

SEQ ID NO: 3989 - protein, 496 aa, Zinnia elegans
  misc_feature (1)..(496): useful for making plants with increased salt and oxidative stress resistance as described in USSN 12/922,143
  misc_feature (1)..(496): Public GI ID no.71834076
  misc_feature (1)..(496): Bit score of 1218.9 for HMM based on sequences of FIGURE 7 of USSN 12/922,143.
  misc_feature (44)..(467): Pfam Name: p450 Pfam Description: Cytochrome P450
  misc_feature (1)..(496): Functional Homolog Of Ceres SEEDLINE ID no. ME06336
MCSTTLNMCDLEFFILASCLVLALFLILKLVKRRTNNGSTRNLPPGNMGWPFIGETIGYLQPYSATTIGKFMEQHISKYGKIYKSSLFGEPTIVSADPGLNKYILQNEGRLFECSYPRSIGGILGKWSMLVLVGDMHRDMRQISLNFLSNARLKTQLVNEVEKNTLWVLDSWKENSPFCAQEEAKKFTFNLMATHIMSLDPGEPETERLKKEYVTFMKGVVSPPLNFPGTAYWKALKSRATILKFIETKMEERIRMDEGNGLGKLDNDLLGWSMKNSNLTKEQILDLVLSLLFAGHETSSVSISLAVYFLEACPTAVRQLREEHEEIVMKKKLLGEKYLTWDDYKKMEFTQCVINETLRFGNVVRFLHRKAIKDVRYKGYDIPCGWKVLPVIAAVHLDPTHFDQPYLFDPWRWQNASVTSSTCSTPPSASNFMPFGGGPRLCTGSELAKLEMAIFIHHLVLKYEWELVDSDEAFAYPYLDFPKGLPIKIRHRKQSC

SEQ ID NO: 3990 - DNA, 1470 bp, Populus balsamifera subsp. trichocarpa
  misc_feature (1)..(1470): useful for making plants with increased salt and oxidative stress resistance as described in USSN 12/922,143
  misc_feature (1)..(1470): Ceres ANNOT ID no.1541253
atgtctcactcagagcttgttgtgcttctccttccttcaattttatctctactcctggtcttcattctcatgcaaagaaagcaagcaagatttaatctcccacctggcaacatgggctggccatttcttggagaaactattggctacttgaagccttactctgctacttcaataggggaattcatggaacaacacatatcaaggtatggaaagatttacaagtccaatttgtttggggagccgacaatagtatctgcagatgctggacttaacagatttatactccagagtgaaggaagattgtttgaatgcagctatccaagaagtattggtggaattcttggaaaatggtctatgctggttctagttggagacatgcatagaaacatgaggagtatatctctcaactttttgagccatgccaggttaagaagtcatctattgaaagaagtggagaagcaaaccttgcttgttcttagttcttggaaggagaattgtacattttcagctcaagatgaagcaaagaagtttaccttcaatttgatggcaaaacatatgatgagcttggatcctggaaagccagagactgagcagctgaagaaagagtatgttactttcatgaaaggagtggtttctgctccactaaattttcctggaacaccgtatagaaaagccttgaagtctcgatcaatcatccttaaatttatagagcaaaaaatggaagagagaattgctagattgaaggagggagtggaagatttagaggaagatgatcttcttggatgggttttgaagcattcaaatctttctaccgagcaaatccttgacttgatattaagcttgctctttgctggccatgaaacttcttctgtctccatagctttagccatctacttcttgcaagcttgtcccggtgctattcaacagttaaaagaagaacatattgaaatttccagagccaagaaacagtcaggagagatggaaataaactgggatgattacaaaaaaatggaattcactcaatgtgttataagtgagacactgaggcttggaaacgtagtcaggttccttcatagaaaagctgtcagagatgttcgctataaagggtatgacattccatgtggatggaaagtgctgccagtgatctcagccgtgcatttagattctactgtttttgaccagcctcaacagttcaatccatggagatggcagcagcacaacaatgctcgtggatcttctacttgttcgagtgcggcggcggcgagtagtaatcacttcatgccatttgggggaggaccgcgactctgtgcaggatcggaattggcaaaacttgaaatggcagttttcattcaccatttggttctgaacttccattgggaattggtcggtgccgatcaagcctttgcctttccttttgttgattttcctaaaggcttgccaataagagtcaagcaccacacagtcatataa

SEQ ID NO: 3991 - protein, 489 aa, Populus balsamifera subsp. trichocarpa
  misc_feature (1)..(489): useful for making plants with increased salt and oxidative stress resistance as described in USSN 12/922,143
  misc_feature (1)..(489): Ceres ANNOT ID no.1541253
  misc_feature (1)..(489): Bit score of 1104.8 for HMM based on sequences of FIGURE 7 of USSN 12/922,143.
  misc_feature (265)..(461): Pfam Name: p450 Pfam Description: Cytochrome P450
  misc_feature (1)..(489): Functional Homolog Of Ceres SEEDLINE ID no. ME06336
MSHSELVVLLLPSILSLLLVFILMQRKQARFNLPPGNMGWPFLGETIGYLKPYSATSIGEFMEQHISRYGKIYKSNLFGEPTIVSADAGLNRFILQSEGRLFECSYPRSIGGILGKWSMLVLVGDMHRNMRSISLNFLSHARLRSHLLKEVEKQTLLVLSSWKENCTFSAQDEAKKFTFNLMAKHMMSLDPGKPETEQLKKEYVTFMKGVVSAPLNFPGTPYRKALKSRSIILKFIEQKMEERIARLKEGVEDLEEDDLLGWVLKHSNLSTEQILDLILSLLFAGHETSSVSIALAIYFLQACPGAIQQLKEEHIEISRAKKQSGEMEINWDDYKKMEFTQCVISETLRLGNVVRFLHRKAVRDVRYKGYDIPCGWKVLPVISAVHLDSTVFDQPQQFNPWRWQQHNNARGSSTCSSAAAASSNHFMPFGGGPRLCAGSELAKLEMAVFIHHLVLNFHWELVGADQAFAFPFVDFPKGLPIRVKHHTVI

SEQ ID NO: 3992 - protein, 480 aa, Hordeum vulgare subsp. vulgare
  misc_feature (1)..(480): useful for making plants with increased salt and oxidative stress resistance as described in USSN 12/922,143
  misc_feature (1)..(480): Public GI ID no.116876026
  misc_feature (1)..(480): Bit score of 1114.1 for HMM based on sequences of FIGURE 7 of USSN 12/922,143.
  misc_feature (334)..(453): Pfam Name: p450 Pfam Description: Cytochrome P450
  misc_feature (1)..(480): Functional Homolog Of Ceres SEEDLINE ID no. ME06336
MSMTVGDLVLAAPAILLALLLALVLSHFLPLLLNPKAPRGSFGWPLVGETLKFLTPHASNTLGSFLEDHCSRYGRVFKSHLFCTPTVVSCDQEVSRFVLQSDARSFVPWYPRSLTELMGKSSILLINGSLQRRVHGLVGAFFKSPQLKAQVTADMQRRLAPALAAWREQGPGARLRIQDHAKTIVFQILVRGLIGLEAGPEMQQLKQQFQEFIVGLMSLPIKLPGTRLYRSLQAKKRMARVIQRIIQDKRRRRRALDEAPPARDAIDVLMGDGSEELTDELISDNMIDLMIPAEDSVPVLITLAVKFLSECPLALQQLEEENMQLKMRKAGLGETLQWTDYMSLSFTQHVITETLRMGNIISGIMRKAVRDVEVKGHLIPKGWCVFMYFRSVHLDDMLYEDPCKFNPWRWKEKDVSASSFTPFGGGQRLCPGLDLARLEASIFLHHLVTSFRWVAEEDHIVNFPTVRLKGGMPIRVTARD

SEQ ID NO: 3993 - protein, 485 aa, Gossypium hirsutum
  misc_feature (1)..(485): useful for making plants with increased salt and oxidative stress resistance as described in USSN 12/922,143
  misc_feature (1)..(485): Public GI ID no.116248050
  misc_feature (1)..(485): Bit score of 1188.3 for HMM based on sequences of FIGURE 7 of USSN 12/922,143.
  misc_feature (217)..(465): Pfam Name: p450 Pfam Description: Cytochrome P450
  misc_feature (1)..(485): Functional Homolog Of Ceres SEEDLINE ID no. ME06336
MPDSEPIFLLLPSILSLILFFILIKRKQRRYNLPPGNMGWPFLGETIGYLRPYSATSVGEFMHQHISRYGNIYKSNLFGEKTIVSADAGLNKFILQNEGRLFECSYPRSIGGILGKWSMLVLVGDMHRDMRIISLNFLSNARLRTHLLREVEKHTLLVLNTWKEKCIFSAQDEAKKFTFNLVAKNIMSMDPGHPETEQLKKEYVTFMKGVVSAPLNLPGTAYRKALQSRSTILKFIEKKMEVRIRKMKEGKENSEEDDLLEWVLKHSNLSTEQILDLILSLLFAGHETSSVAITLAIYFLPGCPLAIQQLREEHLEVARAKNQSGETELNWDDYKKMEFTQCVINETLRLGNVVRFLHRKALKDIRYKGYDIPCGWKVLPVIAAVHLDPCLFDHPQLFNPWRWQQNNGSRGAGTATSSASSSNYFMPFGGGPRLCAGTELAKLEMAVFIHHLVLNYQWELADTDEAFAFPFVDFPKGLPIRVFKS

SEQ ID NO: 3994 - protein, 491 aa, Solanum lycopersicum
  misc_feature (1)..(491): useful for making plants with increased salt and oxidative stress resistance as described in USSN 12/922,143
  misc_feature (1)..(491): Public GI ID no.119224824
  misc_feature (1)..(491): Bit score of 1041.8 for HMM based on sequences of FIGURE 7 of USSN 12/922,143.
  misc_feature (217)..(459): Pfam Name: p450 Pfam Description: Cytochrome P450
  misc_feature (1)..(491): Functional Homolog Of Ceres SEEDLINE ID no. ME06336
MSDLEFFLFLIPPILAVLIILNLFKRKHNFQNLPPGDMGWPFLGETIGYLRPYSATTIGDFMQDHISRYGKIFKSNLFGEPTIVSADAGLNRYILQNEGRLFECNYPRSIGGILGKWSMLVQVGQMHRDMRMIPLNFLSNARLRNQLLSEVEKHTLLVLGSWKQDSVVCAQDEAKKLTFNFMAEHIMSLQPGNPETEKLKKEYITFMKGVVSAPLNFPGTAYRKALQSRSTILGFIERKMEERLKEMNRNENDLLGWVLKNSNLSKEQILDLLLSLLFAGHETSSVAIALSIFLLESCPAAVQQLTEEHLEISRAKKQSGETELNWDDYKKMEFTQCVINETLRLGNVVRFLHRKAVKDVRYKGYDIPCGWKVLPVISAAHLDPSLFDRPHDFDPWRWQNAEESPSGKGGSTGTSSTTKSSNNFMPFGGGPRLCAGSELAKLEMAIFIHYLVLNFHWKLAATDQAFAYPYVDFPNALPINIQHRSLNKLHD

SEQ ID NO: 3995 - DNA, 2061 bp, Gossypium hirsutum
  misc_feature (1)..(2061): useful for making plants with increased salt and oxidative stress resistance as described in USSN 12/922,143
  misc_feature (1)..(2061): Ceres CLONE ID no.1918218
attagatagtcagtaagcttattggctaattctaaattctaaattctaagcttttttcgtttaagtagctgccgcaagtgactctaaatactccagaaatgatctccttttcaagaaaaacaccaacaaaagtagatatctgatttctttcttggaaagctaagctaagcaaagcaaaaaaagaaaaacaagtgggagtgggaaaggattgaagaagaaaaaagggtcggtctccatgcctgactcagagcctattttcttgcttctaccatctattttatctttgattctgttcttcattctcatcaagagaaagcaaagaaggtataatcttccaccagggaacatggggtggccttttctcggcgaaacaatcggttacttgaggccttactctgctacttcagtaggtgaattcatgcaccagcatatatcaaggtatgggaatatctacaaatcgaatttgtttggtgagaagacaatagtgtctgcagatgctgggttgaacaagttcatattacaaaacgaagggagattattcgagtgcagttacccgagaagcattggtggcattcttgggaaatggtcgatgctggttttggttggggatatgcatagagacatgaggattatatcactcaacttcttgagcaacgccaggctgaggactcatcttttgagagaagtggagaaacatactttgcttgttctaaatacttggaaagagaagtgcatattttcagctcaggatgatgcaaaaaagttcactttcaatttgatggcaaaaaatatcatgagcatggaccctggacatccagagacggagcagctaaagaaagaatatgttactttcatgaaaggagtcgtttctgctcctttaaatttacctggaactgcatacagaaaagccttacaatctcgatcaacaatcctgaaatttattgaaaagaaaatggaagtaaggataaggaaaatgaaggaaggaaaagaaaactcagaggaagatgatcttcttgaatgggtcttaaagcattctaatctttccacagagcaaatccttgacttgattttgagcttgctttttgctggacatgagacttcctcggtagccataaccttagccatctacttcttgccaggttgtcctttggccattcaacagttgagagaagaacaccttgaagttgccagagccaagaaccaatcaggagagactgaactcaactgggatgattacaagaaaatggagttcactcaatgtgttattaacgagacacttaggcttggtaatgtcgtcagatttctccacagaaaagctctcaaagatattagatataaaggttatgatattccatgtgggtggaaagtgcttccagtgattgcagcagtgcacttggatccctgtctttttgaccaccctcaactcttcaatccatggcgatggcagcaaaataatgggagtcgaggggcggggacggcaacgtcatcagcgagcagcagcaattacttcatgccattcgggggaggaccacggctatgtgcaggaacagagctggctaaactggaaatggcggtgttcatccaccatttggtcctcaactaccagtgggagttagccgatacggatgaagcctttgccttcccttttgtcgacttccctaaaggcctacccatcagagtcttcaaatcttaaaacagacatctcaggcaggcaggcaggcaggcaggctcagccgctcgtgttgctgcatatatttatatatagtagatatataggcattaatttaaaagtggacccccaagctacctactatcaccattcttctgcagtactgtacgtacgtgaagacaaagacgatagtggctttcgtatttttcaacgttctagttgttccacatttatatatatagtataattacatgaagaaaaagggaagacaaaacagattcaaagtatatatttatatatatatatattcatatccaccatattaatgtaaatttttattttattttggtcccttctgggagataattattattattactattcatttatcg

SEQ ID NO: 3996 - protein, 485 aa, Gossypium hirsutum
  misc_feature (1)..(485): useful for making plants with increased salt and oxidative stress resistance as described in USSN 12/922,143
  misc_feature (1)..(485): Ceres CLONE ID no.1918218
  misc_feature (1)..(485): Bit score of 1185.7 for HMM based on sequences of FIGURE 7 of USSN 12/922,143.
  misc_feature (217)..(465): Pfam Name: p450 Pfam Description: Cytochrome P450
  misc_feature (1)..(485): Functional Homolog Of Ceres SEEDLINE ID no. ME06336
MPDSEPIFLLLPSILSLILFFILIKRKQRRYNLPPGNMGWPFLGETIGYLRPYSATSVGEFMHQHISRYGNIYKSNLFGEKTIVSADAGLNKFILQNEGRLFECSYPRSIGGILGKWSMLVLVGDMHRDMRIISLNFLSNARLRTHLLREVEKHTLLVLNTWKEKCIFSAQDDAKKFTFNLMAKNIMSMDPGHPETEQLKKEYVTFMKGVVSAPLNLPGTAYRKALQSRSTILKFIEKKMEVRIRKMKEGKENSEEDDLLEWVLKHSNLSTEQILDLILSLLFAGHETSSVAITLAIYFLPGCPLAIQQLREEHLEVARAKNQSGETELNWDDYKKMEFTQCVINETLRLGNVVRFLHRKALKDIRYKGYDIPCGWKVLPVIAAVHLDPCLFDHPQLFNPWRWQQNNGSRGAGTATSSASSSNYFMPFGGGPRLCAGTELAKLEMAVFIHHLVLNYQWELADTDEAFAFPFVDFPKGLPIRVFKS

SEQ ID NO: 3997 - protein, 502 aa, Oryza sativa subsp. japonica
  misc_feature (1)..(502): useful for making plants with increased salt and oxidative stress resistance as described in USSN 12/922,143
  misc_feature (1)..(502): Public GI ID no.115451693
  misc_feature (1)..(502): Bit score of 938.3 for HMM based on sequences of FIGURE 7 of USSN 12/922,143.
  misc_feature (237)..(475): Pfam Name: p450 Pfam Description: Cytochrome P450
  misc_feature (1)..(502): Functional Homolog Of Ceres SEEDLINE ID no. ME06336
MASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 3998 - protein, 506 aa, Oryza sativa subsp. japonica
  misc_feature (1)..(506): useful for making plants with increased salt and oxidative stress resistance as described in USSN 12/922,143
  misc_feature (1)..(506): Public GI ID no.60677681
  misc_feature (1)..(506): Bit score of 938.3 for HMM based on sequences of FIGURE 7 of USSN 12/922,143.
  misc_feature (241)..(479): Pfam Name: p450 Pfam Description: Cytochrome P450
  misc_feature (1)..(506): Functional Homolog Of Ceres SEEDLINE ID no. ME06336
MAAMMASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 3999 - protein, 502 aa, Oryza sativa subsp. indica
  misc_feature (1)..(502): useful for making plants with increased salt and oxidative stress resistance as described in USSN 12/922,143
  misc_feature (1)..(502): Public GI ID no.125542982
  misc_feature (1)..(502): Bit score of 937.8 for HMM based on sequences of FIGURE 7 of USSN 12/922,143.
  misc_feature (237)..(475): Pfam Name: p450 Pfam Description: Cytochrome P450
  misc_feature (1)..(502): Functional Homolog Of Ceres SEEDLINE ID no. ME06336
MASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWLPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 4000 - protein, 513 aa, Arabidopsis thaliana
  misc_feature (1)..(513): useful for making plants with increased salt and oxidative stress resistance as described in USSN 12/922,143
  misc_feature (1)..(513): Public GI ID no.71152350
  misc_feature (1)..(513): Bit score of 1029.3 for HMM based on sequences of FIGURE 7 of USSN 12/922,143.
  misc_feature (292)..(493): Pfam Name: p450 Pfam Description: Cytochrome P450
  misc_feature (1)..(513): Functional Homolog Of Ceres SEEDLINE ID no. ME06336
MFETEHHTLLPLLLLPSLLSLLLFLILLKRRNRKTRFNLPPGKSGWPFLGETIGYLKPYTATTLGDFMQQHVSKYGKIYRSNLFGEPTIVSADAGLNRFILQNEGRLFECSYPRSIGGILGKWSMLVLVGDMHRDMRSISLNFLSHARLRTILLKDVERHTLFVLDSWQQNSIFSAQDEAKKFTFNLMAKHIMSMDPGEEETEQLKKEYVTFMKGVVSAPLNLPGTAYHKALQSRATILKFIERKMEERKLDIKEEDQEEEEVKTEDEAEMSKSDHVRKQRTDDDLLGWVLKHSNLSTEQILDLILSLLFAGHETSSVAIALAIFFLQACPKAVEELREEHLEIARAKKELGESELNWDDYKKMDFTQCVINETLRLGNVVRFLHRKALKDVRYKGYDIPSGWKVLPVISAVHLDNSRYDQPNLFNPWRWQQQNNGASSSGSGSFSTWGNNYMPFGGGPRLCAGSELAKLEMAVFIHHLVLKFNWELAEDDQPFAFPFVDFPNGLPIRVSRIL

SEQ ID NO: 4001 - protein, 513 aa, Arabidopsis thaliana
  misc_feature (1)..(513): useful for making plants with increased salt and oxidative stress resistance as described in USSN 12/922,143
  misc_feature (1)..(513): Public GI ID no.15229822
  misc_feature (1)..(513): Bit score of 1028.6 for HMM based on sequences of FIGURE 7 of USSN 12/922,143.
  misc_feature (292)..(493): Pfam Name: p450 Pfam Description: Cytochrome P450
  misc_feature (1)..(513): Functional Homolog Of Ceres SEEDLINE ID no. ME06336
MFETEHHTLLPLLLLPSLLSLLLFLILLKRRNRKTRFNLPPGKSGWPFLGETIGYLKPYTATTLGDFMQQHVSKYGKIYRSNLFGEPTIVSADAGLNRFILQNEGRLFECSYPRSIGGILGKWSMLVLVGDMHRDMRSISLNFLSHARLRTILLKDVERHTLFVLDSWQQNSIFSAQDEAKKFTFNLMAKHIMSMDPGEEETEQLKKEYVTFMKGVVSAPLNLPGTAYHKALQSRATILKFIERKMEERKLDIKEEDQEEEEVKTEDEAEMSKSDHVRKQRTDDDLLGWVLKHSNLSTEQILDLILSLLFAGHETSSVAIALAIFFLQACPKAVEELREEHLEIARAKKELGESELNWDDYKKMDFTQCVINETLRLGNVVRFLHRKALKDVRYKGYDIPSGWKVLPVISAVHLDNSRYDQPNLFNPWRWQQQNNGASSSGSGSFSTWGNNYMPFGGGPRLCAGSELAKLEMAVFIHHLVLKFNWELAEDDKPFAFPFVDFPNGLPIRVSRIL

SEQ ID NO: 4002 - DNA, 2021 bp, Zea mays
  misc_feature (1)..(2021): useful for making plants with increased salt and oxidative stress resistance as described in USSN 12/922,143
  misc_feature (1)..(2021): Ceres CLONE ID no.1578373
agacgaagtggggcgcctagcttcttactagttttttttttccttgcgcaaagcttgcacttgctgagagagagggagagagaaatccagagataaaggcgcttcattcattccctctcctgctttctctctccaacccatccgtcctctctctccacacataaaaaccaacgaagcgggcgagtgatcaggcagaggcagcaggcaggaaataaatttgaagaaagctagacctctgatcagcaggagctcatgggcgccatgatggcctccataaccagcgagctcctcttcttccttcccttcatcctgctggccctcctcgccttgtacaccaccaccgtcgccaaatgccacggcacccacccgtggcgccgtcagaagaagaagcggcccaacctgcccccgggcgcccgcggatggcccttggtcggcgaaactttcggctacctccgcgcccacccggccacctccgtgggccgcttcatggagcggcatgtcgcacggtacgggaagatataccggtcgagcctgttcggggagcggacggtggtgtcggcggacgcggggctgaaccgctacatcctgcagaacgaggggcggctgttcgagtgcagctacccgcgcagcatcggcggcatcctgggcaagtggtccatgctggtgctcgtgggcgacgcgcaccgcgagatgcgcgctatctcgctcaacttcctcagctccgtccgcctccgcgccgtgctgctccccgaggtggagcgccacaccctgctggtcctccgctcgtggccgccctccgacggcaccttctccgcccagcacgaagccaagaagttcacgtttaacctgatggcgaagaacataatgagcatggaccccggcgaggaggagacggagcggctgcggctggagtacatcaccttcatgaagggcgtcgtgtcagcgccgctcaacttcccgggcacggcctactggaaggcgctcaagtcgcgcgcgtccatacttggagtgatagagaggaagatggaggacaggcttgagaagatgagcagggagaagtcaagcgtggaggaggacgaccttcttggatgggccctgaagcaatccaacctgtccaaggaacagatcctggacctcttgctgagcctgctcttcgcggggcacgagacttcgtccatggcgctcgccctcgccatcttcttcctcgaagggtgccctaaggccgtgcaagaactccgggaggagcatctcctgattgctaggagacaaaggctaaggggggcgtccaaattgagctgggaagactacaaggaaatggttttcacgcagtgtgttataaacgagacattgcggctcggcaacgtggtcaggttcctgcaccggaaggtcatccgagatgtacactacaatgggtacgacataccgcgggggtggaaaatcctgccggttctagcggcggtgcacctggactcgtcgctgtacgaggaccccagccggttcaacccttggagatggaagagcaacaacgcgccaagcagcttcatgccgtacggcggcgggccgcggctgtgcgccgggtcggagctggccaagctggagatggccatcttcctgcaccacctggtgctcaacttccggtgggagctggcggagccggaccaggccttcgtctaccctttcgtcgacttccccaagggcctcccgatcagggtccagcgggtcgccgacgaccaaggccatcgtagcgttttgaccgagagcacaagaggctgagagggaggaggcagttcaatttttcgttgcattttgagggctgtggtctcgtgttttatgtagattgtgattattattattatacatactaaaacaagatagaagcacgtatagacagagcaaagaggaggatggtccaaaagtgtttggggtagataaaatgtgtactcactagggttgtaataaggccggtccatggcccatgtcaagtaatactagagatatatagaatatagtggatatccaac

SEQ ID NO: 4003 - protein, 502 aa, Zea mays
  misc_feature (1)..(502): useful for making plants with increased salt and oxidative stress resistance as described in USSN 12/922,143
  misc_feature (1)..(502): Ceres CLONE ID no.1578373
  misc_feature (1)..(502): Bit score of 932.8 for HMM based on sequences of FIGURE 7 of USSN 12/922,143.
  misc_feature (279)..(466): Pfam Name: p450 Pfam Description: Cytochrome P450
  misc_feature (1)..(502): Functional Homolog Of Ceres SEEDLINE ID no. ME06336
MASITSELLFFLPFILLALLALYTTTVAKCHGTHPWRRQKKKRPNLPPGARGWPLVGETFGYLRAHPATSVGRFMERHVARYGKIYRSSLFGERTVVSADAGLNRYILQNEGRLFECSYPRSIGGILGKWSMLVLVGDAHREMRAISLNFLSSVRLRAVLLPEVERHTLLVLRSWPPSDGTFSAQHEAKKFTFNLMAKNIMSMDPGEEETERLRLEYITFMKGVVSAPLNFPGTAYWKALKSRASILGVIERKMEDRLEKMSREKSSVEEDDLLGWALKQSNLSKEQILDLLLSLLFAGHETSSMALALAIFFLEGCPKAVQELREEHLLIARRQRLRGASKLSWEDYKEMVFTQCVINETLRLGNVVRFLHRKVIRDVHYNGYDIPRGWKILPVLAAVHLDSSLYEDPSRFNPWRWKSNNAPSSFMPYGGGPRLCAGSELAKLEMAIFLHHLVLNFRWELAEPDQAFVYPFVDFPKGLPIRVQRVADDQGHRSVLTESTRG

SEQ ID NO: 4004 - DNA, 1897 bp, Zea mays
  misc_feature (1)..(1897): useful for making plants with increased salt and oxidative stress resistance as described in USSN 12/922,143
  misc_feature (1)..(1897): Ceres CLONE ID no.1583137
gacgaagtggggcgcctagcttcttactagttttttttccttgcgcaaagcttgcacttgctgagagagagggagagagaaatccagagataaaggcgcttcattcattccctctcctgctttctctctccaacccatccgtcctctctctccacacataaaaaccaacgaagcgggcgagtgatcaggcagaggcagcaggcaggaaataaatttgaagaaagctagacctctgatcagcaggagctcatgggcgccatgatggcctccataaccagcgagctcctcttcttccttcccttcatcctgctggccctcctcgccttgtacaccaccaccgtcgccaaatgccacggcacccaccagtggcgccgtcagaagaagaagcggcccaacctgcccccgggcgcccgcggatggcccttggtcggcgagactttcggctacctccgcgcccacccggccacctccgtgggccgcttcatggagcggcatgtcgcacggtacgggaagatataccggtcgtgcctgttcggggagcggacggtggtgtcggcggacgcggggctgaaccgctacatcctgcagaacgaggggcggctgttcgagtgcagctacccgcgcagcatcggcggcatcctgggcaagtggtccatgctggtgctcgtgggcgacgcgcaccgcgagatgcgcgctatctcgctcaacttcctcagctccgtccgcctccgcgccgtgctgctccccgaggtggagcgccacaccctgctggtcctccgctcgtggccgccctccgacggcaccttctccgcccagcacgaagccaagaagttcacgtttaacctgatggcgaagaacataatgagcatggaccccggcgaggaggagacggagcggctgcggctggagtacatcaccttcatgaagggcgtcgtgtcagcgccgctcaacttcccgggcacggcctactggaaggcgctcaagtcacgcgcgtccatacttggagtgatagagaggaagatggaggacaggcttgagaagatgagcagggagaagtcaagcgtggaggaggacgaccttcttggatgggccctgaagcaatccaacctgtccaaggaacagatcctggacctcttgctgagcctgctcttcgcggggcacgagacttcgtccatggcgctcgccctcgccatcttcttcctcgaagggtgccctaaggccgtgcaagaactccgggaggagcatctcctgattgctaggagacaaaggctaagaggggcgtctaaattgagctgggaagactgcaaggaaatggttttcacgcagtgtgttataaacgagacattgcggctcggcaacgtggtcaggttcctgcaccggaaggtcatccgagatgtacactacaatgggtacgacataccgcgggggtggaaaatcctgccggttctagcggcggtgcacctggactcgtcgctgtacgaggaccccagccggttcaacccttggagatggaagctgcagagcaacaacgcgccaagcagcttcatgccgtacggcggcgggccgcggctgtgcgccgggtcggagctggccaagctggagatggccatcttcctgcaccacctggtgctcaacttccggtgggagctggcggagccggaccaggccttcgtctaccctttcgtcgacttccccaagggcctcccgatcagggtccagcgggtcgccgacgaccaaggccatcgtagcgttttgaccgagagcacaagaggctgagagggaggaggcagttcaatttttcgttgcattttgagggctgtggtctcgtgttttatgtagattgtgattattattattatacatactaaaacaagatagaagcacgtatagacagagc

SEQ ID NO: 4005 - protein, 504 aa, Zea mays
  misc_feature (1)..(504): useful for making plants with increased salt and oxidative stress resistance as described in USSN 12/922,143
  misc_feature (1)..(504): Ceres CLONE ID no.1583137
  misc_feature (1)..(504): Bit score of 920.0 for HMM based on sequences of FIGURE 7 of USSN 12/922,143.
  misc_feature (279)..(468): Pfam Name: p450 Pfam Description: Cytochrome P450
  misc_feature (1)..(504): Functional Homolog Of Ceres SEEDLINE ID no. ME06336
MASITSELLFFLPFILLALLALYTTTVAKCHGTHQWRRQKKKRPNLPPGARGWPLVGETFGYLRAHPATSVGRFMERHVARYGKIYRSCLFGERTVVSADAGLNRYILQNEGRLFECSYPRSIGGILGKWSMLVLVGDAHREMRAISLNFLSSVRLRAVLLPEVERHTLLVLRSWPPSDGTFSAQHEAKKFTFNLMAKNIMSMDPGEEETERLRLEYITFMKGVVSAPLNFPGTAYWKALKSRASILGVIERKMEDRLEKMSREKSSVEEDDLLGWALKQSNLSKEQILDLLLSLLFAGHETSSMALALAIFFLEGCPKAVQELREEHLLIARRQRLRGASKLSWEDCKEMVFTQCVINETLRLGNVVRFLHRKVIRDVHYNGYDIPRGWKILPVLAAVHLDSSLYEDPSRFNPWRWKLQSNNAPSSFMPYGGGPRLCAGSELAKLEMAIFLHHLVLNFRWELAEPDQAFVYPFVDFPKGLPIRVQRVADDQGHRSVLTESTRG

SEQ ID NO: 4006 - DNA, 1599 bp, Populus balsamifera subsp. trichocarpa
  misc_feature (1)..(1599): useful for making plants with increased salt and oxidative stress resistance as described in USSN 12/922,143
  misc_feature (1)..(1599): Ceres ANNOT ID no.1487841
atgtctcactcagagcttgttgtgcttctccttccttcaattttatctctactcctggtcttcattctcatgcaaagaaagcaagcaagatttaatctcccacctggcaacatgggctggccatttcttggagaaactattggctacttgaagccttactctgctacttcaataggggaattcatggaacaacacatatcaaggtatggaaagatttacaagtccaatttgtttggggagccgacaatagtatctgcagatgctggacttaacagatttatactccagagtgaaggaagattgtttgaatgcagctatccaagaagtattggtggaattcttggaaaatggtctatgctggttctagttggagacatgcatagaaacatgaggagtatatctctcaactttttgagccatgccaggttaagaagtcatctattgaaagaagtggagaagcaaaccttgcttgttcttagttcttggaaggagaattgtacattttcagctcaagatgaagcaaagaagtttaccttcaatttgatggcaaaacatatgatgagcttggatcctggaaagccagagactgagcagctgaagaaagagtatgttactttcatgaaaggagtggtttctgctccactaaattttcctggaacaccgtatagaaaagccttgaagtctcgatcaatcatccttaaatttatagagcaaaaaatggaagagagaattgctagattgaaggagggagtggaagatttagaggaagatgatcttcttggatgggttttgaagcattcaaatctttctaccgagcaaatccttgacttgatattaagcttgctctttgctggccatgaaacttcttctgtctccatagctttagccatctacttcttgcaagcttgtcccggtgctattcaacagttaaaagaagaacatattgaaatttccagagccaagaaacagtcaggagagatggaaataaactgggatgattacaaaaaaatggaattcactcaatgtgttataagtgagacactgaggcttggaaacgtagtcaggttccttcatagaaaagctgtcagagatgttcgctataaagggtatgacattccatgtggatggaaagtgctgccagtgatctcagccgtgcatttagattctactgtttttgaccagcctcaacagttcaatccatggagatggcagattttggcatcatcaacagggtctcctgactgtgtttggttttttgctacacgtatctccattttagcgttcaatgcaagggttgattccatgacatttggacaacgaaagctcccgtggtctgcccttcagcacaacaatgctcgtggatcttctacttgttcgagtgcggcggcggcgagtagtaatcacttcatgccatttgggggaggaccgcgactctgtgcaggatcggaattggcaaaacttgaaatggcagttttcattcaccatttggttctgaacttccattgggaattggtcggtgccgatcaagcctttgcctttccttttgttgattttcctaaaggcttgccaataagagtcaagcaccacacagtcatataa

SEQ ID NO: 4007 - protein, 532 aa, Populus balsamifera subsp. trichocarpa
  misc_feature (1)..(532): useful for making plants with increased salt and oxidative stress resistance as described in USSN 12/922,143
  misc_feature (1)..(532): Ceres ANNOT ID no.1487841
  misc_feature (1)..(532): Bit score of 1056.4 for HMM based on sequences of FIGURE 7 of USSN 12/922,143.
  misc_feature (265)..(403): Pfam Name: p450 Pfam Description: Cytochrome P450
  misc_feature (1)..(532): Functional Homolog Of Ceres SEEDLINE ID no. ME06336
MSHSELVVLLLPSILSLLLVFILMQRKQARFNLPPGNMGWPFLGETIGYLKPYSATSIGEFMEQHISRYGKIYKSNLFGEPTIVSADAGLNRFILQSEGRLFECSYPRSIGGILGKWSMLVLVGDMHRNMRSISLNFLSHARLRSHLLKEVEKQTLLVLSSWKENCTFSAQDEAKKFTFNLMAKHMMSLDPGKPETEQLKKEYVTFMKGVVSAPLNFPGTPYRKALKSRSIILKFIEQKMEERIARLKEGVEDLEEDDLLGWVLKHSNLSTEQILDLILSLLFAGHETSSVSIALAIYFLQACPGAIQQLKEEHIEISRAKKQSGEMEINWDDYKKMEFTQCVISETLRLGNVVRFLHRKAVRDVRYKGYDIPCGWKVLPVISAVHLDSTVFDQPQQFNPWRWQILASSTGSPDCVWFFATRISILAFNARVDSMTFGQRKLPWSALQHNNARGSSTCSSAAAASSNHFMPFGGGPRLCAGSELAKLEMAVFIHHLVLNFHWELVGADQAFAFPFVDFPKGLPIRVKHHTVI

SEQ ID NO: 4008 - protein, 526 aa, Oryza sativa subsp. japonica
  misc_feature (1)..(526): useful for making plants with increased salt and oxidative stress resistance as described in USSN 12/922,143
  misc_feature (1)..(526): Public GI ID no.125585475
  misc_feature (1)..(526): Bit score of 834.8 for HMM based on sequences of FIGURE 7 of USSN 12/922,143.
  misc_feature (237)..(397): Pfam Name: p450 Pfam Description: Cytochrome P450
  misc_feature (1)..(526): Functional Homolog Of Ceres SEEDLINE ID no. ME06336
MASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGFDIPSGWKILPVLAPCIWTRPCTRTPALQSLEMEGKENTGTSADVAVGQCLSIISEGDHSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 4009 - protein, 483 aa, Nicotiana tabacum
  misc_feature (1)..(483): useful for making plants with increased salt and oxidative stress resistance as described in USSN 12/922,143
  misc_feature (1)..(483): Public GI ID no.45260636
  misc_feature (1)..(483): Bit score of 1139.2 for HMM based on sequences of FIGURE 7 of USSN 12/922,143.
  misc_feature (215)..(474): Pfam Name: p450 Pfam Description: Cytochrome P450
  misc_feature (1)..(483): Functional Homolog Of Ceres SEEDLINE ID no. ME06336
MDFIIYLFLSFSISLITFLLLRAAAAAHFRRRKTRLPPGTLGLPFIGETLQLISAYKTENPEPFIDDRVSKYGNIFTTHIFGEPTVFSTDAETNRFILQNEGRPFESSYPSSLQNLLGKHSLLLMRGSLHKRMHSLTMSFANSSILKDHLLADIDRLVRLNLDSWTGRVFLMEEAKKITFNLTVKQLMSLDPCEWTEKLMKEYMLVIEGFFTIPLPFFSSTYRKAIQARRKVAEALGLVVKERRKERGGGERLKNDMLEALFEGDGVEGFSDEVIVDFMLALLVAGYETTSTIMTLAVKFLTETPHALSLLKEEHEEIRLRKGDVESLLWEDYKSMPFTQCVVNETLRVGNIISGVFRRTMTDINIKGYTIPKGWKVFACFRAVHLDHEHFKDARTFDPWRWQSNAGSTSSPNVFTPFGGGPRRCPGYELARVELSVFLHHLVTRHSWVPAEPDKLVFFPTTRMQKRYPIIVQRRSLFDPCKE

SEQ ID NO: 4010 - protein, 472 aa, Arabidopsis thaliana
  misc_feature (1)..(472): useful for making plants with increased salt and oxidative stress resistance as described in USSN 12/922,143
  misc_feature (1)..(472): Public GI ID no.15239203
  misc_feature (1)..(472): Bit score of 894.6 for HMM based on sequences of FIGURE 7 of USSN 12/922,143.
  misc_feature (205)..(467): Pfam Name: p450 Pfam Description: Cytochrome P450
  misc_feature (1)..(472): Functional Homolog Of Ceres SEEDLINE ID no. ME06336
MAFTAFLLLLSSIAAGFLLLLRRTRYRRMGLPPGSLGLPLIGETFQLIGAYKTENPEPFIDERVARYGSVFMTHLFGEPTIFSADPETNRFVLQNEGKLFECSYPASICNLLGKHSLLLMKGSLHKRMHSLTMSFANSSIIKDHLMLDIDRLVRFNLDSWSSRVLLMEEAKKITFELTVKQLMSFDPGEWSESLRKEYLLVIEGFFSLPLPLFSTTYRKAIQARRKVAEALTVVVMKRREEEEEGAERKKDMLAALLAADDGFSDEEIVDFLVALLVAGYETTSTIMTLAVKFLTETPLALAQLKEEHEKIRAMKSDSYSLEWSDYKSMPFTQCVVNETLRVANIIGGVFRRAMTDVEIKGYKIPKGWKVFSSFRAVHLDPNHFKDARTFNPWRWQSNSVTTGPSNVFTPFGGGPRLCPGYELARVALSVFLHRLVTGFSWVPAEQDKLVFFPTTRTQKRYPIFVKRRDFAT

SEQ ID NO: 4011 - DNA, 1649 bp, Arabidopsis thaliana
  misc_feature (1)..(1649): useful for making plants with increased salt and oxidative stress resistance as described in USSN 12/922,143
  misc_feature (1)..(1649): Ceres CLONE ID no.36334
tccattaatactctctctccctcatcctctcttcttctctcatcatcatcttcttcttcaatggccttcaccgcttttctcctcctcctctcttccatcgccgccggcttcctcctcctactccgccgtacacgttaccgtcggatgggtcttcctccgggaagccttggtctccctctgataggagagacttttcagctgatcggagcttacaaaacagagaaccctgagcctttcatcgacgagagagtagcccggtacggttcggttttcatgacgcatctttttggtgaaccgacgattttctcagctgacccggaaacgaaccggtttgttcttcagaacgaagggaagctttttgagtgttcttatcctgcttccatttgtaaccttttggggaaacactctctgcttcttatgaaaggttctttgcataaacgtatgcactctctcaccatgagctttgctaattcttcaatcattaaagaccatctcatgcttgatattgaccggttagtccggtttaatcttgattcttggtcctctcgtgttctcctcatggaagaagccaaaaagataacgtttgagctaacggtgaagcagttgatgagctttgatccaggggaatggagtgagagtttaaggaaagagtatcttcttgtcatcgaaggcttcttctctcttcctctccctctcttctccaccacttaccgcaaagccatccaagcgcggaggaaggtggcggaggcgttgacggtggtggtgatgaaaaggagggaggaggaggaagaaggagcggagagaaagaaagatatgcttgcggcgttgcttgcggcggatgatggattttccgatgaagagattgttgacttcttggtggctttacttgtcgccggttatgaaacaacctccacgatcatgactctcgccgtcaaatttctcaccgagactcctttagctcttgctcaactcaaggaagagcatgaaaagattagggcaatgaagagtgattcgtatagtcttgaatggagtgattacaagtcaatgccattcacacaatgtgtggttaatgagacgctacgagtggctaacatcatcggcggtgttttcagacgtgcaatgacggatgttgagatcaaaggttataaaattccaaaagggtggaaagtattctcatcgtttagagcggttcatttagacccaaaccacttcaaagatgctcgcactttcaacccttggagatggcagagcaactcggtaacgacaggcccttctaatgtgttcacaccgtttggtggagggccaaggctatgtcccggttacgagctggctagggttgcactctctgttttccttcaccgcctagtgacaggcttcagttgggttcctgcagagcaagacaagctggttttctttccaactacaagaacgcagaaacggtacccgatcttcgtgaagcgccgtgattttgctacttgaagaagaagagacccatctgattttatttatagaacaacagtatttttcaggattaatttcttcttctttttttgcctccttgtgggtctagtgtttgacaataaaagttatcattactctataaagccttagcttctgtgtacataaaaaaaaaaaaacttttgtttacc

SEQ ID NO: 4012 - protein, 472 aa, Arabidopsis thaliana; identical to SEQ ID NO: 4010
  misc_feature (1)..(472): useful for making plants with increased salt and oxidative stress resistance as described in USSN 12/922,143
  misc_feature (1)..(472): Ceres CLONE ID no.36334
  misc_feature (1)..(472): Bit score of 894.6 for HMM based on sequences of FIGURE 7 of USSN 12/922,143.
  misc_feature (205)..(467): Pfam Name: p450 Pfam Description: Cytochrome P450
  misc_feature (1)..(472): Functional Homolog Of Ceres SEEDLINE ID no. ME06336

SEQ ID NO: 4013 - DNA, 1754 bp, Glycine max
  misc_feature (1)..(1754): useful for making plants with increased salt and oxidative stress resistance as described in USSN 12/922,143
  misc_feature (1)..(1754): Ceres CLONE ID no.690176
  misc_feature (1568)..(1568): m is a or c
  misc_feature (1622)..(1622): y is t/u or c
  misc_feature (1718)..(1718): k is g or t/u
  misc_feature (1726)..(1726): y is t/u or c
atatatacacacagtaccaaccactcttttttacttatggcatctttcatcttcacacctgtactctttcttcttatcatctccgccgtccttctcttcctccaccgccgatcccgctgccggcgcttccgcctaccgcctggtacactcgggctccccttcgtcggcgaaaccttacagctcatatcagcttacaagagtgacaacccggaacccttcatggaccagcgcgtgaaacggtacggtccaatcttcaccacccatgtgttcggcgaacccaccgtgttctcgaccgacccagaaacgaaccggttcattttgctcaacgaagggaagctcttcgaatgcagctaccccggttcgatatcgaacctccttgggaaacactctctgctcctcatgaaaggttctcttcacaagagaatgcactccctcactatgagcttcgccaactcctccatcatcaaggaccatttattggtcgacatagaccgcctcatccggctcaacttggattcctggtccgaccgggttcttctcatggaagaagccaagaagataacgtttgagttgacagtgaagcagctgatgagctttgatccaggtgaatggactgagacactaaggaaagagtacgtgcttgtgattgaaggatttttctcagttcccttgcctctcttctcaagtacctaccgtagagccatcaaggctaggacgaaggtggcagaggcattaacactggtagtgagggatagaagaaaagaaagcgtaacggaggagaaaaagaatgacatgctaggggcattgttggcctccggctaccacttttccgacgaggaaatagtcgattttatgttggctttgctcgtcgccggctatgaaaccacctctacaataatgactcttgccatcaagttcctcaccgagactcccttagcactggcacaactcaaggaagagcatgatcaaatcagagccaagaagagttgcccagaggcaccactggagtggacagattataagtcaatggcatttactcaatgtgttgtgaatgagactttaagggtggcaaacataattggtgcgatatttaggagagcaatgacagacatcaacataaaaggttacactattccaaagggatggagggtcgttgcttcatttcgtgcggtacatctaaaccctgaccatttcaaagatgcccgcaccttcaatccatggagatggcagagtaactcagaagcaagtagccctgggaatgtatataccccatttggaggagggccacgtctgtgtcctgggtatgagcttgccagagtggtgctctctgtcttccttcatcgcattgtcacccgttatagttggtttcctgcagaagaagataagttggtgttttttccaacgactaggacgcagaagaggtatcctatcatagtgaagcgtagagaggagtccaaactaagtaaatcgccatgagagacaccacacaaagaagaggaagaagagattgtagatgattttaatcattgtaatgtctaatgtattaagcaataatgaagtttcatccmctagtttagccgtttatattttatttattttagggggttataggaaggaatgtyttattagtagaccttaggaagggatgggaaatgaggatgtgaaagatcaaacccctcatcaccctaataaaacagttgagctaaatccacctgtgkatatgatyttaattaattcctacaaatcctttcacg

SEQ ID NO: 4014 - protein, 479 aa, Glycine max
  misc_feature (1)..(479): useful for making plants with increased salt and oxidative stress resistance as described in USSN 12/922,143
  misc_feature (1)..(479): Ceres CLONE ID no.690176
  misc_feature (1)..(479): Bit score of 894.7 for HMM based on sequences of FIGURE 7 of USSN 12/922,143.
  misc_feature (207)..(469): Pfam Name: p450 Pfam Description: Cytochrome P450
  misc_feature (1)..(479): Functional Homolog Of Ceres SEEDLINE ID no. ME06336
MASFIFTPVLFLLIISAVLLFLHRRSRCRRFRLPPGTLGLPFVGETLQLISAYKSDNPEPFMDQRVKRYGPIFTTHVFGEPTVFSTDPETNRFILLNEGKLFECSYPGSISNLLGKHSLLLMKGSLHKRMHSLTMSFANSSIIKDHLLVDIDRLIRLNLDSWSDRVLLMEEAKKITFELTVKQLMSFDPGEWTETLRKEYVLVIEGFFSVPLPLFSSTYRRAIKARTKVAEALTLVVRDRRKESVTEEKKNDMLGALLASGYHFSDEEIVDFMLALLVAGYETTSTIMTLAIKFLTETPLALAQLKEEHDQIRAKKSCPEAPLEWTDYKSMAFTQCVVNETLRVANIIGAIFRRAMTDINIKGYTIPKGWRVVASFRAVHLNPDHFKDARTFNPWRWQSNSEASSPGNVYTPFGGGPRLCPGYELARVVLSVFLHRIVTRYSWFPAEEDKLVFFPTTRTQKRYPIIVKRREESKLSKSP

SEQ ID NO: 4015 - DNA, 1663 bp, Glycine max
  misc_feature (1)..(1663): useful for making plants with increased salt and oxidative stress resistance as described in USSN 12/922,143
  misc_feature (1)..(1663): Ceres CLONE ID no.718939
aaacttcttttatttccttcttcttctcttctctgttacagcaatggcttctttgccaacacttctctcgttcgccgtcatcttcttcaccgtcgccctcttatacctccgccgcgtgttccgccgccgtcagttccgcctcccgccggggagccacggcctgccgttgatcggcgagacgctgcagctgatatcggcgtacaagagcgacaatccggagcctttcatcgacgagcgcgtggagcggtacggttcgatcttcacgacgcacgtgttcggcgagccgacggtgttctcggcggacccggaggtgaaccggttcattctgcagaacgaagggaagctgttggattgcagttatcccggttcgatatcgaacctgctcggaaaacactctcttctgttgatgaaaggtgctctccacaagagaatgcactctctcacaatgagcttcgccaactcctccatcatcaaggatcatcttcttcaccacatcgaccgcctcatctgcctcaacctcgatgcctggtccgacactgtctttctcatggatcaggcaaaaaagataacatttgagttaacggtgaagcagttgatgagctttgacccagatgaatggactgagaatctaaggaaagagtatgttcttgtgattgaaggattcttcactctcccttttcctctcttctccaccacataccgcagagccatcaaggcaagaacaaaggtggcagaggcactagcgttggtagtgaggcagaggagaaaagagtatggtgaaaacaaagagaaaaagagtgacatgcttggggcactgttggcctccggcgaccacctttccgacgaggaaatagtggattttttgttggctttgctcgtcgccggttacgaaaccacctctaccataatgactcttgcgatcaagttcctcactgagactcctctggccttggcacagctcaaggaagagcatgaccaaatcagagcaaagagtcacccaggggcaccactggaatggacggattacaagtcaatggcatttactcaatgtgttgtgaatgagaccttgagagtggcaaacataattggtgggatatttaggagagcaacgacagacatcaacataaaaggttacactattcctaagggatggaaagtctttgcatcatttcgtgctgtacatctgaatcctgaacattacaaagatgcccggtccttcaatccctggagatggcagagtaactcatcagaaacagcaaatcctgggaatgtttatacaccatttggaggagggccaaggttgtgccctggctatgagctagccagagttgtactgtctgtcttccttcaccgcattgttacccgcttcagttgggttcctgctgaggaagataagttggtgttttttccaactactaggacgcagaagaggtatcctattattgtgcagcgtagacattagagaggaatgaccatgtatagcaatatgaaaattaagagcacaacagatagagaagggaaaaaaggaagctgagtgtagatcagtttaataagttaattttcatcacatgtaaataaataataaaattcatatctccccgttcatatatcaattgtctctgcaatgctcaacaaccagaaaagttggcaagaattttaacgc

SEQ ID NO: 4016 - protein, 472 aa, Glycine max
  misc_feature (1)..(472): useful for making plants with increased salt and oxidative stress resistance as described in USSN 12/922,143
  misc_feature (1)..(472): Ceres CLONE ID no.718939
  misc_feature (1)..(472): Bit score of 866.5 for HMM based on sequences of FIGURE 7 of USSN 12/922,143.
  misc_feature (212)..(470): Pfam Name: p450 Pfam Description: Cytochrome P450
  misc_feature (1)..(472): Functional Homolog Of Ceres SEEDLINE ID no. ME06336
MASLPTLLSFAVIFFTVALLYLRRVFRRRQFRLPPGSHGLPLIGETLQLISAYKSDNPEPFIDERVERYGSIFTTHVFGEPTVFSADPEVNRFILQNEGKLLDCSYPGSISNLLGKHSLLLMKGALHKRMHSLTMSFANSSIIKDHLLHHIDRLICLNLDAWSDTVFLMDQAKKITFELTVKQLMSFDPDEWTENLRKEYVLVIEGFFTLPFPLFSTTYRRAIKARTKVAEALALVVRQRRKEYGENKEKKSDMLGALLASGDHLSDEEIVDFLLALLVAGYETTSTIMTLAIKFLTETPLALAQLKEEHDQIRAKSHPGAPLEWTDYKSMAFTQCVVNETLRVANIIGGIFRRATTDINIKGYTIPKGWKVFASFRAVHLNPEHYKDARSFNPWRWQSNSSETANPGNVYTPFGGGPRLCPGYELARVVLSVFLHRIVTRFSWVPAEEDKLVFFPTTRTQKRYPIIVQRRH

SEQ ID NO: 4017 - DNA, 1431 bp, Populus balsamifera subsp. trichocarpa
  misc_feature (1)..(1431): useful for making plants with increased salt and oxidative stress resistance as described in USSN 12/922,143
  misc_feature (1)..(1431): Ceres ANNOT ID no.1464715
atggcggttatttctctttatttggttttctttgtggttctcccggcgatagtccttatcgctcaccggagttcgcggtgccgacggctccggttgccgccggggagtttgggtctgccctttgttggggagactctacagttgatatctgcatacaagaccgagaaccctgaaccgtttatagatgagcgggtgagccggttcggttcgttgtttacgacccatgttttcggtgaacccactgttttttctgttgatccggaaacgaaccggttcatcatgcaaaatgaagggaagttgtttgagtgtagttacccgggttcgataagcaacttgctgggaaaacactccttgttgttgatgaagggcagtcttcacaaaagaatgcactctttgaccatgagttttgctaactcttcaatcattagagaccatcttctggttgatatagaccggttgatccgtctcaatttagattcctggtctgaccgggttcttctcatggaggaggccaagaagattacatttgagttgacaatgaagcagctaatgagctttgatccatgtgaatggaccgagagtctaagaaaagagtacgttcttgttattgaaggctttttcagtgtgccactacccatcttttcccccacttaccgcagagctatcaaagctaggactaaggtggcagaggctttgagcttggtagtgaagcaaaggaggatagagagtgagtcaggagagaaaaggaaggacatgctggcagctcttgtagcttcagatgatcatggcagcttctcggacgaggaaatagtggatttcttggtagctttgcttgtcgcaggctatgaaactacatctactagcatgactcttgctgtcaagttcctcactgagacacctctcgctttggctcagatcacggaggagcatgaacagattagagcaaagaagggtgagggggaagctcttgagtggagtgattacaagtcaatgaccttcactcaatgcgttgttaatgagacgctgagaatcgcgaacattataggtgggatatttagacgaacgatgacagatatcaatgtaaaaggctatacaattcctaaaggatggaaggtttttgcatcctttcgtggtgtgcatttagaccacgaatactttaaagatgctcggactttcaatccatggagatggcagaacaactcgggggcaacatgcccagcaaatgtgttcactccatttggaggagggcaacggctatgcccaggatatgagcttgctagagtagaactctctgttttccttcaccacctagtcacccgtttcagttggactccagctggagaagataagctggttttctttccaactacacggacacagaagcgatatcccatcaatgtgcagcgtcgagatcgtgtccaagccatgtaa

SEQ ID NO: 4018 - protein, 476 aa, Populus balsamifera subsp. trichocarpa
  misc_feature (1)..(476): useful for making plants with increased salt and oxidative stress resistance as described in USSN 12/922,143
  misc_feature (1)..(476): Ceres ANNOT ID no.1464715
  misc_feature (1)..(476): Bit score of 886.3 for HMM based on sequences of FIGURE 7 of USSN 12/922,143.
  misc_feature (206)..(467): Pfam Name: p450 Pfam Description: Cytochrome P450
  misc_feature (1)..(476): Functional Homolog Of Ceres SEEDLINE ID no. ME06336
MAVISLYLVFFVVLPAIVLIAHRSSRCRRLRLPPGSLGLPFVGETLQLISAYKTENPEPFIDERVSRFGSLFTTHVFGEPTVFSVDPETNRFIMQNEGKLFECSYPGSISNLLGKHSLLLMKGSLHKRMHSLTMSFANSSIIRDHLLVDIDRLIRLNLDSWSDRVLLMEEAKKITFELTMKQLMSFDPCEWTESLRKEYVLVIEGFFSVPLPIFSPTYRRAIKARTKVAEALSLVVKQRRIESESGEKRKDMLAALVASDDHGSFSDEEIVDFLVALLVAGYETTSTSMTLAVKFLTETPLALAQITEEHEQIRAKKGEGEALEWSDYKSMTFTQCVVNETLRIANIIGGIFRRTMTDINVKGYTIPKGWKVFASFRGVHLDHEYFKDARTFNPWRWQNNSGATCPANVFTPFGGGQRLCPGYELARVELSVFLHHLVTRFSWTPAGEDKLVFFPTTRTQKRYPINVQRRDRVQAM

SEQ ID NO: 4019 - DNA, 1606 bp, Glycine max
  misc_feature (1)..(1606): useful for making plants with increased salt and oxidative stress resistance as described in USSN 12/922,143
  misc_feature (1)..(1606): Ceres CLONE ID no.574698
atttaacttcttctcttctcttccctgttacagcaatggcttctttgccagctttgccaacactcctcctctcgttcgccgccatcttcttcaccgtcctcctcctcttcctccgccgccggcagctccgcctcccgccggggagctacggcttgccgttgatcggcgagacgctgcaactgatatcggcgtacaagagcgacaatccagagccgttcatcgacgagcgcgtggagcggtacgggtcgatcttcacgacgcacgtgttcggagaggcgacggtgttctcggcggatccggaggtgaaccggttcattctgcagaacgaagggaggctgttggattgcagctaccccggttcgatatcgaacctgctcggaaaacactctcttctgttgatgaaaggtggtctccacaagagaatgcactctctgacgatgagcttggccaattcctccatcatcaaggatcatcttcttcaccacatcgaccgcctcgtctgcctcaacttggacgcctggtccaaccgcgtctttcttatggaccaggcaaaaaagataacatttgagctaacggtgaagcagttgatgagctttgacccagatgaatggactgagaatctaagaaaagagtatgttcttgtgattgaaggattcttcactctcccttttcctctcttctccaccacataccgcagagccatcaaggcaagaacaaaggtggcagaggcactaacgttggtagtaaggcagaggagaaaagagtatgatgaagacaaagagaaaaagaatgacatgcttggggcactgttggcctccggcgaccacttttccgacgaggaaatagtggattttttgttggctttgctcgtcgccggttatgagaccacctctaccataatgactcttgcgatcaagttcctcactgagactcccctggccttggcacagctcaaggaagagcatgaccaaatcagagcaagaagtgacccagggacaccactggaatggaccgattacaagtcaatggcgtttactcaatgtgttgtgaatgagaccttgagagtggcaaacataattggtgggatttttaggagagcaaggacagacattgacataaaaggttacactattcctaagggatggaaagtctttgcatcatttcgtgctgtacatctgaatcctgaacattacaaagatgcccggtccttcaatccctggagatggcagagtaactcatcagaagcaacaaaccctggtaatgtttatacaccatttggaggagggccacggttgtgccctggctataagctagccagagttgtactttccgtcttccttcaccgcattgttacccgcttcagttgggttcctgctgaggaagataagttggtgtttttcccaactactaggacgcagaagaggtatccaattattgtgcagcgtagagactagagaggagtgcagaccatgtatagcaatatgaaaattaagagcccaacagatagagaagggccaaaaggaagatgagtgtagatcagtttaataagttaatgttcatcatatgtaaataaatgataaaattcatatctcccagttcatatatc

SEQ ID NO: 4020 - protein, 472 aa, Glycine max
  misc_feature (1)..(472): useful for making plants with increased salt and oxidative stress resistance as described in USSN 12/922,143
  misc_feature (1)..(472): Ceres CLONE ID no.574698
  misc_feature (1)..(472): Bit score of 858.6 for HMM based on sequences of FIGURE 7 of USSN 12/922,143.
  misc_feature (212)..(470): Pfam Name: p450 Pfam Description: Cytochrome P450
  misc_feature (1)..(472): Functional Homolog Of Ceres SEEDLINE ID no. ME06336
MASLPALPTLLLSFAAIFFTVLLLFLRRRQLRLPPGSYGLPLIGETLQLISAYKSDNPEPFIDERVERYGSIFTTHVFGEATVFSADPEVNRFILQNEGRLLDCSYPGSISNLLGKHSLLLMKGGLHKRMHSLTMSLANSSIIKDHLLHHIDRLVCLNLDAWSNRVFLMDQAKKITFELTVKQLMSFDPDEWTENLRKEYVLVIEGFFTLPFPLFSTTYRRAIKARTKVAEALTLVVRQRRKEYDEDKEKKNDMLGALLASGDHFSDEEIVDFLLALLVAGYETTSTIMTLAIKFLTETPLALAQLKEEHDQIRARSDPGTPLEWTDYKSMAFTQCVVNETLRVANIIGGIFRRARTDIDIKGYTIPKGWKVFASFRAVHLNPEHYKDARSFNPWRWQSNSSEATNPGNVYTPFGGGPRLCPGYKLARVVLSVFLHRIVTRFSWVPAEEDKLVFFPTTRTQKRYPIIVQRRD

SEQ ID NO: 4021 - DNA, 1419 bp, Populus balsamifera subsp. trichocarpa
  misc_feature (1)..(1419): useful for making plants with increased salt and oxidative stress resistance as described in USSN 12/922,143
  misc_feature (1)..(1419): Ceres ANNOT ID no.1511511
atggcggtttctgtttgtcttgttctctttattgttctcccagcgatagtctttatcgttcacaggagttcccggttccggaggctccggctgccgccggggagtttgggtctgccctttgttggagagactctacagctgatatctgcatacaagactgagaaccctgaaccgtttatagatgagcgggtgaaccggttcggttcgttgtttaaaacccatatttttggtgaaccgaccgttttttctgttgacccggaaacgaacaggttcattttgcaaaatgaagggaagctgtttgagtgtagttaccccggttcgataagcaacctgctgggaaaacattctttgttgctaatgacgggtaatcttcacaaaaaaatgcattccttaaccatgagtttcgctaactcttcaatcatcagagaccatctcttggtcgatatagaccggttgatccgtctcaatttagattcttggtccgaccgggttcttctcatggaggaggccaagaagactacatttgagttgacaatgaagcagctaatgagctttgatccatgtgaatggaccgagagtctgagaagagagtacgtgcttgttattgaaggctttttcagcgtgcctctacccatcctttcccccacataccgcagagctatcaaagctaggactaaggtggcagaggctttgagtttggtagtgaagcaaaggaggatagagagtgagtcaggagagaaaaagaaagacatgcttggagctcttttagcttcagatgatcatggaggcttctcggacgaggagatagtagatttcttggtggctctgcttgttgcaggctatgaaactacatctacaagcatgactcttgctgttaagttcctcaccgagacacctctggctctggctcagatcaaggaggagcatgaacagattagaggaaagaagggcgaggagggagctcttgagtggagtgattacaagtcaatgaccttcactcagtgtgttgttaatgagactttgagaatagcaaacataataggtgggatatttagacgaacaatgacagatataaatgttaaaggttatacaattcctaaaggatggaaggtttttgcatcctttcgtggtgtacatttagaccatgaatacttcaaagatgctcgaactttcaatccgtggagatggcaggacgactcgggggcaacatgcccagcaaatgtgttcactccttttggaggagggcaacggttatgcccaggatatgaacttgctagagtagaactctctgttttccttcaccacctggtcacccgtttcagttggaccccagctgaacaagacaagctggttttctttccaactacgcggacacaaaagcgatatcccatcaatgtgcagcgtcgaaatcgtgtctaa

SEQ ID NO: 4022 - protein, 472 aa, Populus balsamifera subsp. trichocarpa
  misc_feature (1)..(472): useful for making plants with increased salt and oxidative stress resistance as described in USSN 12/922,143
  misc_feature (1)..(472): Ceres ANNOT ID no.1511511
  misc_feature (1)..(472): Bit score of 879.3 for HMM based on sequences of FIGURE 7 of USSN 12/922,143.
  misc_feature (205)..(466): Pfam Name: p450 Pfam Description: Cytochrome P450
  misc_feature (1)..(472): Functional Homolog Of Ceres SEEDLINE ID no. ME06336
MAVSVCLVLFIVLPAIVFIVHRSSRFRRLRLPPGSLGLPFVGETLQLISAYKTENPEPFIDERVNRFGSLFKTHIFGEPTVFSVDPETNRFILQNEGKLFECSYPGSISNLLGKHSLLLMTGNLHKKMHSLTMSFANSSIIRDHLLVDIDRLIRLNLDSWSDRVLLMEEAKKTTFELTMKQLMSFDPCEWTESLRREYVLVIEGFFSVPLPILSPTYRRAIKARTKVAEALSLVVKQRRIESESGEKKKDMLGALLASDDHGGFSDEEIVDFLVALLVAGYETTSTSMTLAVKFLTETPLALAQIKEEHEQIRGKKGEEGALEWSDYKSMTFTQCVVNETLRIANIIGGIFRRTMTDINVKGYTIPKGWKVFASFRGVHLDHEYFKDARTFNPWRWQDDSGATCPANVFTPFGGGQRLCPGYELARVELSVFLHHLVTRFSWTPAEQDKLVFFPTTRTQKRYPINVQRRNRV

SEQ ID NO: 4023 - protein, 473 aa, Citrus sinensis
  misc_feature (1)..(473): useful for making plants with increased salt and oxidative stress resistance as described in USSN 12/922,143
  misc_feature (1)..(473): Public GI ID no.70609692
  misc_feature (1)..(473): Bit score of 898.5 for HMM based on sequences of FIGURE 7 of USSN 12/922,143.
  misc_feature (213)..(469): Pfam Name: p450 Pfam Description: Cytochrome P450
  misc_feature (1)..(473): Functional Homolog Of Ceres SEEDLINE ID no. ME06336
MAGLTLVYDLVLYISISTVIFFIIKRSRSRRLRLPPGSLGLPFLGETLQLIAAYKTENPEPFIDVRVKRFGSIFTTHIFGEPTVFSADPETNRFILQNEGKSFECSYPGSVSNLLGKHSLLLMKGSLHKRMHSLTMTFANSSIIRDHLLVVIDRLVRLHMDSWTDRVLLMEEAKKITFELTVKQLMSFDPNEWTESLRKEYVLVIEGFFTVPLPIFSTTYRRAIQARTKVAEALSLVVRQRRKESEPGERKNDMLEALLAGDDGFSDEEIVDFLVALLVAGYETTSTIMTLAVKFLTETPLALAQLKEEHDEIRAKKSKQEPLEWNDYKSMPFTQCVVNETLRVANIISGVFRRAMTDINIKGYTIPKGWRVFASFRAVHLDHDHFKDARSFNPWRWQNNSGATSPVNVSTSFGGGPRLCPGYELARVELSVFLHHLVTRFSWVPAEQDKLVFFPTTRTQKRNPIIVQRRNEN

SEQ ID NO: 4024 - protein, 474 aa, Vigna radiata
  misc_feature (1)..(474): useful for making plants with increased salt and oxidative stress resistance as described in USSN 12/922,143
  misc_feature (1)..(474): Public GI ID no.9587211
  misc_feature (1)..(474): Bit score of 857.5 for HMM based on sequences of FIGURE 7 of USSN 12/922,143.
  misc_feature (210)..(468): Pfam Name: p450 Pfam Description: Cytochrome P450
  misc_feature (1)..(474): Functional Homolog Of Ceres SEEDLINE ID no. ME06336
MVSLPTLLLLFAASAAAIFLHRAFSRRKFRLPPGSYGLPFIGETLQLISAYKSSNPEPFMDERVRRYGSIFMTHVFGEPTVFSADPELNRFILQNEGKLLDCSYPGSISNLLGKHSLLLMKGALHKRMHSLTMSFANSSIIKDHLLHHIDRLIGLNLDTWSDRVTLMDQAKKITFELTVKQLMSFDPDEWTESLRKEYVLVIEGFFTLPLPLFSTTYRRAIKARTKVAEALTLVVRQRREEYNQGKEKKSDMLGALLASGDHFSDDQIVDFLLALLVAGYETTSTIMTLAVKFLTETPLALAQLKEEHDQIRARSDPGAPLEWTDYKSMVFTQHVVNETLRVANIIGGIFRRATTDIDIKGYTIPKGWKVFASFRAVHLNPEYYKDARTFNPWRWQSNSSEAANPANVYTPFGGGPRLCPGYELARVVLSVFLHRIVTRFSWVPAEEDKLVFFPTTRTQKRYPIIVKRRNANHV

SEQ ID NO: 4025 - protein, 503 aa, Oryza sativa subsp. indica
  misc_feature (1)..(503): useful for making plants with increased salt and oxidative stress resistance as described in USSN 12/922,143
  misc_feature (1)..(503): Public GI ID no.125551173
  misc_feature (1)..(503): Bit score of 765.8 for HMM based on sequences of FIGURE 7 of USSN 12/922,143.
  misc_feature (348)..(501): Pfam Name: p450 Pfam Description: Cytochrome P450
  misc_feature (1)..(503): Functional Homolog Of Ceres SEEDLINE ID no. ME06336
MQPLAAGGAVSWPLYAATVAAALLVTAIVLRLAARSTAAACKARPPAGSLGWPLVGETLQFISAAYSSRPESFVEKRCRRYGKVFRSHLWGSPAVVSADAEASRAVLQSDASAFVPWYPRSLMELMGESSILVLGGALQRRVHGLAGAFFKSPELKARVTADMRSRLAAAMDAWRATAATGAGAAVRVQDEAKSIVFEILVRALIGLEQGQEMNYLRQQFHIFIAGLISLPIKLPGTQLYRSLKAKKRMTSLIQNIIQEKRRRIFEGKDLCAVSRDLIDVLMSNGSDELSLTDELISDNMIDFMIPAEDSVPVLITLAIKYLSECPLALQQLEEENMELKRQKSDVGETLEWTDYMSLTFTQHVITETLRIGNIISGIMRKAVRDVEVKGQGDVVIPKGWCVLVYFRSVHLDANIYDDPYAFNPWRWKERDMAAATTNSGSGFTPFGGGQRLCPGLDLARLQTSIFLHHLVTNFTWVAQGDVVVNFPTVRLKRGMPIKVTPKT

SEQ ID NO: 4026 - protein, 503 aa, Oryza sativa subsp. japonica
  misc_feature (1)..(503): useful for making plants with increased salt and oxidative stress resistance as described in USSN 12/922,143
  misc_feature (1)..(503): Public GI ID no.48475241
  misc_feature (1)..(503): Bit score of 766.2 for HMM based on sequences of FIGURE 7 of USSN 12/922,143.
  misc_feature (348)..(501): Pfam Name: p450 Pfam Description: Cytochrome P450
  misc_feature (1)..(503): Functional Homolog Of Ceres SEEDLINE ID no. ME06336
MQPLAAGGGVSWPLYAATVAAALLVTAIVLRLAARSTAAACKARPPAGSLGWPLVGETLQFISAAYSSRPESFVEKRCRRYGKVFRSHLWGSPAVVSADAEASRAVLQSDASAFVPWYPRSLMELMGESSILVLGGALQRRVHGLAGAFFKSPELKARVTADMRSRLAAAMDAWRATAATGAGAAVRVQDEAKLIVFEILVRALIGLEQGQEMNYLRQQFHIFIAGLISLPIKLPGTQLYRSLKAKKRMTSLIQNIIQEKRRRIFEGKDLCAVSRDLIDVLMSNGSDELSLTDELISDNMIDFMIPAEDSVPVLITLAIKYLSECPLALQQLEEENMELKRQKSDVGETLEWTDYMSLTFTQHVITETLRIGNIISGIMRKAVRDVEVKGQGDVVIPKGWCVLVYFRSVHLDANIYDDPYAFNPWRWKERDMAAATANSGSGFTPFGGGQRLCPGLDLARLQTSIFLHHLVTNFTWVAQGDVVVNFPTVRLKRGMPIKVTPKT

SEQ ID NO: 4027 - protein, 473 aa, Artemisia annua
  misc_feature (1)..(473): useful for making plants with increased salt and oxidative stress resistance as described in USSN 12/922,143
  misc_feature (1)..(473): Public GI ID no.86279652
  misc_feature (1)..(473): Bit score of 823.4 for HMM based on sequences of FIGURE 7 of USSN 12/922,143.
  misc_feature (213)..(466): Pfam Name: p450 Pfam Description: Cytochrome P450
  misc_feature (1)..(473): Functional Homolog Of Ceres SEEDLINE ID no. ME06336
  misc_feature (68)..(68): Xaa is any aa, unknown or other
MELYTTSLLFIVSFSTIIFLLFRRNSAFWRSINTPPGSTGLPLIGETFQIISAYKTENPEPFIDARVXKYGSVFTTHVFGERTVFSADVEINKFILQNEGRLFESSYPGSIANLVGKHSLLLMRGGLHRRMHSLTMSFANSTIIKDHLLADIDRLVRLNLDSWTGRILLMDEAKKITFELTLKQLLSIEPCEWSENLRKEYMLVIEGFFCIPLPFFSLTYRRAIQARKRVTEALHLVVRERRIEREKGVKKNDMLAALFDSDGDEENFYDDEIVDFLVSLLVAGYDTTSTTMTLAVKYLTDTPSALAQLKEEHDAIRAKKGASVALEWDDYKSMPFTQCVVNETLRLSNIISGVFRRAITDVKIKDYTIPKGAKVFTSLRAVHLDQDNFEDARVFNPWRWQKTSDSASFMPFGGGPRRCPGHELARVALSVFLHHLITHFSWKPAEEDKVVFFPTTRTQKRYPIIVEQRNVVG

SEQ ID NO: 4028 - DNA, 1976 bp, Triticum aestivum
  misc_feature (1)..(1976): useful for making plants with increased salt and oxidative stress resistance as described in USSN 12/922,143
  misc_feature (1)..(1976): Ceres CLONE ID no.568563
ctctcgtagtcgcgtatctccacctccactacaccacaccatcagaagcccggccggcacggtcggtgcaaggatagctgcagacacacgcccacacagacacggtgtgacagcaattgccaccggcgatgtccgtttcttggccggcgccgtcgacgtgcgcggccgccggggccctgctggccgccgcatggctgctgtgcttcaggctgctcccggccgcggccaggccgagaaggcgggcgatgaagacagaggcgcagctccctcccggcagcttcgggtggccggtcgtcggcgagacgctggacttcgtctcctgcgcctactccccgcgccccgaggcgttcgtggacaagcgccgcctccggtacggcggcgcggtgttccggtcgcacctgttcgggtcggcgacggtggtgacggcggacgcggaggtgaaccggttcgtgctgcagagcgacgcgcggtcgttcgtgccgtggtacccgcggtcgctgacggagctcatgggcaagtcctccatcctgctcatcaacggcagcctgcagcgccgcgtccacggcctcgtcggcgccttcttcaagtcgccgcagctcaaggcgcaggtcaccgccgacatgcagcgccgcctcgcccccgcgctcgcctcctggcgccaccagggccccggcgcccgcctccgcatccaggaccacgccaagacgatagtgttcccgatcctggtgcggggtctgatcgggctggaggcaggcccagagatgcagcagctcaagcagcaattccaggaatttattgtcggactcatgtcccttcccattaagctgccagggactaggctctacagatccctccaggccaagaagaggatggccagggtgatacagaggatcatacaggagaagaggaggaggagggccctcgacggcggcggcgggccgagggacgccatcgacgtgctcatgggcgacggcagcgaggagctcaccgacgagctcatatccgacaacatgatcgacttcatgatccccgccgaggactccgtgccagtgctcatcacgctcgccgtcaagttcctcagcgagtgccccctcgccctgcagcagctcgaggaggagaacatggagctcaagatgaggaaaaccgacctgggtgaaaccttgcaatggactgactacatgtccttgtcattcacgcagcatgtgataacggagacgctgcggatcgggaacatcatcagcgggatcatgcgcaaggcggtccgcgacgtcgaggtgaaggggcatctcatccccaaaggatggcgcgtgttcatgtacttccggtcggtccacctcgacgacatgctctacgaggatccctgcaagttcaatccatggaggtggaaggagaaggacatgagcactagcagcttcaccccttttggcggtgggcagaggctgtgcccgggcctggatctggccaggctggaagcttccatctttctccaccacttggtcaccagcttcaggtgggtggccgaggaggaccacatcgtcaacttccccaccgtgcgcctcaagggaggcatgcccatcagggtcaccgccaaagactagctgcctgtcaatcagacggtcgtccttgatcaactccccgcagcagccaagccagccatgcatatacatgatgctgctgctgcaagtatggtatcttccatagcaaggttgaaaggatccttaaaacaagctagctaggcaacatctgatctgagagtacatagttatgggcatgcatgtataagtgttgtagggaagggttaattagccatggagtaggtgccactcatcaccgtggctcgttaatcatagccgaggaagaagactctgaccgatgatgcatgctgttatactagtataagtagtatagtgcttatgtcacaaggaatagatatctcatccctgtacatggaagaactttgccatctggtctgctcc

SEQ ID NO: 4029 - protein, 489 aa, Triticum aestivum
  misc_feature (1)..(489): useful for making plants with increased salt and oxidative stress resistance as described in USSN 12/922,143
  misc_feature (1)..(489): Ceres CLONE ID no.568563
  misc_feature (1)..(489): Bit score of 915.0 for HMM based on sequences of FIGURE 7 of USSN 12/922,143.
  misc_feature (343)..(462): Pfam Name: p450 Pfam Description: Cytochrome P450
  misc_feature (1)..(489): Functional Homolog Of Ceres SEEDLINE ID no. ME06336
MSVSWPAPSTCAAAGALLAAAWLLCFRLLPAAARPRRRAMKTEAQLPPGSFGWPVVGETLDFVSCAYSPRPEAFVDKRRLRYGGAVFRSHLFGSATVVTADAEVNRFVLQSDARSFVPWYPRSLTELMGKSSILLINGSLQRRVHGLVGAFFKSPQLKAQVTADMQRRLAPALASWRHQGPGARLRIQDHAKTIVFPILVRGLIGLEAGPEMQQLKQQFQEFIVGLMSLPIKLPGTRLYRSLQAKKRMARVIQRIIQEKRRRRALDGGGGPRDAIDVLMGDGSEELTDELISDNMIDFMIPAEDSVPVLITLAVKFLSECPLALQQLEEENMELKMRKTDLGETLQWTDYMSLSFTQHVITETLRIGNIISGIMRKAVRDVEVKGHLIPKGWRVFMYFRSVHLDDMLYEDPCKFNPWRWKEKDMSTSSFTPFGGGQRLCPGLDLARLEASIFLHHLVTSFRWVAEEDHIVNFPTVRLKGGMPIRVTAKD

SEQ ID NO: 4030 - DNA, 1952 bp, Zea mays
  misc_feature (1)..(1952): useful for making plants with increased salt and oxidative stress resistance as described in USSN 12/922,143
  misc_feature (1)..(1952): Ceres CLONE ID no.1697472
aatagccggccggacgccactctatcccggccgtcggccgcggttcaggctctccttccattagaagcactcttctagtttagactttataatagaggcgctgaggcctcacccttttccctggtgttgcaagttgcaacacacagcgtccggcgagatcggcgatcagaaaccacgagcccacccaccatccggaacgcgcgcgcgatgtgtcccgtcagaggcggtggttgttcttggccagcgtccgtcgtcggctctgtcacggcggcgctgctcctcgccgccgtcatcgtgcggctcttcgtcccccgtgcctgttcttcaggaattatcaaggggcggcggcaggtaggtgctggtgctgccggaggagcacggctccctgccggctcgctcgggtggccgctcctcggcgagacgctggcgttcatccgggccgcgtactcccctcgcccggagtccttcgtcgagaaacgccgcgtcttgtacgggaaggtgttcaagtcgcacctgtgggggtcgccggcggtggtgagctcggacccggaggtgagccgcgcggtgctgcaggccgacgcgtcggcgttcgttccatggtacccgcgatcgctcatggagctgatggggcaatcgtccatcctagtgctcggcggcggcctccagcgccgggtgcacggcctcgcgggcgccttcttcaagtcgccgcagctcaaggcgcaggtcaccctggacatgcagcgccgcgtcggccgcgccatggacatgtggggcaggcggcgccatcggagcatgggcgacgacgacagcggtggtatgcccgtgcgtgtgcagaacgaggccaagtcgattgtgttcgaaatcctagtgagggcgctgatagggttagaggaaggggacaagatgcagtacctcaggcaacagtttcaagaattcattgctggtttgatatcacttcctgttaagcttccggggactcaactctatagatccctcaaggctaagaagaggatgacaaagttgataaaaacgatcatccaagagaagaggaagaagatgatgtcggaaggaggcgacgatctgcgtggtgggactcatccacgtgatatgatcgacgtcctgctaggcaacggcaacgacgagctcaccgacgagctgatatctgacaacatgatcgacttcatgatccctgcagaggactccgtgccggtgctcatcacgctggccgtcaagtacatcagcgaatgcccactggctctgcagcaactcgaggaggagaacatggagctcaagaggcagaaatcaggcgcgggagaaaccctagaatggacagactacatgtcgctcgccttcacacagcacgtgatcacggagacgctgcggatgggcaacatcatcaacgggatcatgcggaaggcggtgcgagacgtggaggtgagaggccacctggtccccaagggctggcgcgtcctcgtctacttccgcgccgtccacctcgacgccgccgtccacgacgacccgcacgccttcaacccctggaggtggaaggagaggcccgacgtcgtggccatgagcggcttcaccccgttcggcggcggccagaggctgtgccctgggctcgacctggcaaggctcgaggcctccatctttctgcaccatctcgtcaccaatttcaggtgggtggcggaggaggacaccgtcgtcaacttccccacggtgcggctcaagcgagggatgccaatcgcagtgacgcccagaacctgctgaacgcaacgcaacttgccaggcaaaaccatactatacatttatactccgtaatcaactaaagaggtgtgagaaataatacagtaaatgcatgcatgtaatggagggcgaaattaaaagttggcacggcaaagaagctgctggtatgccaaaagttcagtttgcaaattatatagtttaattactat

SEQ ID NO: 4031 - protein, 519 aa, Zea mays
  misc_feature (1)..(519): useful for making plants with increased salt and oxidative stress resistance as described in USSN 12/922,143
  misc_feature (1)..(519): Ceres CLONE ID no.1697472
  misc_feature (1)..(519): Bit score of 765.2 for HMM based on sequences of FIGURE 7 of USSN 12/922,143.
  misc_feature (367)..(491): Pfam Name: p450 Pfam Description: Cytochrome P450
  misc_feature (1)..(519): Functional Homolog Of Ceres SEEDLINE ID no. ME06336
MCPVRGGGCSWPASVVGSVTAALLLAAVIVRLFVPRACSSGIIKGRRQVGAGAAGGARLPAGSLGWPLLGETLAFIRAAYSPRPESFVEKRRVLYGKVFKSHLWGSPAVVSSDPEVSRAVLQADASAFVPWYPRSLMELMGQSSILVLGGGLQRRVHGLAGAFFKSPQLKAQVTLDMQRRVGRAMDMWGRRRHRSMGDDDSGGMPVRVQNEAKSIVFEILVRALIGLEEGDKMQYLRQQFQEFIAGLISLPVKLPGTQLYRSLKAKKRMTKLIKTIIQEKRKKMMSEGGDDLRGGTHPRDMIDVLLGNGNDELTDELISDNMIDFMIPAEDSVPVLITLAVKYISECPLALQQLEEENMELKRQKSGAGETLEWTDYMSLAFTQHVITETLRMGNIINGIMRKAVRDVEVRGHLVPKGWRVLVYFRAVHLDAAVHDDPHAFNPWRWKERPDVVAMSGFTPFGGGQRLCPGLDLARLEASIFLHHLVTNFRWVAEEDTVVNFPTVRLKRGMPIAVTPRTC

SEQ ID NO: 4032 - DNA, 1981 bp, Triticum aestivum
  misc_feature (1)..(1981): useful for making plants with increased salt and oxidative stress resistance as described in USSN 12/922,143
  misc_feature (1)..(1981): Ceres CLONE ID no.912067
gtagtcgcgtgcctccacctccactacaccgcaccgcgccatcagaaggccggccgggtcggtcggtgcaaggatattgcacacacacgctcgcagacacggtgtgacagcaattgcctccggcgatgtccgtttcttggccggcgccgtcgacgtgcgcggccgccggggccctcctggccgccgcgtggctgctgtgcttcaggctgttcccggccgtggcgaggccgagaaggcgggcgatgaagacgggggcgcagctccctcccggcatcttcgggtggccggtcgtcggcgagacgctggacttcgtctcctgcgcctactccccacgccccgaggcgttcgttgacaagcgccgcctccggtacggcagcgcggtgttccggtcgcacctgttcgggtcggcgacggtagtgacggcggacgcggaggtgaaccggttcgtgctgcagagcgacgcgcggtcgttcgtaccgtggtacccgcggtcgctgacggagctcatgggcaagtcctccatcctcgtcatcaacggcagcctgcagcgccgcgtccacggcctcgtcggcgccttcttcaagtcgccgcagctcaaggcgcaggtcaccgccgacatgcagcgccgcctcgccccggcgctcgccgcctggcgcgagcagggccccggcgcgcgcctccgcatccaggaccacgccaagacgattgtgttccagatcctggtgcgggctctgatcgggctggaggcaggcccagagatgcagcagctcaagcagcaattccaggaatttattgtcggactcatgtcccttcccattaagctgccagggactaggctctacagatccctccaggccaagaagaggatggcgagggtcgtacagaggatcatacaggagaagaggaggaggagggccctggacggcggcggcgcgccgagagacgccatcgacgtgctcatgggcgacggcagtgaggagctcaccgacgagctcatatccgacaacatgatcgacttcatgatccccgccgaggactccgtgccggtgctcatcacgctcgccgtcaagttcctcagcgagtgccccctcgccttgcaacagcttgaggaggagaacatgcagctcaagatgagaaaaaccgacctgggtgaaaccttgcaatggactgactacatgtccttgtcattcacgcagcatgtgataacggagacgctgcggattgggaatatcatcagtgggatcatgcgcaaggcggtccgcgacgtcgaagtgaaggggcatctcatccccaaaggatggcgtgtgttcatgtacttccggtcggtccacctcgacgacatgctctacgaggatccctgcaagttcaatccatggaggtggaagtgtgtcaatcaacaggagaaggacatgagcactagcagcttcaccccttttggtggtgggcagaggctgtgcccgggcctggatctggccaggctggaagcttccatctttctccaccacttggtcaccagcttcaggtgggtggccgaggaggaccacatcgtcaacttccccaccgtgcgcctcaagggaggcatgcccatcagggtcaccgccaaagactagctacccgttactcggaccatcgtccttgatcaactccccgcagcagccaagccagccaaaggctcaagttacatgtgcatatacataatgctactgctacaagtatgtggtgttatccatagcaaggttaaaagccccttcaaggagtaagctagctaggcaacatctgatgtgagtacataggggggtatgttgaagtgttgtaggggagcttaattagccaaggagtagtaggtgccactgatgatcactgtggctcgttaatcatagccgagggagactctgaccgatgatgcatgctgttatagtagtataagtagtagtatagtgctggtgtcacaaggaatagatatatcatctatgtatacatg

SEQ ID NO: 4033 - protein, 494 aa, Triticum aestivum
  misc_feature (1)..(494): useful for making plants with increased salt and oxidative stress resistance as described in USSN 12/922,143
  misc_feature (1)..(494): Ceres CLONE ID no.912067
  misc_feature (1)..(494): Bit score of 902.8 for HMM based on sequences of FIGURE 7 of USSN 12/922,143.
  misc_feature (343)..(467): Pfam Name: p450 Pfam Description: Cytochrome P450
  misc_feature (1)..(494): Functional Homolog Of Ceres SEEDLINE ID no. ME06336
MSVSWPAPSTCAAAGALLAAAWLLCFRLFPAVARPRRRAMKTGAQLPPGIFGWPVVGETLDFVSCAYSPRPEAFVDKRRLRYGSAVFRSHLFGSATVVTADAEVNRFVLQSDARSFVPWYPRSLTELMGKSSILVINGSLQRRVHGLVGAFFKSPQLKAQVTADMQRRLAPALAAWREQGPGARLRIQDHAKTIVFQILVRALIGLEAGPEMQQLKQQFQEFIVGLMSLPIKLPGTRLYRSLQAKKRMARVVQRIIQEKRRRRALDGGGAPRDAIDVLMGDGSEELTDELISDNMIDFMIPAEDSVPVLITLAVKFLSECPLALQQLEEENMQLKMRKTDLGETLQWTDYMSLSFTQHVITETLRIGNIISGIMRKAVRDVEVKGHLIPKGWRVFMYFRSVHLDDMLYEDPCKFNPWRWKCVNQQEKDMSTSSFTPFGGGQRLCPGLDLARLEASIFLHHLVTSFRWVAEEDHIVNFPTVRLKGGMPIRVTAKD

SEQ ID NO: 4034 - protein, 481 aa, Pinus taeda
  misc_feature (1)..(481): useful for making plants with increased salt and oxidative stress resistance as described in USSN 12/922,143
  misc_feature (1)..(481): Public GI ID no.59800264
  misc_feature (1)..(481): Bit score of 535.5 for HMM based on sequences of FIGURE 7 of USSN 12/922,143.
  misc_feature (229)..(454): Pfam Name: p450 Pfam Description: Cytochrome P450
  misc_feature (1)..(481): Functional Homolog Of Ceres SEEDLINE ID no. ME06336
MADQISLLLVVFTAAVALLHLIYRWWNAQRGQKRTSNEKNQELHLPPGSTGWPLIGETYSYYRSMTSNRPRQFIDDREKRYDSDVFVSHLFGSQAVISSDPQFNKYVLQNEGRFFQAHYPKALKALIGDYGLLSVHGDLQRKLHGIAVNLLRFERLKFDFMEEIQNLVHSTLDRWVDKKEIALQNECHQMVLNLMAKQLLDLSPSKETNEICELFVDYTNAVIAIPIKIPGSTYAKGLKARELLIRKISNMIKERRDHPHIVHKDLLTKLLEEDSISDEIICDFILFLLFAGHETSSRAMTFAIKFLTTCPKALTQMKEEHDAILKAKGGHKKLEWDDYKSMKFTQCVINETLRLGNFGPGVFRETKEDTKVKDCLIPKGWVVFAFLTATHLDEKFHNEALTFNPWRWELDQDVSNNHLFSPFGGGARLCPGSHLARLELALFLHIFITRFRWEALADEHPSYFPLPYLAKGFPMRLYNRE

SEQ ID NO: 4035 - DNA, 1847 bp, Panicum virgatum
  misc_feature (1)..(1847): useful for making plants with increased salt and oxidative stress resistance as described in USSN 12/922,143
  misc_feature (1)..(1847): Ceres CLONE ID no.1806872
caccacaacctgatactcctctcgcaacaaatccgcggcgccgatcagcgatcggagctgaagcaccatcatccggcgcgcgtgatgtggcccggggacggtccttggccggcgtccgccgtcacggcggcggcgctgctcgtcgccgctgtcatcatcgtgcggcggctcttcatccctcgcctgtggccgtcgtcagggtcagggaccgagcgacggggggcggcgagcggcggcgcgtccggatcggcgcgtctccccgcgggctcgctcgggtggccgctcctcggcgagacgccggcgttcatcctcgcggcgtactccgcccgcccggagtccttcgtcgagcggcggcggctcctgtacgggaaggtgttcgcgtcgcacctgtggggctccccggcggtggtgagctcggacccggaggtgagccgcgcggtgctgcaggccgacgcgtcggcgttcgtaccgtggtacccgcgctcgctcatggagctcatggggcggtcctccatcctggtgctcggcggcgggctccagcgccgggtgcacggcctcgccggcgccttcttcaagtcgccgcacctcaaggcccgggtcaccgccgacatgcgccgccgcgtcgcccgcgccatggccgcgtggcagcgccgcggcgcgcccgtcgtgcgcgtccaggacgaggccaagtcgattgtgtttgaaatcctggtgagggcgctgatagggctagacgaaggacacgaaatgcagtacctcaggcaacagttcaaagaattcattgccggtctgatatcacttccggttaaacttcccgggactcagctctacagatccctcaaggctaagaagaggatgacaacgttgatccaaaagatcatccaggagaagaggaagagaaggatcgccgccgggtgcgatgaggatccgcatgatgggacgactcatcatccgcgcaacatgatcgacgtgctgctgggcaatggcagcgacgagctcaccgacgagctgatatccgacaacatgatcgacttcatgatccctgcggaggactcggtgccggtgctcatcacgctggccgtcaagtacctcagcgagtgcccaccggctctacagcagctggaggaggagaacatggagctgaagaggcggaaatcaggcgctggagaaaccctagaatggacagactacatgtcgctcaccttcacacagcacgtgatcacggagacgctgcggatggggaacatcatcaacgggatcatgcgcaaggcggtgcgggacgtggaggtgagaggccacctcatccccaagggctggcgcgtcctcgtctacttccgcgccgtccacctcgacgccgccgtccacgacgacccgcacgccttcaacccatggaggtggaaggacagggccgacgtgatgaccggcggcggcggcgggggcttcacccccttcggcggcgggcagaggctctgcccggggctggacctcgccaggctcgaggcctccatcttcctgcaccatctcgtcaccaacttcaggtgggtggcggaggaggacgccgtcgtcaacttccccacggtgcggctccggcgagggatgccaatcgcagtcacgcccagaacgtgaacacaggttgccttccgcgcgcgtcgaccatctgtcaagtgtttgactagaatagtttccttcttcaaattaagcagaaaaatttaagaaaactcatactgtacatgcaaccgtgcatttgatgagtgcagacttgagatgcatggttttatacctgatgagttgtactcgaatcgttgtacgttacgcaactgaattaaatatatacagagaatttttac

SEQ ID NO: 4036 - protein, 513 aa, Panicum virgatum
  misc_feature (1)..(513): useful for making plants with increased salt and oxidative stress resistance as described in USSN 12/922,143
  misc_feature (1)..(513): Ceres CLONE ID no.1806872
  misc_feature (1)..(513): Bit score of 752.7 for HMM based on sequences of FIGURE 7 of USSN 12/922,143.
  misc_feature (359)..(486): Pfam Name: p450 Pfam Description: Cytochrome P450
  misc_feature (1)..(513): Functional Homolog Of Ceres SEEDLINE ID no. ME06336
MWPGDGPWPASAVTAAALLVAAVIIVRRLFIPRLWPSSGSGTERRGAASGGASGSARLPAGSLGWPLLGETPAFILAAYSARPESFVERRRLLYGKVFASHLWGSPAVVSSDPEVSRAVLQADASAFVPWYPRSLMELMGRSSILVLGGGLQRRVHGLAGAFFKSPHLKARVTADMRRRVARAMAAWQRRGAPVVRVQDEAKSIVFEILVRALIGLDEGHEMQYLRQQFKEFIAGLISLPVKLPGTQLYRSLKAKKRMTTLIQKIIQEKRKRRIAAGCDEDPHDGTTHHPRNMIDVLLGNGSDELTDELISDNMIDFMIPAEDSVPVLITLAVKYLSECPPALQQLEEENMELKRRKSGAGETLEWTDYMSLTFTQHVITETLRMGNIINGIMRKAVRDVEVRGHLIPKGWRVLVYFRAVHLDAAVHDDPHAFNPWRWKDRADVMTGGGGGGFTPFGGGQRLCPGLDLARLEASIFLHHLVTNFRWVAEEDAVVNFPTVRLRRGMPIAVTPRT

SEQ ID NO: 4037 - protein, 501 aa, Oryza sativa subsp. japonica
  misc_feature (1)..(501): useful for making plants with increased salt and oxidative stress resistance as described in USSN 12/922,143
  misc_feature (1)..(501): Public GI ID no.115487260
  misc_feature (1)..(501): Bit score of 701.4 for HMM based on sequences of FIGURE 7 of USSN 12/922,143.
  misc_feature (209)..(493): Pfam Name: p450 Pfam Description: Cytochrome P450
  misc_feature (1)..(501): Functional Homolog Of Ceres SEEDLINE ID no. ME06336
MAAAALLLLAAAAAAVVVAMALRWLLLLGGPAAGRLGKRARMPPGSTGLPLIGETLRLISAYKTPNPEPFIDERVARHGGVFTTHVFGERTVFSADPAFNRLLLAAEGRAVHSSYPSSIATLLGARSLLLTRGAAHKRLHSLTLTRLGRPASPPLLAHIDRLVLATMRQWEPAATVRLMDEAKKITFNLTVKQLVSIEPGPWTESLRREYVKLIDGFFSIPFPLAYFLPFTTYGQALKARKKVAGALREVIKKRMEEKAENGGSIGDDEGKKEKKDMVEELLQAEGGSFSEEEMVDFCLSLLVAGYETTSVLMTLAVKFLTETPAALAELKEEHANIRDMKGKNQPLEWSDYKSMPFTQCVINETLRVGNIISGVFRRANTDIHYKDYTIPKGCKIFASFRAVHLNNEHYENARTFNPWRWQINNKLQNAVGANIFTPFGGGPRLCPGYELARVVVSIFLHHLVTRFSWEETEEDRLVFFPTTRTLKGYPINLRLLSESIC

SEQ ID NO: 4038 - protein, 501 aa, Oryza sativa subsp. japonica
  misc_feature (1)..(501): useful for making plants with increased salt and oxidative stress resistance as described in USSN 12/922,143
  misc_feature (1)..(501): Public GI ID no.115484119
  misc_feature (1)..(501): Bit score of 699.4 for HMM based on sequences of FIGURE 7 of USSN 12/922,143.
  misc_feature (230)..(493): Pfam Name: p450 Pfam Description: Cytochrome P450
  misc_feature (1)..(501): Functional Homolog Of Ceres SEEDLINE ID no. ME06336
MAAAALLLLAAAAAIVVVAMVLRWLLLLGGPAAGRLGKRALMPPGSTGLPLIGETLRLISAYKTPNPEPFIDERVARHGGVFTTHVFGERTVFSADPAFNRLLLAAEGRAVHSSYPSSIATLLGARSLLLTRGAAHKRLHSLTLTRLGRPASPPLLAHIDRLVLATMRQWEPAATVRLMDEAKKITFNLTVKQLVSIEPGPWTESLRREYVKLIDGFFSIPFPLANLLPFTTYGQALKARKKVAGALREVIKKRMEEKAENGGSIGDDEGKKEKKDMVEELLEAEGGSFSEEEMVDFCLSLLVAGYETTSMLMTLAVKFLTETPAALAELKEEHANIRDMKGKKQPLEWSDYKSMPFTQCVINETLRVGNIISGVFRRANTDIHYKDYTIPKGCKIFASFRAVHLNNEHYENARTFNPWRWQINNKLQNAVGANIFTPFGGGPRLCPGYELARVVVSIFLHHLVTRFSWEETEEDRLVFFPTTRTLKGYPINLRLLSESIC

SEQ ID NO: 4039 - DNA, 1392 bp, Populus balsamifera subsp. trichocarpa
  misc_feature (1)..(1392): useful for making plants with increased salt and oxidative stress resistance as described in USSN 12/922,143
  misc_feature (1)..(1392): Ceres ANNOT ID no.1510523
atggaacaaaagagtggagtgcttccaaagggaagctttggctggcctctgataggagaaactcttgacttcattgctgctggctacacttctcaacctgttagtttcatggagaaacgcagatcactgtacgggaaggtgttcaaaacacacatcctggggacacccatcatagtatccacggatccagcagtgaacaaagttgttttacaaaaccatggcaacatttttattcctgcttatcctaaatcagtcagggaaatatttggagaatattctatacttcaaaccaatggaactctacagaagaaggtccatgcacttattggtggtttcttgaggtcaccacagttcaaaactagaattaccaaagacattgagcaccatgtcaaactcaccttgacttcttggaaggacctgccccttctattcgtccaagaagaaacccaaaagttcacgttcaaagtcttggttaaagcattgctaagtcttgatccaagtgatgatttggattttcttaagagagaattcgatgaattcatcaaagggttgatatgtctgccgatcaaattaccaggaacaagattatacaaatccttaaaggctaaagagagaatattcaagctagtaaaaaagattgttgagcaaagaaaattgggcttggagaaatcagaagatcaagaacatcaaaatacaatccctaatgatgcggtggacgtgcttttacgtgacatttctggtgaacaaaatgacaagcaatctctatcgttggatttcatcatttcacatattattgagctgatgatccctggagaagaaaccgtgcctatgtccatgaccttagctgtcaaattcctcagtgactgccctgtcgctctagagctattaacggaggagaacatgaaattgaagaggcagaagactgattctggtgatgattattgttggactgattacatgtccttgcaatttactcagaatgtgataaatgaaactcttagagtagcaaacataatcaatgcagtttggaggaaagctctcaaggatgtagagatcaaaggaattctgattcccgaaggatggtgtgtcctgacatctttcagctctgtacatatggatgaagaaaattatgaaaacccacatgagtttgatccatggagatgggagaaaacaggagcttctgttaagaacaattgctttacaccttttggaggtggacaaaggctatgccctggtctagaactatccaggcttgaaatctccatcttccttcaccatcttgtcacaacttacagatggattgctgaaaaggatgacattatttactttccaacagtgaagttaaagaaaaagctgcctatcagagtcacctccataggcaactcttcatga

SEQ ID NO: 4040 - protein, 463 aa, Populus balsamifera subsp. trichocarpa
  misc_feature (1)..(463): useful for making plants with increased salt and oxidative stress resistance as described in USSN 12/922,143
  misc_feature (1)..(463): Ceres ANNOT ID no.1510523
  misc_feature (1)..(463): Bit score of 624.6 for HMM based on sequences of FIGURE 7 of USSN 12/922,143.
  misc_feature (194)..(458): Pfam Name: p450 Pfam Description: Cytochrome P450
  misc_feature (1)..(463): Functional Homolog Of Ceres SEEDLINE ID no. ME06336
MEQKSGVLPKGSFGWPLIGETLDFIAAGYTSQPVSFMEKRRSLYGKVFKTHILGTPIIVSTDPAVNKVVLQNHGNIFIPAYPKSVREIFGEYSILQTNGTLQKKVHALIGGFLRSPQFKTRITKDIEHHVKLTLTSWKDLPLLFVQEETQKFTFKVLVKALLSLDPSDDLDFLKREFDEFIKGLICLPIKLPGTRLYKSLKAKERIFKLVKKIVEQRKLGLEKSEDQEHQNTIPNDAVDVLLRDISGEQNDKQSLSLDFIISHIIELMIPGEETVPMSMTLAVKFLSDCPVALELLTEENMKLKRQKTDSGDDYCWTDYMSLQFTQNVINETLRVANIINAVWRKALKDVEIKGILIPEGWCVLTSFSSVHMDEENYENPHEFDPWRWEKTGASVKNNCFTPFGGGQRLCPGLELSRLEISIFLHHLVTTYRWIAEKDDIIYFPTVKLKKKLPIRVTSIGNSS

SEQ ID NO: 4041 - DNA, 1799 bp, Zea mays
  misc_feature (1)..(1799): useful for making plants with increased salt and oxidative stress resistance as described in USSN 12/922,143
  misc_feature (1)..(1799): Ceres CLONE ID no.339347
ctataaataaataccgcccaccaacatctggtggtatcaaagaatctcctctgtatctctggcagccgcatcgtctcaatctcagtcactcccggacacgcgcacgagccaccccgcacccaactaaccaacccatggacgcgggcggaacgccgccgctgctgttcctcctggccgcggcggccgccctgctgggcgcggcgctcaggtggctgctcctggcctggcggtcggcggcgaggacggggcggctgccaccgggcagcacggggctgccgctcatcggggagacgctgcgcctcatcgcggcgtacaagacgccgaacccggagccgttcatcgacgagcgcgtggcgcggcacggcagcggggtgttcacgacgcacgtgttcggcgagcgcaccgtgttctccgcggacccggccttcaaccgcctgctcctggccgccgagggccgcgccgtcagctgcagctacccgtcgtccatcgccacgctgctgggcccgcgctcgctgctcctcaccgccggccccgcgcacaagcgcctccactcgctcacgctcgcccgcctcggccggccggcctcgccgccgctgctggcgcacatcgaccgcctcgtcctcgccaccctgcgggactggggccggccaggcgccggcgccgtcgtccgcctcctcgacgaggccaagaagatcaccttcaacctcactgtctggcagctcgtcagcatcgagcctgggccctggaccgagagcctccgccgcgagtacgtcaagctcgtcgacggcttcttctccatccccttccccttcgcctacctcctccctttcaccgcctacggccaggccctcaaggcgaggaagaaggtggctggagctcttcgggaggtgataaggaagaggatgggcgaggaggccggaactggccctggcgccggtagaaatggggagaagaaggacatggtggaggagcttctggaagcagagggtgggagcttctcggtggaggagatggtggatttctgcctgtctctgctggtggctggctacgagaccacctccgtgctcatgacgctcgccgtcaagttcctcaccgagacgcccactgcactggcgcagctcaaggaagagcacgacagcatcagacacaggaaaggcaaggacgagcagcctctgcaatggagcgattacaagtcgatgccgtttacacaatgcgtgatcagtgagacgctgcgcgtggctaacttgatcagcggggtgttcaggcgggcgaacaccgacatccatttcaaagattacgttatcccaaagggctgcagaatcttcgcgtcgttccgagccgtgcacctgagccccgagcactacgagaacgctcgagccttcgacccctggagatggcagcagagcaagaaggagggagtactagtagtagggcaggacgcgcagcagggggccagggccagcgtgttcactcccttcggcggggggcctcgcctgtgcccgggccacgagcttgcccgcgtcgtggtctccgttttcctccaccgcctggtgacgcgcttcagctgggaagaggctgaggaggacagggtcgtcttcttccccaccacccgcaccctcaaagggtaccccatcatcctgcggcggcgaccgggttgggatttctgacctagctcatcatgttacaatagagtcgatccatctatagttgttacactcatctctctctctctctctctctctgtctgtaataacactactgtctaatataaacaagcatctccgctctattctgttcag

SEQ ID NO: 4042 - protein, 510 aa, Zea mays
  misc_feature (1)..(510): useful for making plants with increased salt and oxidative stress resistance as described in USSN 12/922,143
  misc_feature (1)..(510): Ceres CLONE ID no.339347
  misc_feature (1)..(510): Bit score of 669.4 for HMM based on sequences of FIGURE 7 of USSN 12/922,143.
  misc_feature (223)..(504): Pfam Name: p450 Pfam Description: Cytochrome P450
  misc_feature (1)..(510): Functional Homolog Of Ceres SEEDLINE ID no. ME06336
MDAGGTPPLLFLLAAAAALLGAALRWLLLAWRSAARTGRLPPGSTGLPLIGETLRLIAAYKTPNPEPFIDERVARHGSGVFTTHVFGERTVFSADPAFNRLLLAAEGRAVSCSYPSSIATLLGPRSLLLTAGPAHKRLHSLTLARLGRPASPPLLAHIDRLVLATLRDWGRPGAGAVVRLLDEAKKITFNLTVWQLVSIEPGPWTESLRREYVKLVDGFFSIPFPFAYLLPFTAYGQALKARKKVAGALREVIRKRMGEEAGTGPGAGRNGEKKDMVEELLEAEGGSFSVEEMVDFCLSLLVAGYETTSVLMTLAVKFLTETPTALAQLKEEHDSIRHRKGKDEQPLQWSDYKSMPFTQCVISETLRVANLISGVFRRANTDIHFKDYVIPKGCRIFASFRAVHLSPEHYENARAFDPWRWQQSKKEGVLVVGQDAQQGARASVFTPFGGGPRLCPGHELARVVVSVFLHRLVTRFSWEEAEEDRVVFFPTTRTLKGYPIILRRRPGWDF

SEQ ID NO: 4043 - protein, 524 aa, Arabidopsis thaliana
  misc_feature (1)..(524): useful for making plants with increased salt and oxidative stress resistance as described in USSN 12/922,143
  misc_feature (1)..(524): Public GI ID no.13878393
  misc_feature (1)..(524): Bit score of 679.5 for HMM based on sequences of FIGURE 7 of USSN 12/922,143.
  misc_feature (368)..(511): Pfam Name: p450 Pfam Description: Cytochrome P450
  misc_feature (1)..(524): Functional Homolog Of Ceres SEEDLINE ID no. ME06336
MQPPASAGLFRSPENLPWPYNYMDYLVAGFLVLTAGILLRPWLWFRLRNSKTKDGDEEEDNEEKKKGMIPNGSLGWPVIGETLNFIACGYSSRPVTFMDKRKSLYGKVFKTNIIGTPIIISTDAEVNKVVLQNHGNTFVPAYPKSITELLGENSILSINGPHQKRLHTLIGAFLRSPHLKDRITRDIEASVVLTLASWAQLPLVHVQDEIKKMTFEILVKVLMSTSPGEDMNILKLEFEEFIKGLICIPIKFPGTRLYKSLKAKERLIKMVKKVVEERQVAMTTTSPANDVVDVLLRDGGDSEKQSQPSDFVSGKIVEMMIPGEETMPTAMTLAVKFLSDNPVALAKLVEENMEMKRRKLELGEEYKWTDYMSLSFTQNVINETLRMANIINGVWRKALKDVEIKGYLIPKGWCVLASFISVHMDEDIYDNPYQFDPWRWDRINGSANSSICFTPFGGGQRLCPGLELSKLEISIFLHHLVTRYSWTAEEDEIVSFPTVKMKRRLPIRVATVDDSASPISLEDH

SEQ ID NO: 4044 - protein, 457 aa, Arabidopsis thaliana
  misc_feature (1)..(457): useful for making plants with increased salt and oxidative stress resistance as described in USSN 12/922,143
  misc_feature (1)..(457): Public GI ID no.25282635
  misc_feature (1)..(457): Bit score of 643.8 for HMM based on sequences of FIGURE 7 of USSN 12/922,143.
  misc_feature (301)..(444): Pfam Name: p450 Pfam Description: Cytochrome P450
  misc_feature (1)..(457): Functional Homolog Of Ceres SEEDLINE ID no. ME06336
MIPNGSLGWPVIGETLNFIACGYSSRPVTFMDKRKSLYGKVFKTNIIGTPIIISTDAEVNKVVLQNHGNTFVPAYPKSITELLGENSILSINGPHQKRLHTLIGAFLRSPHLKDRITRDIEASVVLTLASWAQLPLVHVQDEIKKMTFEILVKVLMSTSPGEDMNILKLEFEEFIKGLICIPIKFPGTRLYKSLKAKERLIKMVKKVVEERQVAMTTTSPANDVVDVLLRDGGDSEKQSQPSDFVSGKIVEMMIPGEETMPTAMTLAVKFLSDNPVALAKLVEENMEMKRRKLELGEEYKWTDYMSLSFTQNVINETLRMANIINGVWRKALKDVEIKGYLIPKGWCVLASFISVHMDEDIYDNPYQFDPWRWDRINGSANSSICFTPFGGGQRLCPGLELSKLEISIFLHHLVTRYSWTAEEDEIVSFPTVKMKRRLPIRVATVDDSASPISLEDH

SEQ ID NO: 4045 - protein, 524 aa, Arabidopsis thaliana
  misc_feature (1)..(524): useful for making plants with increased salt and oxidative stress resistance as described in USSN 12/922,143
  misc_feature (1)..(524): Public GI ID no.18419825
  misc_feature (1)..(524): Bit score of 678.2 for HMM based on sequences of FIGURE 7 of USSN 12/922,143.
  misc_feature (368)..(511): Pfam Name: p450 Pfam Description: Cytochrome P450
  misc_feature (1)..(524): Functional Homolog Of Ceres SEEDLINE ID no. ME06336
MQPPASAGLFRSPENLPWPYNYMDYLVAGFLVLTAGILLRPWLWLRLRNSKTKDGDEEEDNEEKKKGMIPNGSLGWPVIGETLNFIACGYSSRPVTFMDKRKSLYGKVFKTNIIGTPIIISTDAEVNKVVLQNHGNTFVPAYPKSITELLGENSILSINGPHQKRLHTLIGAFLRSPHLKDRITRDIEASVVLTLASWAQLPLVHVQDEIKKMTFEILVKVLMSTSPGEDMNILKLEFEEFIKGLICIPIKFPGTRLYKSLKAKERLIKMVKKVVEERQVAMTTTSPANDVVDVLLRDGGDSEKQSQPSDFVSGKIVEMMIPGEETMPTAMTLAVKFLSDNPVALAKLVEENMEMKRRKLELGEEYKWTDYMSLSFTQNVINETLRMANIINGVWRKALKDVEIKGYLIPKGWCVLASFISVHMDEDIYDNPYQFDPWRWDRINGSANSSICFTPFGGGQRLCPGLELSKLEISIFLHHLVTRYSWTAEEDEIVSFPTVKMKRRLPIRVATVDDSASPISLEDH

SEQ ID NO: 4046 - protein, 501 aa, Oryza sativa subsp. japonica
  misc_feature (1)..(501): useful for making plants with increased salt and oxidative stress resistance as described in USSN 12/922,143
  misc_feature (1)..(501): Public GI ID no.60677683
  misc_feature (1)..(501): Bit score of 696.7 for HMM based on sequences of FIGURE 7 of USSN 12/922,143.
  misc_feature (230)..(493): Pfam Name: p450 Pfam Description: Cytochrome P450
  misc_feature (1)..(501): Functional Homolog Of Ceres SEEDLINE ID no. ME06336
MAAAALLLLAAAAAIVVVAMVLRWLLLLGGPAAGRLGKRALMPPGSTGLPLIGETLRLISAYKTPNPEPFIDERVARHGGVFTTHVFGERTVFSADPAFNRLLLAAEGRAVHSSYPSSIATLLGARSLLLTRGAAHKRLHSLTFTRLGRPASPPLLAHIDRLVLATMRQWEPAATVRLMDEAKKITFNLTVKQLVSIEPGPWTESLRREYVKLIDGFFSIPFPLANLLPFTTYGQALKARKKVAGALREVIKKRMEEKAENGGSIGDDEGKKEKKDMVEELLEAEGGSFSEEEMVDFCLSLLVAGYETTSMLMTLAVKFLTETPAALAELKEEHANIRDMKGKKQPLEWSDYKSMPFTQCVINETLRVGNIISGVFRRANTDIHYKDYTIPKGCKIFASFRAVHLNNEHYENARTFNPWRWQINNKLQNAVGANIFTPFGGGPRLCPGYELARVVVSIFLHHLVTRFSWEETEEDRLVFFPTTRTLKGYPINLRLLSESIC

SEQ ID NO: 4047 - protein, 501 aa, Oryza sativa subsp. indica
  misc_feature (1)..(501): useful for making plants with increased salt and oxidative stress resistance as described in USSN 12/922,143
  misc_feature (1)..(501): Public GI ID no.125535723
  misc_feature (1)..(501): Bit score of 701.6 for HMM based on sequences of FIGURE 7 of USSN 12/922,143.
  misc_feature (230)..(493): Pfam Name: p450 Pfam Description: Cytochrome P450
  misc_feature (1)..(501): Functional Homolog Of Ceres SEEDLINE ID no. ME06336
MAAAALLLLAAAAAAVVVAMALRWLLLLGGPAAGRQGKRARMPPGSTGLPLIGETLRLISAYKTPNPEPFIDERVARHGGVFTTHVFGERTVFSADPAFNRLLLAAEGRAVHSSYPSSIATLLGARSLLLTRGAAHKRLHSLTLTRLGRPASPPLLAHIDRLVLATMRQWEPAATVRLMDEAKKITFNLTVKQLVSIEPGPWTESLRREYVKLIDGFFSIPFPLACLLPFTTYGQALKARKKVAGALREVIKKRMEEKAENGGSIGDDEGKKEKKDMVEELLQAEGGSFSEEEMVDFCLSLLVAGYETTSVLMTLAVKFLTETPAALAELKEEHANIRDMKGKNQPLEWSDYKSMPFTQCVINETLRVGNIISGVFRRANTDIHYKDYTIPKGCKIFASFRAVHLNNEHYENARTFNPWRWQINNKLQNAVGANIFTPFGGGPRLCPGYELARVVVSIFLHHLVTRFSWEETEEDRLVFFPTTRTLKGYPINLRLLSESIC

SEQ ID NO: 4048 - protein, 471 aa, Zinnia elegans
  misc_feature (1)..(471): useful for making plants with increased salt and oxidative stress resistance as described in USSN 12/922,143
  misc_feature (1)..(471): Public GI ID no.71834072
  misc_feature (1)..(471): Bit score of 795.9 for HMM based on sequences of FIGURE 7 of USSN 12/922,143.
  misc_feature (214)..(464): Pfam Name: p450 Pfam Description: Cytochrome P450
  misc_feature (1)..(471): Functional Homolog Of Ceres SEEDLINE ID no. ME06336
MITIDLLLSPLSLLLLSLSTILIILHTTTSSRRNHHSPPGATGIPFIGETLQLISAYKTENPEPFIDTRVEKYGVVFTTHVFGERTVFSADGETNRFILKNEGRLFESSYPGSIANLVGKNSLLLMRGGLHRRMHSLTMSFANSTIIKDHLLVDIDRLVRLNLDAWTGRILLMDEAKKITFELTLKQLLSIEPFEWSENLRKEYMLVIEGFFCIPLPFFPLTYRRAIQARKRVTEALHLVVRERRVERERGVKKNDMLAALFDNDCDDDEIVDLLVSLLVAGYDTTPTTMTLAVKYLTDTPSALAQLKEEHEQITRKKGALVALEWDDYKSMPFTQCVVNETLRLSNIISGVFRRAMTDVKIKDFTIPKGSKVFASLRAVHLDLENFEDARVFYPWRWQKISDPANFMPFGGGPRRCPGHELARVALSVFLHHLITRFSWIPAEEDKLVFFPTTRTQKRYPIIVQKRNVVE

SEQ ID NO: 4049 - protein, 524 aa, Arabidopsis thaliana
  misc_feature (1)..(524): useful for making plants with increased salt and oxidative stress resistance as described in USSN 12/922,143
  misc_feature (1)..(524): Public GI ID no.110736225
  misc_feature (1)..(524): Bit score of 672.2 for HMM based on sequences of FIGURE 7 of USSN 12/922,143.
  misc_feature (368)..(511): Pfam Name: p450 Pfam Description: Cytochrome P450
  misc_feature (1)..(524): Functional Homolog Of Ceres SEEDLINE ID no. ME06336
MQPPASAGLFRSPENLPWPYNYMDYLVAGFLVLTAGILLRPWLWLRLRNSKTKDGDEEEDNEEKKKGMIPNGSLGWPVIGETLNFIACGYSSRPVTFMDKRKSLYGKVFKTNIIGTPIIISTDAEVNKVVLQNHGNTFVPAYPKSITELLGENSILSINGPHQKRLHTLIGAFLRSPHLKDRITRDIEASVVLTLASWAQLPLVHVQDEIKKMTFEILVKVLMSTSPGEDMNILKLEFEEFIKGLICIPIKSPGTRLYKSLKAKERLIKMVKKVVEERQVAMTTTSPANDVVDVLLRDGGDSEKQSQPSDFVSGKIVEMMIPGEETMPTAMTLAVKFLSDNPVALAKLVEENMEMKRRKLELGEEYKWTDYMSLSFTQNVINETLRMANIINGVWRKALKDVEIKGYLIPKGWCVLASFISVHMDEDIYDNPYQFDPWRWDRINGSANSSICFTPFGGGQRLCPGLELSKLEISIFLHHLVTRYSWTAEEDEIVSFPTVKMKRRLPIRVATVDDSASPISLEDH

SEQ ID NO: 4050 - DNA, 1921 bp, Zea mays
  misc_feature (1)..(1921): useful for making plants with increased salt and oxidative stress resistance as described in USSN 12/922,143
  misc_feature (1)..(1921): Ceres CLONE ID no.1584356
gtggctggtggtgccaaagaatctcttatctctggcaacagcgcatcactcacacaatctgtcactccccgacacgcgcacgagctccactccccactccgcacccaacccaaggcgccactgccatggacgcgggcggtccgccgccgctgttcctcctgggcgccgtgctggccgcggcgctggggtggctgctcgtggtctggcgggcggcggcggggcggcggcggtccgcgtcggcgcggctgccgccggggagcacggggctgccgctcatcggggagacgctgcggctcatcgcggcgtacaagtcgccgaacccggagccgttcatcgacgagcgcgtggcgcggcacggcagcggggtgttcacgacgcacgtgttcggcgagcgcaccgtgttctccgccgacccggccttcaaccgcctgctgctggccgcggagggccgcgccgtgagctgcagctacccgtcgtccatcgccacgctgctgggcccgcggtcgctgctgctcacctcgggccccgcgcacaagcgcctccactcgctcacgctgacccgcctcggccgcccggcctcgccgccgctgctggcgcacatcgaccgcctcgtcctcgccaccatgaggggctgggaccgccccggcgccggcgccatgcgcctcctcgacgaggccaagaagatcaccttcaacctcaccgtgtggcagctcgtcagcatcgagcctgggccgtggaccgagagcgtccggcgcgagtacgtgaagctcgtcgacggcttcttctccatccccttccccttcgcctccctcctcccgttcaccgtctacggccaggccctcaaggcgaggaagaaggtggccggagctcttcgggaggtggtaaggaagaggatggacgacaaggcggaggacgactgtggcgccagtaagaagaacggggagaagaaggacatggtggaggagctcctagaagcggagggcgggagcttctccgtggaggagatggtggacttctgcctgtccctgctggtggctgggtacgagaccacctccgtgctcatgacgctcgccgtcaagttcctcaccgagacacccaccgcactggcgcagctcaaggaagagcacgacagcatcagaggggtaaaaggcaaaggccaagctctggaatggagcgattacaagtcgatgccgtttacacaatgcgtgataagcgaaacgctgcgcgtggccaacctgatcagcggggtgttcaggcgtgcgaacaccgacatccacttcaaaggccacgtgatcccaaagggctgcaagatcttcgcgtcgttccgagccgtgcaccttagcctggaccactacgagaacgcccggaccttcgacccttggagatggcagcagggcaagagcaagctgcagagcgcggaaggggccagtctgttcacgccgttcggcggcgggccgcgcctgtgcccgggctacgagctcgcccgggtggtggtttccgtcttcctccaccacctcgtcacgcgctttagctgggaggaagccgaggaggacaggattgtcttcttccccaccacccggaccctcaagggataccccatcatcctacggcggcgaccggattgcgatgatctctgacctcatggctaggttccccccttatcttcttcggatcaaggctgaaggctaagcattagatagagtaaggtggatgtcgtcgtggctagtaggtgcatggtggtttctgccactcactcactcactcactctgttgtctgtttgttcctgttcctctctgttttctcttgctctgtaacctggacctggtacgagtcagcactcagcagccagcagcaaactcgcgttttgcttgtaaaatctaaaatctgatatgagatgcagatgcccccgcgactgagacg

SEQ ID NO: 4051 - protein, 503 aa, Zea mays
  misc_feature (1)..(503): useful for making plants with increased salt and oxidative stress resistance as described in USSN 12/922,143
  misc_feature (1)..(503): Ceres CLONE ID no.1584356
  misc_feature (1)..(503): Bit score of 661.7 for HMM based on sequences of FIGURE 7 of USSN 12/922,143.
  misc_feature (210)..(496): Pfam Name: p450 Pfam Description: Cytochrome P450
  misc_feature (1)..(503): Functional Homolog Of Ceres SEEDLINE ID no. ME06336
MDAGGPPPLFLLGAVLAAALGWLLVVWRAAAGRRRSASARLPPGSTGLPLIGETLRLIAAYKSPNPEPFIDERVARHGSGVFTTHVFGERTVFSADPAFNRLLLAAEGRAVSCSYPSSIATLLGPRSLLLTSGPAHKRLHSLTLTRLGRPASPPLLAHIDRLVLATMRGWDRPGAGAMRLLDEAKKITFNLTVWQLVSIEPGPWTESVRREYVKLVDGFFSIPFPFASLLPFTVYGQALKARKKVAGALREVVRKRMDDKAEDDCGASKKNGEKKDMVEELLEAEGGSFSVEEMVDFCLSLLVAGYETTSVLMTLAVKFLTETPTALAQLKEEHDSIRGVKGKGQALEWSDYKSMPFTQCVISETLRVANLISGVFRRANTDIHFKGHVIPKGCKIFASFRAVHLSLDHYENARTFDPWRWQQGKSKLQSAEGASLFTPFGGGPRLCPGYELARVVVSVFLHHLVTRFSWEEAEEDRIVFFPTTRTLKGYPIILRRRPDCDDL

SEQ ID NO: 4052 - protein, 472 aa, Arabidopsis thaliana
  misc_feature (1)..(472): useful for making plants with increased salt and oxidative stress resistance as described in USSN 12/922,143
  misc_feature (1)..(472): Public GI ID no.30682922
  misc_feature (1)..(472): Bit score of 456.2 for HMM based on sequences of FIGURE 7 of USSN 12/922,143.
  misc_feature (209)..(467): Pfam Name: p450 Pfam Description: Cytochrome P450
  misc_feature (1)..(472): Functional Homolog Of Ceres SEEDLINE ID no. ME06336
MWALLIWVSLLLISITHWVYSWRNPKCRGKLPPGSMGFPLLGESIQFFKPNKTSDIPPFIKERVKKYGPIFKTNLVGRPVIVSTDADLSYFVFNQEGRCFQSWYPDTFTHIFGKKNVGSLHGFMYKYLKNMVLTLFGHDGLKKMLPQVEMTANKRLELWSNQDSVELKDATASMIFDLTAKKLISHDPDKSSENLRANFVAFIQGLISFPFDIPGTAYHKCLQGRAKAMKMLRNMLQERRENPRKNPSDFFDYVIEEIQKEGTILTEEIALDLMFVLLFASFETTSLALTLAIKFLSDDPEVLKRLTEEHETILRNREDADSGLTWEEYKSMTYTFQFINETARLANIVPAIFRKALRDIKFKDYTIPAGWAVMVCPPAVHLNPEMYKDPLVFNPSRWEGSKVTNASKHFMAFGGGMRFCVGTDFTKLQMAAFLHSLVTKYRWEEIKGGNITRTPGLQFPNGYHVKLHKKRD

SEQ ID NO: 4053 - DNA, 1572 bp, Populus balsamifera subsp. trichocarpa
  misc_feature (1)..(1572): useful for making plants with increased salt and oxidative stress resistance as described in USSN 12/922,143
  misc_feature (1)..(1572): Ceres ANNOT ID no.1458265
atggcggtttctgtttgtcttgttctctttattgttctcccagcgatagtctttatcgttcacaggagttcccggttccggaggctccggctgccgccggggagtttgggtctgccctttgttggagagactctacagctgatatctgcatacaagactgagaaccctgaaccgtttatagatgagcgggtgaaccggttcggttcgttgtttaaaacccatatttttggtgaaccgaccgttttttctgttgacccggaaacgaacaggttcattttgcaaaatgaagggaagctgtttgagtgtagttaccccggttcgataagcaacctgctgggaaaacattctttgttgctaatgacgggtaatcttcacaaaaaaatgcattccttaaccatgagtttcgctaactcttcaatcatcagagaccatctcttggtcgatatagaccggttgatccgtctcaatttagattcttggtccgaccgggttcttctcatggaggaggccaagaagggaattaaactggtgggtgacaaacattccaagcatactacatttgagttgacaatgaagcagctaatgagctttgatccatgtgaatggaccgagagtctgagaagagagtacgtgcttgttattgaaggctttttcagcgtgcctctacccatcctttcccccacataccgcagagctatcaaagctaggactaaggtggcagaggctttgagtttggtagtgaagcaaaggaggatagagagtgagtcaggagagaaaaagaaagacatgcttggagctcttttagcttcagatgatcatggaggcttctcggacgaggagatagtagatttcttggtggctctgcttgttgcaggctatgaaactacatctacaagcatgactcttgctgttaagttcctcaccgagacacctctggctctggctcagatcaagagatcggggaagtcagagactaaatatgcccctgtaccccggcgagtcgtattgggatcatcggaaacactcgtctctgatttcgatgaagaagatcatccaacggcggtgaccgatgaggagcatgaacagattagaggaaagaagggcgaggagggagctcttgagtggagtgattacaagtcaatgaccttcactcagtgtgttgttaatgagactttgagaatagcaaacataataggtgggatatttagacgaacaatgacagatataaatgttaaaggttatacaattcctaaaggatggaaggtttttgcatcctttcgtggtgtacatttagaccatgaatacttcaaagatgctcgaactttcaatccgtggagatggcaggacgactcgggggcaacatgcccagcaaatgtgttcactccttttggaggagggcaacggttatgcccaggatatgaacttgctagagtagaactctctgttttccttcaccacctggtcacccgtttcagttggaccccagctgaacaagacaagctggttttctttccaactacgcggacacaaaagcgatatcccatcaatgtgcagcgtcgaaatcgtgtctaa

SEQ ID NO: 4054 - protein, 523 aa, Populus balsamifera subsp. trichocarpa
  misc_feature (1)..(523): useful for making plants with increased salt and oxidative stress resistance as described in USSN 12/922,143
  misc_feature (1)..(523): Ceres ANNOT ID no.1458265
  misc_feature (1)..(523): Bit score of 811.3 for HMM based on sequences of FIGURE 7 of USSN 12/922,143.
  misc_feature (358)..(517): Pfam Name: p450 Pfam Description: Cytochrome P450
  misc_feature (1)..(523): Functional Homolog Of Ceres SEEDLINE ID no. ME06336
MAVSVCLVLFIVLPAIVFIVHRSSRFRRLRLPPGSLGLPFVGETLQLISAYKTENPEPFIDERVNRFGSLFKTHIFGEPTVFSVDPETNRFILQNEGKLFECSYPGSISNLLGKHSLLLMTGNLHKKMHSLTMSFANSSIIRDHLLVDIDRLIRLNLDSWSDRVLLMEEAKKGIKLVGDKHSKHTTFELTMKQLMSFDPCEWTESLRREYVLVIEGFFSVPLPILSPTYRRAIKARTKVAEALSLVVKQRRIESESGEKKKDMLGALLASDDHGGFSDEEIVDFLVALLVAGYETTSTSMTLAVKFLTETPLALAQIKRSGKSETKYAPVPRRVVLGSSETLVSDFDEEDHPTAVTDEEHEQIRGKKGEEGALEWSDYKSMTFTQCVVNETLRIANIIGGIFRRTMTDINVKGYTIPKGWKVFASFRGVHLDHEYFKDARTFNPWRWQDDSGATCPANVFTPFGGGQRLCPGYELARVELSVFLHHLVTRFSWTPAEQDKLVFFPTTRTQKRYPINVQRRNRV

SEQ ID NO: 4055 - DNA, 1834 bp, Panicum virgatum
  misc_feature (1)..(1834): useful for making plants with increased salt and oxidative stress resistance as described in USSN 12/922,143
  misc_feature (1)..(1834): Ceres CLONE ID no.1786280
aagccaaaccgcacacggccacgccgcccatggacgcgagcggggcgccgccgcccctcctggccgtgtcctccttcgccgcggccgcgctgctcttcgccgcggtgctggggtggctcttcgccgcgcggtcgtccaagcgcgggtcggcgcggctgccgccgggcagcacggggctgccgctcatcggggagacgctgcgcctcatctccgcctacaagacccccaacccggagcccttcatcgacgaccgcgtggcgcgccacggcagcggcgtcttcaccacccacatcttcggcgagcgcaccgtcttctccgccgacccggccttcaaccgcctcctcctcgccgccgagggccgcgccgtcggctgcagctacccgtcctccatcgccacgctgctcggcccgcactcgctgctcctcaccaggggccccgcgcaccgccgcctccacacgctcacgctcacccgcctcggccgccccgcgtcgccgccgctcctcgcctacatcgaccgcctcgtcctcgccaccatgcgggagtgggagcccgccgccaccgtccgcctcctcgacgaggccaagaagatcaccttcaacctcaccgtcaagcagctcgtcagcatcgaccccggcccgtggaccgagagcgtccgccgcgagtacgtcaagctcatcgacggcttcttctccatcccgttccccttcgcccacctccttcctttcaccacctacggccaggccctcaaggcgaggaagaaggtggccggggctctgcgggaggtgataaggaagaggatggacgacaagctggaaaatggttgcgcgaacgggaaggaggatgacaagattgagaagaaggacatggtggaggagcttcttgaagcagagggtgggagcttctccgaggaggaaatggtggatttctgcctgtctctgctggtggctggctacgagacgacgtccgtgctcatgacgcttgctgtcaagttcctcaccgagacacccactgcgctggcgcagctcaaggaagagcatgaaaatatcagagacgtaaaaggcaaaaatcaacctctggaatggagcgatttcaagtcaatgccatttacacaatgtgtgataaatgaaacattgcgtgttgctaacttaattagtggggtattcaggcgtgcaaacactgatattcattttaaagactacgttattccaaagggctgcaaaatatttgcttcattccgagctgtgcaccttaatactgaacactatgagaatgctcggacctttgatccctggagatggcagagtaagaataaactccagaacgcagtaggggccagcttgtttactccctttggtggcggacctcgtctgtgcccaggctatgagcttgcccgggttgttgtttctgtttttctccatcatcttgtgacacgctttagttgggaagaagctgaggaagataggattgtcttcttccccaccacccgaactctcaaaggataccccatcaatctccggcggcgaccagattctgttttctgacctcgcattaggttccagttacccttatggtctaagcaagagtaagcatagataagaaaaatgtccccagtagtcagtgaaattttatctgtaacttggcgcagaaagcagtcggcaaacttggttttgcttgtaaaatgacccaaactgctatgcaatgcgtactggttacagataacattttgccgtgtattatttggctatcctaagatccagcaaagatcttgctagtcgttatatcgctgtcctaacaattgacaaatgatgtgatgattttgtacgatttggtgggc

SEQ ID NO: 4056 - protein, 503 aa, Panicum virgatum
  misc_feature (1)..(503): useful for making plants with increased salt and oxidative stress resistance as described in USSN 12/922,143
  misc_feature (1)..(503): Ceres CLONE ID no.1786280
  misc_feature (1)..(503): Bit score of 690.8 for HMM based on sequences of FIGURE 7 of USSN 12/922,143.
  misc_feature (232)..(497): Pfam Name: p450 Pfam Description: Cytochrome P450
  misc_feature (1)..(503): Functional Homolog Of Ceres SEEDLINE ID no. ME06336
MDASGAPPPLLAVSSFAAAALLFAAVLGWLFAARSSKRGSARLPPGSTGLPLIGETLRLISAYKTPNPEPFIDDRVARHGSGVFTTHIFGERTVFSADPAFNRLLLAAEGRAVGCSYPSSIATLLGPHSLLLTRGPAHRRLHTLTLTRLGRPASPPLLAYIDRLVLATMREWEPAATVRLLDEAKKITFNLTVKQLVSIDPGPWTESVRREYVKLIDGFFSIPFPFAHLLPFTTYGQALKARKKVAGALREVIRKRMDDKLENGCANGKEDDKIEKKDMVEELLEAEGGSFSEEEMVDFCLSLLVAGYETTSVLMTLAVKFLTETPTALAQLKEEHENIRDVKGKNQPLEWSDFKSMPFTQCVINETLRVANLISGVFRRANTDIHFKDYVIPKGCKIFASFRAVHLNTEHYENARTFDPWRWQSKNKLQNAVGASLFTPFGGGPRLCPGYELARVVVSVFLHHLVTRFSWEEAEEDRIVFFPTTRTLKGYPINLRRRPDSVF

SEQ ID NO: 4057 - DNA, 1434 bp, Populus balsamifera subsp. trichocarpa
  misc_feature (1)..(1434): useful for making plants with increased salt and oxidative stress resistance as described in USSN 12/922,143
  misc_feature (1)..(1434): Ceres ANNOT ID no.1438753
atgtgggctttgttctttggagctttgattattataagcattacacattgggtttaccgctggagaaaccccagatgcaatggcactctcccaccaggttcaatgggattgccacttattggcgagacccttcagttcttcgctccaaatacttcttgtgacatttctccatttgtcagagacaggatgaaaagatatggaccaatattccggactaatttggtcggaaggccagttgtagtatcaacagatccggatctcaattactttatcttccaacaagaaggaaaattgttccagagctggtatccggatacattcacggagatctttggaaggcaaaatgttggttcgttacatgggttcatgtacaagtatcttaagaatatggtgcttaatctcttcggtcctgaaagccttaaaaaaatgctccctgaagttgaacagacagcatcaaatagattacaactatggtctcatcaggaatcagttgaattgaaagaagcaactgcaactatgatatttgatctgacggcgaagaagctgataagttatgatcaagaaaattcttcagagaatctaagggagaactttgttgcattcatacaaggattaatctccttccctttggacattccaggaacagcatatcacgaatgcttacagggtaggaaaaaggcaatgagaatgctaaagaacctgctacaggaaagacaagcaaatccgagaaagcacgaaactgatttttttgattatgtgcttgaagaacttcaaaagaacaaaacaatccttacagaggaaatcgctctggatttaatgtttgtgctgctatttgccagctttgaaacaacttccctgggtctaactttagctgtcaagtttatatcggaccacccattggtgctaaaggaattgacggaagagcacgagggaattctaaaaaatcgggaaaatgccaactctggtcttacatggaaggaatacaaatcaatgaaattcacgtttcaggtcattaatgaaactgttagactggcaaacatagttccagggatcttcagaaaaacacttagagatatccagtttaagggatataccattccagcaggctgggcagtaatggtctgtccccccgctgtacacttaaacccagcaaaatatgaagatccacttgccttcaatccatggagatggaagggtatggaagtaaatggtgcatccaaaactttcatggcctttggtggtggcatgagattttgtgttggaacagagtttaccaaggtgcagatggctgtatttctacattgcttggtcacaaagtccaggtggcaagcaatcaaaggaggaaatattgttcgaactcctggtttacaatttcccagtggttatcacattcagctcacggagagagacaaaagatataactctactacataa

SEQ ID NO: 4058 - protein, 477 aa, Populus balsamifera subsp. trichocarpa
  misc_feature (1)..(477): useful for making plants with increased salt and oxidative stress resistance as described in USSN 12/922,143
  misc_feature (1)..(477): Ceres ANNOT ID no.1438753
  misc_feature (1)..(477): Bit score of 481.1 for HMM based on sequences of FIGURE 7 of USSN 12/922,143.
  misc_feature (224)..(437): Pfam Name: p450 Pfam Description: Cytochrome P450
  misc_feature (1)..(477): Functional Homolog Of Ceres SEEDLINE ID no. ME06336
MWALFFGALIIISITHWVYRWRNPRCNGTLPPGSMGLPLIGETLQFFAPNTSCDISPFVRDRMKRYGPIFRTNLVGRPVVVSTDPDLNYFIFQQEGKLFQSWYPDTFTEIFGRQNVGSLHGFMYKYLKNMVLNLFGPESLKKMLPEVEQTASNRLQLWSHQESVELKEATATMIFDLTAKKLISYDQENSSENLRENFVAFIQGLISFPLDIPGTAYHECLQGRKKAMRMLKNLLQERQANPRKHETDFFDYVLEELQKNKTILTEEIALDLMFVLLFASFETTSLGLTLAVKFISDHPLVLKELTEEHEGILKNRENANSGLTWKEYKSMKFTFQVINETVRLANIVPGIFRKTLRDIQFKGYTIPAGWAVMVCPPAVHLNPAKYEDPLAFNPWRWKGMEVNGASKTFMAFGGGMRFCVGTEFTKVQMAVFLHCLVTKSRWQAIKGGNIVRTPGLQFPSGYHIQLTERDKRYNSTT

SEQ ID NO: 4059 - DNA, 1446 bp, Populus balsamifera subsp. trichocarpa
  misc_feature (1)..(1446): useful for making plants with increased salt and oxidative stress resistance as described in USSN 12/922,143
  misc_feature (1)..(1446): Ceres ANNOT ID no.1447391
atgtgggctttgttttttggagctttgattattataagcatcacacattgggttcaccgctggagaaaccccagatgcaatggcactcttccaccaggttcaatgggattgccacttattggcgagacccttcaattcttcgctcctaatacttcttttgatatccctccctttgtcaaagaaaggatgaaaagatatggaccaatattccggactaatttggttggaaggccagttgtagtatcaacggacccggatctcaattactttatcttccaacaagagggacaattgttccagagctggtatccagatacattcacagagatttttggaaggcaaaatgtcggctcattacatgggttcatgtacaagtatcttaagaatatggtgcttaatctctttggtccagaaagccttaagaaaatgctccctgaagttgaacagacaacatccaagagattacaactatggtcccatcaagagtcagtcgaattaaaagaaacaactgcaactatgatattcgatctgacagcaaagaagctcataagttatgatcaagataattcttcggagaatctaagggacaactttgttgcattcatacacggattgatctccttccctttggacattccaggaacagcatatcacgaatgcttacggggtaggaaaaaggcaatgagaatgctaaaaaaccagctacaggaaagacgagcaaatccgagaaagtaccgaagtgattttttcgattatgtgcttgaagaacttcaggaggacagaggaatccttacagaggaaattgctctggatttaatgtttgtgctgctatttgctagctttgaaacaacttccctggctctaactttagccgtcaaatttctctcggataatccgttggtgctaaagaaactaacggaagagcacgagggaattctgagaaatcgggtagatagcaactctggtcttacatggaacgaatacaaatcaatgaaattcacatttcaggtaattaatgaaacagttagactggcaaacatagttccagggattttcagaaaagcacttagagacatccagtttaagggatataccattccagaaggttgggcagtaatggtttgtccccctgcagtacacttaagcccagaaaaatatgaagatccacttgccttcaatccatggagatgggagggattggaattaaacggtgcatcaaaaaaattcatggcttttggtggcggcatgagattttgtgttggaacagagtttaccaaggtgcagatggctgtatttctacattgcctggtcacaaagttcagatggcaagtaatcaaaggaggaaatattgttcgaactcctggtttacaatttccaagtggttatcacattcagctcatggagagagacaaaaaaatacaactcacgcaatcatatgcccagtaa

SEQ ID NO: 4060 - protein, 481 aa, Populus balsamifera subsp. trichocarpa
  misc_feature (1)..(481): useful for making plants with increased salt and oxidative stress resistance as described in USSN 12/922,143
  misc_feature (1)..(481): Ceres ANNOT ID no.1447391
  misc_feature (1)..(481): Bit score of 478.2 for HMM based on sequences of FIGURE 7 of USSN 12/922,143.
  misc_feature (212)..(466): Pfam Name: p450 Pfam Description: Cytochrome P450
  misc_feature (1)..(481): Functional Homolog Of Ceres SEEDLINE ID no. ME06336
MWALFFGALIIISITHWVHRWRNPRCNGTLPPGSMGLPLIGETLQFFAPNTSFDIPPFVKERMKRYGPIFRTNLVGRPVVVSTDPDLNYFIFQQEGQLFQSWYPDTFTEIFGRQNVGSLHGFMYKYLKNMVLNLFGPESLKKMLPEVEQTTSKRLQLWSHQESVELKETTATMIFDLTAKKLISYDQDNSSENLRDNFVAFIHGLISFPLDIPGTAYHECLRGRKKAMRMLKNQLQERRANPRKYRSDFFDYVLEELQEDRGILTEEIALDLMFVLLFASFETTSLALTLAVKFLSDNPLVLKKLTEEHEGILRNRVDSNSGLTWNEYKSMKFTFQVINETVRLANIVPGIFRKALRDIQFKGYTIPEGWAVMVCPPAVHLSPEKYEDPLAFNPWRWEGLELNGASKKFMAFGGGMRFCVGTEFTKVQMAVFLHCLVTKFRWQVIKGGNIVRTPGLQFPSGYHIQLMERDKKIQLTQSYAQ

SEQ ID NO: 4061 - protein, 701 aa, Oryza sativa subsp. indica
  misc_feature (1)..(701): useful for making plants with increased salt and oxidative stress resistance as described in USSN 12/922,143
  misc_feature (1)..(701): Public GI ID no.125533359
  misc_feature (1)..(701): Bit score of 630.9 for HMM based on sequences of FIGURE 7 of USSN 12/922,143.
  misc_feature (230)..(470): Pfam Name: p450 Pfam Description: Cytochrome P450
  misc_feature (1)..(701): Functional Homolog Of Ceres SEEDLINE ID no. ME06336
MAAAPVLLLAAAAAVVVVAMVLRWLLLLGGPAAGRLGKRALMPPGSTGLPLIGETLRLISAYKTPNPEPFIDERVARHGGVFTTHVFGERTVFSADPAFNRLLLAAEGRAVHSSYPSSIATLLGARSLLLTRGAAHKRLHSLTLTRLGRPASPPLLAHIDRLVLATMRQWEPAATVRLMDEAKKITFNLTVKQLVSIEPGPWTESLRREYVKLIDGFFSIPFPLANLLPFTTYGQALKARKKVADALREVIKKRMEEKAENGGSIGDDEGKKEKKDMVEELLEAEGGSFSEEEMVDFCLSLLVAGYETTSVLMTLAVKFLTETPAALAELKEEHANIRDMKGKKQPLEWSDYKSMPFTQCVINETLRVGNIISGVFRRANTDIHYKDYTIPKGCKIFASFRAVHLNNEHYENARTFNPWRWQINNKLQNAVGANIFTPFGGGPRLCPGYELARVVVSIFLHHLVTRFRLERFCDKFSSTVYSTYSIAHSDAQKRNLHARKFDCLTIRSLPLAHKESGSVHCAWNADHVPEPEPGVSNGHSPASASAWVGSAKRQSGQRRLTCSHSKMQLSWKAWQHGIFLISLSLSSSKASRHTEQSFSFASPGDVSSKAAMASLHAGTEPKRPLLYPSGTAAAALGLWKVGRQNKDRGRGRGRCRGSLQPPVHVVGQQQSSCGRHAPATRTRMRATLGTNEQLADREFED

SEQ ID NO: 4062 - DNA, 1467 bp, Sorghum bicolor
  misc_feature (1)..(1467): useful for making plants with increased salt and oxidative stress resistance as described in USSN 12/922,143
  misc_feature (1)..(1467): Ceres ANNOT ID no.6112764
atggctggggagctcgtgctggccgctgtggcgaccctgctcgcgtcgtcgctcctggctctggtgctcagccacttcctgcctttgcttctgaatcccaaggcccccaagggaagcttcgggtggccgctcctcggcgagacgctgcggttcctcacgccgcacgcgtccaacacgctgggcggcttcctggaggatcactgctccaggtatgggcaggtgttcaagtcccacctgttctgcacccccacggtggtgtcctgcgaccaggacctcaaccacttcatcctgcagaacgaggagcggctgttccagtgcagctaccccaggccgatccatggcatcctgggcaagtcctccatgctcgtggtcctgggcgaggaccacaagcgcctcaggaacctcgccctcgccctcgtcacctccaccaagctcaagcccagctacctcggcgacatcgagaagatcgcgctgcacgtcgtcggcgcatggcgacgacacgacggcggcggcggcggcggcggcggcggcggcgtcagagtcatcgccttctgcgaggaggcaagaaagttcgcattcagtgtgatagtgaagcaggtgctggggctgtcaccagaggagccggtcactgcaaggatactggaggacttcctggccttcatgaagggcctcatctccttccctctctacatcccagggaccccatatgccaaggctgtccaggcgagggagaggatatccaacactgtgaagggcatcatcgaggagcggaggagtgctgggtcatgcaacaagggtgacttccttgacgtgctgctgtcaagcaacgagctctctgacgaggagaaagtgagcttcgtgctggactccctgctgggaggatatgagaccacctcgctcctcatctccatggtcgtttacttccttgggcagtctgctcaagatctggacctggttaagagggagcacgacagcataagatccaacaaagggaaggaggagtgcttgacttcagaagactacaagaagatggaatatacccaacaagttatcaacgaggcgctgagatgtggcaacattgtcaagtttgtccaccggaaggcgctcaaagatgtcaaatacaaagagtatctgattccatctggctggaaggtcctaccggtcttcagcgctgttcatctgaacccctcacttcatggaaacgcacaacagtttcagccctgtagatgggaggggacaagccaagggacaagcaagaggtttacaccgttcggtggtggcccccggctctgcccaggatcagagcttgctaaagtagaggctgctttcttcctccatcaccttgtcctcaattatagatggagaattgatggcgatgacattccgatggcatacccatatgtggagtttcagagaggtctgccaatagaaatcgagccaacttcacctgaatctggactgtcctga

SEQ ID NO: 4063 - protein, 488 aa, Sorghum bicolor
  misc_feature (1)..(488): useful for making plants with increased salt and oxidative stress resistance as described in USSN 12/922,143
  misc_feature (1)..(488): Ceres ANNOT ID no.6112764
  misc_feature (1)..(488): Bit score of 1211.0 for HMM based on sequences of FIGURE 7 of USSN 12/922,143.
  misc_feature (229)..(466): Pfam Name: p450 Pfam Description: Cytochrome P450
  misc_feature (1)..(488): Functional Homolog Of Ceres SEEDLINE ID no. ME06336
MAGELVLAAVATLLASSLLALVLSHFLPLLLNPKAPKGSFGWPLLGETLRFLTPHASNTLGGFLEDHCSRYGQVFKSHLFCTPTVVSCDQDLNHFILQNEERLFQCSYPRPIHGILGKSSMLVVLGEDHKRLRNLALALVTSTKLKPSYLGDIEKIALHVVGAWRRHDGGGGGGGGGGVRVIAFCEEARKFAFSVIVKQVLGLSPEEPVTARILEDFLAFMKGLISFPLYIPGTPYAKAVQARERISNTVKGIIEERRSAGSCNKGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFSAVHLNPSLHGNAQQFQPCRWEGTSQGTSKRFTPFGGGPRLCPGSELAKVEAAFFLHHLVLNYRWRIDGDDIPMAYPYVEFQRGLPIEIEPTSPESGLS

SEQ ID NO: 4064 - DNA, 1440 bp, Sorghum bicolor
  misc_feature (1)..(1440): useful for making plants with increased salt and oxidative stress resistance as described in USSN 12/922,143
  misc_feature (1)..(1440): Ceres ANNOT ID no.6081804
atggtgacgactgtgctgctggctgtctttgtagccgccgccgtcctcgccgcggtggtgtaccgccacttcgtgccgctgctccgcaaccccggcgccccaaggggcagcttcggctggcccctcgtcggtgagaccatcggcttcctccgcccccacgcctccaacaccaccggcgacttcttgcacagtcacatcaccaggtacggcgcggtgttcaagtcgcacctgttcggcgcgccgacggtggtgtcgtgcgacgaggagctcaaccagttggtgctgcagaacgaggagcgactgttccagtgcagctacccgggctccatccggggcatcctgggcgcgtcctccctgctggtggtcacgggcgagcgccaccgccggatccgcggcgtgtcgctggcattcgtcgcctccagggggatgcgccccgcccacctcgccgacgtcgaccgggccgcgcgcgccgccatcgcgtcctggcgcggccgctgcggcgccgtcgttgtcttctgcgacgaggcaagacaggtgctgggcttgtccccggaggagccgctcatccgcaggctcctggagcactactccaccttcatgaaagggctcgtcgctctccctctcaacatccctgggacaccgtatgccagagctgtagaggcgaggaggaagatatctctcactttggaagagattatggacgagaggtggaaggaagatgggtcatccaggaagtcatccgctttcctagacgtgctcatcgcaaatagcgagctgtcccacgatgacaaggtcaccttcctgctggactcgcttttagcaggctatgagaccacctccgtcttgctgtccatgctcgtgtatttcatcgggcaatctccccagtgtttgcagcaactcaaggttgagcatgagagcataaggtccagcaaggggacagatgagttcttgaacgctgaagactacaggaagatggaatatacccaacgtgttatcaacgagacgttaagatgcggtaacattgtcaagtttctgcaccggaaggccctcaaggatgtcaaatataaagggtatgtgatcccagctggctggaaagtgctgccaattttgagctccgttcatttggaccctgctctctacaagaaccctcaagagttcgatccttgcagatgggaggggcaggaccaggcgtcgtcaggcaagaagtttgcgccgttcggcggcgggctccggctgtgccccggatcggagctgggcaaactggaggctgccttcttcctgcaccacctcgtgctccagtacaggtggagcttggacggcgaggacgtcccgatggcgcacccgtacgtggagttcagcaagggcctgcccatcaagatatggcgccaccagcaggagtcgtctgatacgacgatcccttggttcgtcgggcagctgtag

SEQ ID NO: 4065 - protein, 479 aa, Sorghum bicolor
  misc_feature (1)..(479): useful for making plants with increased salt and oxidative stress resistance as described in USSN 12/922,143
  misc_feature (1)..(479): Ceres ANNOT ID no.6081804
  misc_feature (1)..(479): Bit score of 917.3 for HMM based on sequences of FIGURE 7 of USSN 12/922,143.
  misc_feature (184)..(445): Pfam Name: p450 Pfam Description: Cytochrome P450
  misc_feature (1)..(479): Functional Homolog Of Ceres SEEDLINE ID no. ME06336
MVTTVLLAVFVAAAVLAAVVYRHFVPLLRNPGAPRGSFGWPLVGETIGFLRPHASNTTGDFLHSHITRYGAVFKSHLFGAPTVVSCDEELNQLVLQNEERLFQCSYPGSIRGILGASSLLVVTGERHRRIRGVSLAFVASRGMRPAHLADVDRAARAAIASWRGRCGAVVVFCDEARQVLGLSPEEPLIRRLLEHYSTFMKGLVALPLNIPGTPYARAVEARRKISLTLEEIMDERWKEDGSSRKSSAFLDVLIANSELSHDDKVTFLLDSLLAGYETTSVLLSMLVYFIGQSPQCLQQLKVEHESIRSSKGTDEFLNAEDYRKMEYTQRVINETLRCGNIVKFLHRKALKDVKYKGYVIPAGWKVLPILSSVHLDPALYKNPQEFDPCRWEGQDQASSGKKFAPFGGGLRLCPGSELGKLEAAFFLHHLVLQYRWSLDGEDVPMAHPYVEFSKGLPIKIWRHQQESSDTTIPWFVGQL

SEQ ID NO: 4066 - DNA, 1518 bp, Sorghum bicolor
  misc_feature (1)..(1518): useful for making plants with increased salt and oxidative stress resistance as described in USSN 12/922,143
  misc_feature (1)..(1518): Ceres ANNOT ID no.6109091
atgggcgccatgatggcctccataaccagggagctcctcttcttcctccccttcatcctgctggccctcctcgccctgtacaccaccaccgtcgccaaatgccacgccacccaccaccagtggcgccggccgaagaagaagcggccgaacctgcccccgggcgccctcggatggcctttcgtcggcgagaccttcggctacctccgcgcccacccggccacctccgtcggccgcttcatggagcagcacgtcgcacggtacggcaagatataccggtcgagcctgttcggggagcggacggtggtgtcggcggacgcggggctgaaccgctacatcctgcagaacgaggggcggctgttcgagtgcagctacccgcgcagcatcggcggcatcctgggcaagtggtccatgctggtgctggtgggcgacgcgcaccgggagatgcgcgccatctcgctcaacttcctcagctccgtccgcctccgcgccgtgctgctgccggaggtggagcgccacaccctgctggtgctccgctcctggccgccctccgacggcaccttctccgcgcagcaccaagccaagaagttcacgtttaacctgatggcgaagaacataatgagcatggaccccggcgaggaggagacggagcggctgcggctggagtacatcaccttcatgaagggcgtcgtgtcagcgccgctcaacttcccgggcacggcctactggaaggcgctcaagtcacgcgcgtccatacttggagtaatagagaagaagatggaggacaggcttgagaaaatgagcaaggagaactcgagtgtggaggaagatgatcttcttggatgggccctgaagcagtccaatctgtcaaaggaacagatcctggacctcttgctgagcctgctcttcgctgggcacgagacctcgtcaatggcgctggccctcgccatcttcttccttgaaggatgccctaaggctgttcaagaactccgggaagagcatctggagattgctaggagacaaaggcaaagaggggcgtccaaattgagctgggaagactacaaggaaatggttttcacgcaatgtgttataaacgagacattgcggcttggcaacgtggtcaggttcctgcaccggaaggtcatccgagatgtgcactacaatgggtacgacataccacgggggtggaaaatcctgccggttttagcggcagtgcatctggattcgtcgttgtacgaggaccccaaccggttcaacccttggagatggaagagcaacgcgccgagcagtttcatgccgtacggcggcgggccgcggctgtgcgccgggtcggagctggccaagctggagatcgccatcttcctgcaccacctggtgctcaacttccggtgggagctggcggaggcggaccaggccttcgtctaccccttcgtcgacttccccaagggcctgccgatcagggtccagcggatcgccgacgaccaagggcatcgcagcgttttgaccgagagcacaatgtag

SEQ ID NO: 4067 - protein, 505 aa, Sorghum bicolor
  misc_feature (1)..(505): useful for making plants with increased salt and oxidative stress resistance as described in USSN 12/922,143
  misc_feature (1)..(505): Ceres ANNOT ID no.6109091
  misc_feature (1)..(505): Bit score of 940.0 for HMM based on sequences of FIGURE 7 of USSN 12/922,143.
  misc_feature (284)..(470): Pfam Name: p450 Pfam Description: Cytochrome P450
  misc_feature (1)..(505): Functional Homolog Of Ceres SEEDLINE ID no. ME06336
MGAMMASITRELLFFLPFILLALLALYTTTVAKCHATHHQWRRPKKKRPNLPPGALGWPFVGETFGYLRAHPATSVGRFMEQHVARYGKIYRSSLFGERTVVSADAGLNRYILQNEGRLFECSYPRSIGGILGKWSMLVLVGDAHREMRAISLNFLSSVRLRAVLLPEVERHTLLVLRSWPPSDGTFSAQHQAKKFTFNLMAKNIMSMDPGEEETERLRLEYITFMKGVVSAPLNFPGTAYWKALKSRASILGVIEKKMEDRLEKMSKENSSVEEDDLLGWALKQSNLSKEQILDLLLSLLFAGHETSSMALALAIFFLEGCPKAVQELREEHLEIARRQRQRGASKLSWEDYKEMVFTQCVINETLRLGNVVRFLHRKVIRDVHYNGYDIPRGWKILPVLAAVHLDSSLYEDPNRFNPWRWKSNAPSSFMPYGGGPRLCAGSELAKLEIAIFLHHLVLNFRWELAEADQAFVYPFVDFPKGLPIRVQRIADDQGHRSVLTESTM

SEQ ID NO: 4068 - DNA, 1545 bp, Sorghum bicolor
  misc_feature (1)..(1545): useful for making plants with increased salt and oxidative stress resistance as described in USSN 12/922,143
  misc_feature (1)..(1545): Ceres ANNOT ID no.6099094
atggacgcgggcggttcgccgccactgttcctccttgccgcggcggcgaccgccgtgctggccgccgcggcgctggggtggctgctcctggccggcgggcgggcggccgcggcggggcggcggcggcggtccgcgtcgtcggcgccgcggctgccaccgggcagcacggggctgccgctcatcggggagacgctgcggctcatcgcggcgtacaagacgccgaacccggagccgttcatcgacgagcgcgtgacgcggcacggaacccgggtgttcaccacgcacgtcttcggcgagcgcaccgtcttttccgccgacccggccttcaaccgcctcctgctggcggccgagggccgcgccgtcagctgcagctacccgtcctccatcgccacgctgctcggcccgcgctcgctgctcctcacggcgggtcccgcgcacaagcgcctccactcgctcacgctcacccgcctggggcgtccggcctcgccgccgctgctggcgcacatcgaccgcctcgtcctcgccaccatgagggactggggccgccccggcgccgcccccgtccgcctcctcgacgaggccaagaagatcaccttcaacctcaccgtctggcagctcgtcagcatcgagcccgggccatggaccgagagcgtccgccgcgagtatgtcaagctcatcgacggcttcttctccatccccttccccttcgcctacctcctccctttcaccgtctacggccaggccctcaaggcgaggaagaaggtggccggagctcttcgggaggtgataaggaagaggatggacgagaaggcggagaccggtggcgccagtaagaatggggaggatgaggagaagagggagaagaaggacatggtggaggagcttctcgaagcagagggtgggagcttctccgtggaggagatggtggatttctgcctgtctctgctggtggctggctacgagaccacctccgtgctcatgacgctcgccgtcaagttcctcaccgagacacccgctgcactggcgcagctgaaggaagagcatgacaatatcagaggcataaaaggcaaagaccaacctctggaatggagtgattacaagtcgatgccatttacacaatgtgtgataagtgaaacactgcgcgtggctaacttaattggcggggtgttcaggcgtgcaaacactgatattcactttaaagattacgttattccaaagggctgcaaaatattcgcttcgttccgagctgtgcaccttaatctggaacactatgagaatgctcggaccttcgacccttggagatggcagagcaagaacaagcttcagaatgcagaaggggcaagtctgttcactcccttcggcggcggacctcgcctgtgcccgggctacgagcttgcccgggtggtggtttctgttttcctccaccatctcgtcacatgctttagctgggaagaagctgaggaggacaggattgtcttcttccccaccacccggaccctcaaaggataccccatcaacctgcggcggcgaccggattatgcatga

SEQ ID NO: 4069 - protein, 514 aa, Sorghum bicolor
  misc_feature (1)..(514): useful for making plants with increased salt and oxidative stress resistance as described in USSN 12/922,143
  misc_feature (1)..(514): Ceres ANNOT ID no.6099094
  misc_feature (1)..(514): Bit score of 667.1 for HMM based on sequences of FIGURE 7 of USSN 12/922,143.
  misc_feature (245)..(509): Pfam Name: p450 Pfam Description: Cytochrome P450
  misc_feature (1)..(514): Functional Homolog Of Ceres SEEDLINE ID no. ME06336
MDAGGSPPLFLLAAAATAVLAAAALGWLLLAGGRAAAAGRRRRSASSAPRLPPGSTGLPLIGETLRLIAAYKTPNPEPFIDERVTRHGTRVFTTHVFGERTVFSADPAFNRLLLAAEGRAVSCSYPSSIATLLGPRSLLLTAGPAHKRLHSLTLTRLGRPASPPLLAHIDRLVLATMRDWGRPGAAPVRLLDEAKKITFNLTVWQLVSIEPGPWTESVRREYVKLIDGFFSIPFPFAYLLPFTVYGQALKARKKVAGALREVIRKRMDEKAETGGASKNGEDEEKREKKDMVEELLEAEGGSFSVEEMVDFCLSLLVAGYETTSVLMTLAVKFLTETPAALAQLKEEHDNIRGIKGKDQPLEWSDYKSMPFTQCVISETLRVANLIGGVFRRANTDIHFKDYVIPKGCKIFASFRAVHLNLEHYENARTFDPWRWQSKNKLQNAEGASLFTPFGGGPRLCPGYELARVVVSVFLHHLVTCFSWEEAEEDRIVFFPTTRTLKGYPINLRRRPDYA

SEQ ID NO: 4070 - DNA, 1578 bp, Sorghum bicolor
  misc_feature (1)..(1578): useful for making plants with increased salt and oxidative stress resistance as described in USSN 12/922,143
  misc_feature (1)..(1578): Ceres ANNOT ID no.6071126
atgtggcccatcatcatcaggggcggttcttggccaccgtcgtccgtcgacgtcggctctgtcacggcggcgctgctcctcgccgccgccgtcatcttcatcccccgtgtctggtcttcatcaagaactagaaggccgcaggtaccggcgagcggcggcagtactgccggaggagcacggctccctgccggctcgctcgggtggccgctcctcggcgagacgctggccttcatccgggctgcgtattctcctcgcccggagtccttcgtcgagaaacgccgcctctggtacggcaaggtgttcaagtcgcacctgtggggttccccggcggtggtgagctcggacccggaggtgagccgcgcggtgctgcaggccgacgcgtcggcgttcgtgccgtggtacccgcggtcgctcatggagctgatggggcagtcgtccatcctggtgctcggcggcggcctccagcgccgggtgcacggcctcgccggcgccttcttcaagtcgccacagctcaaggcgcaggtcaccgccgacatgcagcgccgcgtcggccgcgccatggacgtctggagcaggcgccatcaccggagcatgagcagcaacggctgcggcggcgcaccgcccgtgcgggtacaggacgaggccaagtcgattgtgtttgaaatcctagtgagagcgctgattgggatagaggaaggagacgaaatgcagtacctcaggcaacaatttcaggaattcattgccggtttgatatcacttcctgtcaaacttccagggtgtcaactctatagatccctcagggctaagaagaggatgacaaagttgataaaaatgatcatccaagagaagaggaagaagatgatcgccgaaggcgaggatctgcgtgggactcatccacgtgatatgatcgacgttctgctaggcaatggcaacgacgagctcactgacgagctgatatctgacaacatgatcgacttcatgatccctgcagaggactccgtgccggtgctcattacgttggcagtcaagtatctcagcgaatgcccactagctttgcagcagctcgaggaggagaacatggagctaaagagccagaaatcagacacgggagaaaccctagaatggacagactacatgtcgctcaccttcacacagcacgtgatcacggagacgctgcggatgggcaacatcataaacgggatcatgcggaaggcggtgcgggacgtggaggtgaggggccacctcatccccaagggctggcgcgtcctcgtctacttccgcgccgtccacctcgacgccgccgtccacgacgacccgcacgccttcaacccctggaggtggaaggagagggccgacgtggtaccggtcatgagcagcggcggcggcggcggcttcacccccttcggcggcggccagaggctgtgcccggggctcgacctggcaaggctcgaggcctccatctttctgcaccatctcgtcaccagcttcaggtgggtggcggaggaggacaccgtcgtcaacttccccacggtgcggctcaagcgagggatgccaatcacagtgacgcctagaacctga

SEQ ID NO: 4071 - protein, 525 aa, Sorghum bicolor
  misc_feature (1)..(525): useful for making plants with increased salt and oxidative stress resistance as described in USSN 12/922,143
  misc_feature (1)..(525): Ceres ANNOT ID no.6071126
  misc_feature (1)..(525): Bit score of 776.7 for HMM based on sequences of FIGURE 7 of USSN 12/922,143.
  misc_feature (371)..(498): Pfam Name: p450 Pfam Description: Cytochrome P450
  misc_feature (1)..(525): Functional Homolog Of Ceres SEEDLINE ID no. ME06336
MWPIIIRGGSWPPSSVDVGSVTAALLLAAAVIFIPRVWSSSRTRRPQVPASGGSTAGGARLPAGSLGWPLLGETLAFIRAAYSPRPESFVEKRRLWYGKVFKSHLWGSPAVVSSDPEVSRAVLQADASAFVPWYPRSLMELMGQSSILVLGGGLQRRVHGLAGAFFKSPQLKAQVTADMQRRVGRAMDVWSRRHHRSMSSNGCGGAPPVRVQDEAKSIVFEILVRALIGIEEGDEMQYLRQQFQEFIAGLISLPVKLPGCQLYRSLRAKKRMTKLIKMIIQEKRKKMIAEGEDLRGTHPRDMIDVLLGNGNDELTDELISDNMIDFMIPAEDSVPVLITLAVKYLSECPLALQQLEEENMELKSQKSDTGETLEWTDYMSLTFTQHVITETLRMGNIINGIMRKAVRDVEVRGHLIPKGWRVLVYFRAVHLDAAVHDDPHAFNPWRWKERADVVPVMSSGGGGGFTPFGGGQRLCPGLDLARLEASIFLHHLVTSFRWVAEEDTVVNFPTVRLKRGMPITVTPRT

SEQ ID NO: 4072 - DNA, 1533 bp, Sorghum bicolor
  misc_feature (1)..(1533): useful for making plants with increased salt and oxidative stress resistance as described in USSN 12/922,143
  misc_feature (1)..(1533): Ceres ANNOT ID no.6100227
atgtcgatcaccaccctgcagcttcttccgtggccgccggagccagcgcgcgccgccgtgctgccgcccctgctgctcgcggcggcggcggcggtcgtcgtctgcctgtgggcgctgctgtcccgcaggctcatcagcagggagcgggccgccggagggaaggagcaggcggtcccggcacggctcccgcctggcagcttcgggtggccggtcgtcggcgagacgctggagttcgtgtcctgcgcctactcctcccgcccggaggccttcgtcgacaagcgccgcctgctgcacgggagcgcggtgttccggtcgcacctgttcggctcggcgacggtggtgacgtcggacgcggaggtgagccggttcgtgctgcagagcgacgcgcgcgccttcgtgccctggtacccgcgctcgctgacggagctcatgggcaagtcctccatcctgctcatcaacggcagcctgcagcggcgcgtgcacggcctcgtcggcgccttcttcaagtcgccgcagctcaaggcgcaggtcaccgccgacatgcagcggcgactcgcgcccgcgctcgacgcctggcgggccagaggccccgccgcgccgccgctccgcatccaggaccacgccaagacgcagatcgtgttcgagatcctggtgaagggtctgatcgggctggaggcaggcccggagatgcagcagctcaagcaccagttccaggaattcattgtcggcctcatgtccctccccatcaagctgccggggactaggctctacaggtccctccaggccaagaagaggatggccaggctgatacaggggatcatacaggagaagaggcggcggcttgacgacggcggcaagggcgagcccggccccccgcgcgacgccatcgacgtgctcataagcggcggcagcgacgagctcaccgacgacctcatctccgacaacatgatcgacctgatgatccccgccgaggactctgtgcccgtgctcatcacgctcgccgtcaagtatctcagcgagtgcccgcttgctctgcaacagctcgaggaggagaacatgcagctcaaaaggcgaaaaaccgacatgggagagaccttgcagtggacagactacatgtcactgtcattcacacaacatgtgataacagagacactgcggatgggcaatatcatcaacggaatcatgcgcaaggcggtgcgggacgttgaggtgaaagggcacctcatccccaaaggttggtgcgtgttcgtgtacttccggtcggtccaccttgacgacaagcgctacgatgagccctacaggttcaatccatggaggtggaaggagaaggacacgagcaccagcagcttcaccccttttggtggtgggcagaggctgtgcccaggcctggatctggccaggctggaagcttccatctttctccatcacttggtgaccagcttcaggtgggtggcggaggaggaccacatcgtcaacttcccaaccgtgcggctgaagcgaggcatgcccatcaggctcaccagcaaagactag

SEQ ID NO: 4073 - protein, 510 aa, Sorghum bicolor
  misc_feature (1)..(510): useful for making plants with increased salt and oxidative stress resistance as described in USSN 12/922,143
  misc_feature (1)..(510): Ceres ANNOT ID no.6100227
  misc_feature (1)..(510): Bit score of 845.8 for HMM based on sequences of FIGURE 7 of USSN 12/922,143.
  misc_feature (364)..(483): Pfam Name: p450 Pfam Description: Cytochrome P450
  misc_feature (1)..(510): Functional Homolog Of Ceres SEEDLINE ID no. ME06336
MSITTLQLLPWPPEPARAAVLPPLLLAAAAAVVVCLWALLSRRLISRERAAGGKEQAVPARLPPGSFGWPVVGETLEFVSCAYSSRPEAFVDKRRLLHGSAVFRSHLFGSATVVTSDAEVSRFVLQSDARAFVPWYPRSLTELMGKSSILLINGSLQRRVHGLVGAFFKSPQLKAQVTADMQRRLAPALDAWRARGPAAPPLRIQDHAKTQIVFEILVKGLIGLEAGPEMQQLKHQFQEFIVGLMSLPIKLPGTRLYRSLQAKKRMARLIQGIIQEKRRRLDDGGKGEPGPPRDAIDVLISGGSDELTDDLISDNMIDLMIPAEDSVPVLITLAVKYLSECPLALQQLEEENMQLKRRKTDMGETLQWTDYMSLSFTQHVITETLRMGNIINGIMRKAVRDVEVKGHLIPKGWCVFVYFRSVHLDDKRYDEPYRFNPWRWKEKDTSTSSFTPFGGGQRLCPGLDLARLEASIFLHHLVTSFRWVAEEDHIVNFPTVRLKRGMPIRLTSKD

SEQ ID NO: 4074 - DNA, 515 bp, Arabidopsis thaliana
  misc_feature (1)..(515): useful for making plants with increased salt and oxidative stress resistance as described in USSN 12/922,143
  misc_feature (1)..(515): Ceres SEEDLINE ID no.ME07302
  misc_feature (1)..(515): Expected Sequence
  misc_feature (503)..(503): k is g or t/u
aatataaaaccataatctctcagttgattaaaaacaccattatctctcaagtcttaatacgaaaaaaatggaatccaagagatcatcatcttctcctctactaattttgattaccaccatcatgatcatattcatcatttctggacctaaatctgtcgatgcagattgcaaacacccggttggaccgtacacggactcatgctttacggattgcgtatctggaaaatatggatataattatgaatccgctttttgtagccgtgacgagaccggaacttgtaaaatatgttgctgcgaacttatcaacgaataggtgcatatgcatttgcatgtttcaatgtatggttggtaacaaaaaaaaaagatgtggagaaagagaacaaattatatacttgtcttccctattttaaagtcaatgcataacccttaaaattattatttacttgcacaatcttgcaatgcttgtaatttaatatatatgacataacaatgtgtatctttgktatgcacattat

SEQ ID NO: 4075 - DNA, 658 bp, Arabidopsis thaliana
  misc_feature (1)..(658): useful for making plants with increased salt and oxidative stress resistance as described in USSN 12/922,143
  misc_feature (1)..(658): Ceres SEEDLINE ID no.ME07302
  misc_feature (1)..(658): Inplanta Sequence
gggatgacgcacaatcccactatccttcgcaagacccttcctctatataaggaagttcatttcatttggagagaacacgggggactctggcctgcagggccatcaccactgcagtggtacctagaacatcctaatcaaaaaatataaaaccataatctctcagttgattaaaaacaccattatctctcaagtcttaatacgaaaaaaatggaatccaagagatcatcatcttctcctctactaattttgattaccaccatcatgatcatattcatcatttctggacctaaatctgtcgatgcagattgcaaacacccggttggaccgtacacggactcatgctttacggattgcgtatctggaaaatatggatataattatgaatccgctttttgtagccgtgacgagaccggaacttgtaaaatatgttgctgcgaacttatcaacgaataggtgcatatgcatttgcatgtttcaatgtatggttggtaacaaaaaaaaaagatgtggagaaagagaacaaattatatacttgtcttccctattttaaagtcaatgcataacccttaaaattattatttacttgcacaatcttgcaatgcttgtaatttaatatatatgacataacaatgtgtatctttgttatgcacattatgat

SEQ ID NO: 4076 - protein, 83 aa, Arabidopsis thaliana
  misc_feature (1)..(83): useful for making plants with increased salt and oxidative stress resistance as described in USSN 12/922,143
  misc_feature (1)..(83): Ceres SEEDLINE ID no.ME07302
MQIANTRLDRTRTHALRIAYLENMDIIMNPLFVAVTRPELVKYVAANLSTNRCICICMFQCMVGNKKKRCGEREQIIYLSSLF

SEQ ID NO: 4077 - protein, 90 aa, Arabidopsis thaliana
  misc_feature (1)..(90): useful for making plants with increased salt and oxidative stress resistance as described in USSN 12/922,143
  misc_feature (1)..(90): Public GI ID no.91806956
  misc_feature (1)..(90): Functional Homolog Of Ceres SEEDLINE ID no. ME07302
MQIANTRLDRTRTHALRIAYLENMDIIMNPLFVAVTRPELVKYVAANLSTNRCICICMFQCMVGNKKKKMWRKRTNYILVFPILKAMHNP

SEQ ID NO: 4078 - DNA, 1099 bp, Arabidopsis thaliana
  misc_feature (1)..(1099): useful for making plants with increased salt and oxidative stress resistance as described in USSN 12/922,143
  misc_feature (1)..(1099): Ceres SEEDLINE ID no.ME08052
aacacggtgtggtatatgtgttagctttcgtcttcgcctcggtttgggagccacatggatcggggcacagagattccgtgtgatcggggcacagagattccgtcgtaaaaaaatcgtgtcctcgccgacagggaaagccgtgttgcaagaaggggaattccgctgcgagatccgtgaacggttcagagatggcacagacggtgttcaccccctctttggaagcgatgaagcatgtcaaggcagagaacggagtcattctcaccaagcccttccttggatgtctgcaagcaaatattgcctgtcctcgataaatttggagctgctatggcaattgtaaagagtgatatcggcggcaatatcacaagactggaaaacaagtatacttcagaaccatcaaagtatgaacacttgtacagcatgattcaggaagaagttcaaaacaagaccgcaaaaggttcctcaagctgcacaaatgggcttctgtggctgacgagggccatggacttccttgttgagttgtttcgtaacctgcttgagcatccagactgggccatgagtcaatcttgcactgattcatacaccaagactttgaagaaatttcatggctggcttgccagttctagttttacggtggcaatgaagcttgctcctaatagagagaaatttatggaggtcattagtggaaccggtgacatcaatgcagatattgagaaattttgcacgaccttctctcctttcctcaaagaaaaccacaactttctggcgagcgtcggtcttgatgatctgaaggcttcatagatcaatctccatgctgattacaacaaaataagcatgtcttacgaaactcaaagtgttgccgagggtatacctgtttcccgtagccatctcccccttgaaaaactttaggagatggtaataatttgtcagcatgattgaccatggctacttacgcagagaattgacaccactcaacaaatttagttaccgaactctcgatcctgtgttacagcaaatcctatggttatgtggaactctggtgctgtaattctcttgtatgctacccagtatgccgcaggaaatcataattcggtgttccatt

SEQ ID NO: 4079 - DNA, 1119 bp, Arabidopsis thaliana
  misc_feature (1)..(1119): useful for making plants with increased salt and oxidative stress resistance as described in USSN 12/922,143
  misc_feature (1)..(1119): Ceres SEEDLINE ID no.ME08052
  misc_feature (1)..(1119): Inplanta Sequence
aacacggtgtggtatatgtgttagctttcgtcttcgcctcggtttgggagccacatggatcggggcacagagattccgtgtgatcggggcacagagattccgtcgtaaaaaaatcgtgtcctcgccgacagggaaagccgtgttgcaagaaggggaattccgctgcgagatccgtgaacggttcagagatggcacagacggtgttcaccccctctttggaagcgatgaagcatgtcaaggcagagaacggagtcattctcaccaagcccttccttgatgtctgcaagcaaatattgcctgtcctcgataaatttggagctgctatggcaattgtaaagagtgatatcggcggcaatatcacaagactggaaaacaagtatacttcagaaccatcaaagtatgaacacttgtacagcatgattcaggaagaagttcaaaacaagaccgcaaaaggttcctcaagctgcacaaatgggcttctgtggctgacgagggccatggacttccttgttgagttgtttcgtaacctgcttgagcatccagactgggccatgagtcaatcttgcactgattcatacaccaagactttgaagaaatttcatggctggcttgccagttctagttttacggtggcaatgaagcttgctcctaatagagagaaatttatggaggtcattagtggaaccggtgacatcaatgcagatattgagaaattttgcacgaccttctctcctttcctcaaagaaaaccacaactttctggcgagcgtcggtcttgatgatctgaaggcttcatagatcaatctccatgctgattacaacaaaataagcatgtcttacgaaactcaaagtgttgccgagggtatacctgtttcccgtagccatctcccccttgaaaaactttaggagatggtaataatttgtcagcatgattgaccatggctacttacgcagagaattgacaccactcaacaaatttagttaccgaactctcgatcctgtgttacagcaaatcctatggttatgtggaactctggtgctgtaattctcttgtatgctacccagtatgccgcaggaaatcataattcggtgttccattacaaaaaaaaaaaaaaaaaaa

SEQ ID NO: 4080 - protein, 202 aa, Arabidopsis thaliana
  misc_feature (1)..(202): useful for making plants with increased salt and oxidative stress resistance as described in USSN 12/922,143
  misc_feature (1)..(202): Ceres SEEDLINE ID no.ME08052
  misc_feature (1)..(202): Bit score of 556.1 for HMM based on sequences of FIGURE 13 of USSN 12/922,143.
  misc_feature (10)..(198): Pfam Name: GLTP Pfam Description: Glycolipid transfer protein (GLTP)
MAQTVFTPSLEAMKHVKAENGVILTKPFLDVCKQILPVLDKFGAAMAIVKSDIGGNITRLENKYTSEPSKYEHLYSMIQEEVQNKTAKGSSSCTNGLLWLTRAMDFLVELFRNLLEHPDWAMSQSCTDSYTKTLKKFHGWLASSSFTVAMKLAPNREKFMEVISGTGDINADIEKFCTTFSPFLKENHNFLASVGLDDLKAS

SEQ ID NO: 4081 - DNA, 984 bp, Zea mays
  misc_feature (1)..(984): useful for making plants with increased salt and oxidative stress resistance as described in USSN 12/922,143
  misc_feature (1)..(984): Ceres CLONE ID no.1556477
aggaggacctgccaaacgggcctctgctccagctaaccgcctgcctgccttttcttctctcgtccaccctaggtctcagtctctgtctctgtctctgctcgcgctcttgtggagctactaggtgaccgtcgcggccgccctacgccacgtgctcgatccagcctcgtcggcttcttcgcacccgtcaccggcggtcagcacccaccaggttcatagatggcagagacggtgttcaccccctctttggaagggatgaagcatgtgaaggcggagaacggagtcattctcaccaagcccttccttgatgtctgcaagcaaatcttgcctgtcctggataaatttggagctgctatggcaattgtaaagaatgatatcagcggcaatatcacaaggctggaaaacaagtattcttcagatccatcgaagtatggacacttgtacagcatggttcaggaagaagttcaaaacaagaccgcgaaaggttcctcaagctgcacaaatggtcttctgtggctcacgagggccatggatttccttgttgagttgttccgtaacctgcttgagcatccagactggaccatgactcaagcttgcactgattcatacaccaagaccctcaagaaatttcatggctggcttgccagttctagttttacggtggccatgaagctctctcctaatagagataaatttatggaggtcattagtggaactggtgatatcaatgcagatatggagaaattttgcacaaccttctctccttttctcaaagaaaatcacgagtttctggcgagcgttggtcttgatgatatgaaggcttcgtagagcgatctccaaggtggtgattacaacaaaataagcgtgtcttatcaaactcaagtgttgcagaggatatacctgttttctgtagccatctccccattgaaaattatacagggtgataataatttttccgcatgattaaccatggctacttacacagct

SEQ ID NO: 4082 - protein, 202 aa, Zea mays
  misc_feature (1)..(202): useful for making plants with increased salt and oxidative stress resistance as described in USSN 12/922,143
  misc_feature (1)..(202): Ceres CLONE ID no.1556477
  misc_feature (1)..(202): Bit score of 548.5 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
MAETVFTPSLEGMKHVKAENGVILTKPFLDVCKQILPVLDKFGAAMAIVKNDISGNITRLENKYSSDPSKYGHLYSMVQEEVQNKTAKGSSSCTNGLLWLTRAMDFLVELFRNLLEHPDWTMTQACTDSYTKTLKKFHGWLASSSFTVAMKLSPNRDKFMEVISGTGDINADMEKFCTTFSPFLKENHEFLASVGLDDMKAS

SEQ ID NO: 4083 - DNA, 972 bp, Zea mays
  misc_feature (1)..(972): useful for making plants with increased salt and oxidative stress resistance as described in USSN 12/922,143
  misc_feature (1)..(972): Ceres CLONE ID no.236892
gggcctctgctccagctaaccgcctgcctgccttttcttctctcgtccaccctaggtctcagtctctgctcgcgctcttgtggagctactaggtgaccgtcgcggacgccctacgccacgtggtcgatccagcctcgtcggcttcttcgcacccgtcaccggcggtcagcacccaccaggttcatagatggcagagacggtgttcaccccctctttggaagggatgaagcatgtgaaggcagagaacggagtcattctcaccaagcccttccttgatgtctgcaagcatatcttgcctgtcctggataaatttggagctgctatggcaattgtaaagaatgatatcagcggcaatatcacaaggctggaaaacaagtattcttcagatccatcaaagtatggacacttgtacagcatggttcaggaagaagttcaaaacaagaccgcgaaaggttcctcaagctgcacaaatggtcttctgtggctcacgagggccatggatttccttgttgagttgttccgtaacctgcttgagcatccagactggaccatgactcaagcttgcactgattcatacaccaagaccctgaagaaatttcatggctggcttgccagttctagttttacggtggccatgaagctctctcctaatagagataaattcatggaggtcattagtggaactggtgatatcaatgcagatatggagaaattttgcacaaccttctctccttttctcaaagaaaatcacgagtttctggcgagcgttggtcttgatgatatgaaggcttcgtagagcgatctccaaggtggtgattacaacaaaataagcgtgtcttatcaaactcaagtgttgcagaggatatacctgttttctgtagccatctccccattgaaaattatacagggtgataataatttttccgcatgattgaccatggctacttacacactgacttgacagtactctac

SEQ ID NO: 4084 - protein, 202 aa, Zea mays
  misc_feature (1)..(202): useful for making plants with increased salt and oxidative stress resistance as described in USSN 12/922,143
  misc_feature (1)..(202): Ceres CLONE ID no.236892
  misc_feature (1)..(202): Bit score of 548.1 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
MAETVFTPSLEGMKHVKAENGVILTKPFLDVCKHILPVLDKFGAAMAIVKNDISGNITRLENKYSSDPSKYGHLYSMVQEEVQNKTAKGSSSCTNGLLWLTRAMDFLVELFRNLLEHPDWTMTQACTDSYTKTLKKFHGWLASSSFTVAMKLSPNRDKFMEVISGTGDINADMEKFCTTFSPFLKENHEFLASVGLDDMKAS

SEQ ID NO: 4085 - protein, 202 aa, Oryza sativa subsp. japonica
  misc_feature (1)..(202): useful for making plants with increased salt and oxidative stress resistance as described in USSN 12/922,143
  misc_feature (1)..(202): Public GI ID no.115447377
  misc_feature (1)..(202): Bit score of 561.2 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
MAETVFTPSLEGMKHVKSESSVILTKPFLDVCKQILPVLDKFGAAMALVKSDIGGNITRLENKYSSDPSKYEQLYSMVQEEVQNKTAKGSSSCTNGLLWLTRAMDFLVELFRNLLEHQDWTMSQACTDSYTKTLKKWHGWLASSSFTVAMKLAPNREKFMEVISGTGDIKADIEKFCTTFYPFLKENHDFLASVGLDDLKAS

SEQ ID NO: 4086 - protein, 202 aa, Zea mays
  misc_feature (1)..(202): useful for making plants with increased salt and oxidative stress resistance as described in USSN 12/922,143
  misc_feature (1)..(202): CERES CLONE ID no.100877993
  misc_feature (1)..(202): Bit score of 503.3 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
  misc_feature (161)..(161): Xaa is any aa, unknown or other
  misc_feature (166)..(166): Xaa is any aa, unknown or other
  misc_feature (167)..(167): Xaa is any aa, unknown or other
  misc_feature (178)..(178): Xaa is any aa, unknown or other
  misc_feature (179)..(179): Xaa is any aa, unknown or other
  misc_feature (180)..(180): Xaa is any aa, unknown or other
  misc_feature (181)..(181): Xaa is any aa, unknown or other
  misc_feature (188)..(188): Xaa is any aa, unknown or other
  misc_feature (191)..(191): Xaa is any aa, unknown or other
  misc_feature (192)..(192): Xaa is any aa, unknown or other
  misc_feature (193)..(193): Xaa is any aa, unknown or other
  misc_feature (196)..(196): Xaa is any aa, unknown or other
  misc_feature (198)..(198): Xaa is any aa, unknown or other
  misc_feature (199)..(199): Xaa is any aa, unknown or other
MAQTVFTPSLEAMKHVKAENGVILTKPFLDVCKQILPVLDKFGGAMAIVKSDIGGNITRLENKYTSEPSKYEHLYSMVQEEVQNKTAKGSSSCTNGLLWLTRAMDFLVELFRNLLEHPDWTMGQSCTDSYTKTLKKFHGWLASSSFTVAMKLAPNREKFMXVISGXXDINADIEKFCXXXXPFLKENXNFXXXVGXDXXKAS

SEQ ID NO: 4087 - DNA, 1190 bp, Triticum aestivum
  misc_feature (1)..(1190): useful for making plants with increased salt and oxidative stress resistance as described in USSN 12/922,143
  misc_feature (1)..(1190): Ceres CLONE ID no.696883
aaaaacagatcagtccggggtcgtggcctccactcggcatcttcttcctcccccacatcgcacttcctcccctgctagattcgtccctccaccgaccggcaaggcctctctcctgcacttccctcgcccaaggttgcaccagagaaggcggaaaacatcacagtttgcgaaatcgtggagcggtagagagagatggccgagacggtgttcgctccgtgtttggaagggatgaagcatgtcaggtcggacagcggggtcatgctcgccaagcccttccttgatgtctgcaagcaaatcttgcctgtcctggataaatttggtgctgctatggcaattgtgaagagtgatattggaggtaatatcacgaggttggagaacaagtattcttcagacccgtcaaaatatgagcacttgtacaccatggtccaagaagaagttgaaaagaagaccgcaaagggttcatcaagctgcacaaatggacttctatggctcacgagggctatggacttccttgttgaactgttccgtaatctacttgaccatccagactggactatgagtcaagcatgtactgattcatacacaaaaactctgaagaaatggcatgggtggctcgccagttccagttttacggtggctatgaagcttgctcctaacaaagataaatttatggaggtaattagcggaacgggtgatatcaaagcagacattgagaaattctgcaccaccttttatccctttctcaaggagaatcatgacttcctggccagtgttgggctcgatgatatgaaggcttcttaatgcaatacacaccgacaatcatcacaaatatgaagtgctgctattttctcgaattttattgtggccaaggatacactgttttgcatactgatcttcaggaaattatagacgaataataagtcaaaatgtttgggtgttcatgacccatagctacttacatacaagatgaattgaatgtatgcatgggatcaaaattaacttttgaaagtcaccttgtcagccaagccggccattttaccaattgatgtaactgaagagaacgcagaggatgcagatatgtggtgatcttgtcgttcagtttataaactgctgtgtaagtgattctgtttataaactgctgtataagtgatgaggcgaagatgcaaattaagagtctgttattgatgcat

SEQ ID NO: 4088 - protein, 202 aa, Triticum aestivum
  misc_feature (1)..(202): useful for making plants with increased salt and oxidative stress resistance as described in USSN 12/922,143
  misc_feature (1)..(202): Ceres CLONE ID no.696883
  misc_feature (1)..(202): Bit score of 557.7 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
MAETVFAPCLEGMKHVRSDSGVMLAKPFLDVCKQILPVLDKFGAAMAIVKSDIGGNITRLENKYSSDPSKYEHLYTMVQEEVEKKTAKGSSSCTNGLLWLTRAMDFLVELFRNLLDHPDWTMSQACTDSYTKTLKKWHGWLASSSFTVAMKLAPNKDKFMEVISGTGDIKADIEKFCTTFYPFLKENHDFLASVGLDDMKAS

SEQ ID NO: 4089 - DNA, 624 bp, Populus balsamifera subsp. trichocarpa
  misc_feature (1)..(624): useful for making plants with increased salt and oxidative stress resistance as described in USSN 12/922,143
  misc_feature (1)..(624): Ceres ANNOT ID no.1462901
atggaggcttcagctggtcaaggaactgtttttgcaccatcgttggaaggaatgaagcatgtcagatctgataacggagaaatactcactaaacctttcttggacgtctgcaaattgattttgcctgttattgataagtttggagctgctatggcccttgtaaaatctgatatcggtggtaacataacaagattggaaaccaaatatctgtcagatccatctaaatacaaccaattttacactatggttcaagaggaggctgatgctaaaacagcaaaaggatcatcaagttgtgccaatggtcttctttggctgaccagagcaatggatttcctggtggaacttttccggaatttacttacacatccagattggacaatgtcacaagcctgtacagattcctatggcaagacactgaaaaaatttcatggctggcttgccagttcaagtttcactattgccatgaagcttgctccagataggaagaagttcatggaagtaatagctggcacaggcgatgttgctgctgacatggaggaattttgtacaacctttcctccatttcttgaagagaatcacaagttcctggctagtgttggtctggatgatatgaaagcttcataa

SEQ ID NO: 4090 - protein, 207 aa, Populus balsamifera subsp. trichocarpa
  misc_feature (1)..(207): useful for making plants with increased salt and oxidative stress resistance as described in USSN 12/922,143
  misc_feature (1)..(207): Ceres ANNOT ID no.1462901
  misc_feature (1)..(207): Bit score of 550.7 for HMM based on sequences of FIGURE 13 of USSN 12/922,143.
  misc_feature (15)..(203): Pfam Name: GLTP Pfam Description: Glycolipid transfer protein (GLTP)
  misc_feature (1)..(207): Functional Homolog Of Ceres SEEDLINE ID no. ME08052
MEASAGQGTVFAPSLEGMKHVRSDNGEILTKPFLDVCKLILPVIDKFGAAMALVKSDIGGNITRLETKYLSDPSKYNQFYTMVQEEADAKTAKGSSSCANGLLWLTRAMDFLVELFRNLLTHPDWTMSQACTDSYGKTLKKFHGWLASSSFTIAMKLAPDRKKFMEVIAGTGDVAADMEEFCTTFPPFLEENHKFLASVGLDDMKAS

SEQ ID NO: 4091 - protein, 202 aa, Oryza sativa subsp. japonica
  misc_feature (1)..(202): useful for making plants with increased salt and oxidative stress resistance as described in USSN 12/922,143
  misc_feature (1)..(202): Public GI ID no.22296432
  misc_feature (1)..(202): Bit score of 497.8 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
MEGTVFTPSLQGIKNVKSESGVILTKPFLEVCKHILPVLDKFGSAMSIVKNDIGGNITRLETKYASDPSKYEQLHSMVKVEISSKTAKSSSSCTNGLLWLTRAMDFLVALFHNLVQHPDWQMSQACSDAYSKTLKKWHGWLASSSFSVAIKLAPDRKKFMEIISGSGDINADIEKFCATFSPLLAENHRFLASVGMDDLKAS

SEQ ID NO: 4092 - DNA, 962 bp, Gossypium hirsutum
  misc_feature (1)..(962): useful for making plants with increased salt and oxidative stress resistance as described in USSN 12/922,143
  misc_feature (1)..(962): Ceres CLONE ID no.1794111
gttttcagcttcagtgtcacttcaattcagtttctctctcgtcttcaatatttcaaccgaatccaattctcaaagaaaaaaaatcgccagttaagagagaaaaaaaaagttgaaatcttttttgagcaatggaaggatcagtttttactccatcattggaaggaatgaagcatatcaaatctccagaaggggaaatgcttaccaagccttttttggatgtctgcaagttgattttgccagtcctcgataagttcggatctgctatgagccttgtgaagagtgatgttggtggtaacatatcgaggttggaaaagaaatatgaaactgatcccgctaaatacaatcacttgtacagtatggtgaaagaagaggttgattgtaaaacagcaacagattcatctagttgtaccaatggtcttctctggttgacacgagcaatggatttcctcgtagaattgttccgcaacttacttgcacatccagattggactatgactgaatcttgtaccgactcctatggcaaaaccctgaaaaagttccatggctggattgctagttccgctttcacggttgcattgaagttggctccagataggaagaagttcatggaagtgatagctgggactggagatgttaatgctgacatggagaaattttgttcgactttccccccatttcttgaggagaatcacaaatatctggccaagtttggcttggatgatatgaaggcatgatggaataagtttaatgagtagaggagagactacctacctatatttactcccgtgttcgaacttccagtatcttgcttccggcttaaaccttcgtatttacttgaaataattaatgagtaatgactttaaacacatactcttgaatgcttagtttttagtaatttttggttaaatgtcttgacccttgaatgatattattgaaattatgttcagttcttctccctagtt

SEQ ID NO: 4093 - protein, 201 aa, Gossypium hirsutum
  misc_feature (1)..(201): useful for making plants with increased salt and oxidative stress resistance as described in USSN 12/922,143
  misc_feature (1)..(201): Ceres CLONE ID no.1794111
  misc_feature (1)..(201): Bit score of 537.4 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(201): Functional Homolog Of Ceres SEEDLINE ID no. ME08052
MEGSVFTPSLEGMKHIKSPEGEMLTKPFLDVCKLILPVLDKFGSAMSLVKSDVGGNISRLEKKYETDPAKYNHLYSMVKEEVDCKTATDSSSCTNGLLWLTRAMDFLVELFRNLLAHPDWTMTESCTDSYGKTLKKFHGWIASSAFTVALKLAPDRKKFMEVIAGTGDVNADMEKFCSTFPPFLEENHKYLAKFGLDDMKA

SEQ ID NO: 4094 - DNA, 1050 bp, Glycine max
  misc_feature (1)..(1050): useful for making plants with increased salt and oxidative stress resistance as described in USSN 12/922,143
  misc_feature (1)..(1050): Ceres CLONE ID no.1240524
agaaagaaaagcgagagtaacttcgaatctgattttcatcccttaacaccaacgccaacgccaattccattcagatcacagtcccttcgattcctgctgcaacatactttcaaagccctaaaatggaggggactgtcttcactcctgcactgcaagaaattgagcatgtaaagtctgatcaaggagaaattctgagcaagcctttcttggatgcgtgcaaacacatattgcctgtaatagataagtttggagctgctatggcccttgttaaatctgacataggtggtaacatatcgagattggaaactatgtattcttccaatccaaccagatttaactacctgtacagtttggtacaggtagaggttaaaactaaaacagctaaatcatcatccagttgtaccaatggacttctttggctcacaagagcaatggatttcttggtggctttgttccgaaacttaatcgagcatgaagattggccaatgtcacaagcatgtacagattcgtataacaagactctgaagaagtggcatggctggcttgctagttcaagcttcacagtagtcatgaagcttgctcctgataggaagaagtttatggacgtgataggaggcactggcaatatcagtgctgacattgagaaattttgtacaaccttttctcctctccttgaagagaatcacaagtttttggctcgatttggcttagatgatatgaaggcatcatgaatcacagattcagaagttcccgatgagtagctcttgcatgctcacacccatttcatatctactttactagcatgataaataagcatcgactttcatattgtgcctctaagtactctattaagaacagtgtttctatggtatctcaaaatttgttacagttagtttattatgaaggttaatgctagtggagtttagtatcttcttgatgatttaccgattggctagaaccaaactcatccaactttggttcagtatatggatggctgcttggttgtataagtctgattcaattataaaatttataacaactgtttttatg

SEQ ID NO: 4095 - protein, 202 aa, Glycine max
  misc_feature (1)..(202): useful for making plants with increased salt and oxidative stress resistance as described in USSN 12/922,143
  misc_feature (1)..(202): Ceres CLONE ID no.1240524
  misc_feature (1)..(202): Bit score of 545.7 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
MEGTVFTPALQEIEHVKSDQGEILSKPFLDACKHILPVIDKFGAAMALVKSDIGGNISRLETMYSSNPTRFNYLYSLVQVEVKTKTAKSSSSCTNGLLWLTRAMDFLVALFRNLIEHEDWPMSQACTDSYNKTLKKWHGWLASSSFTVVMKLAPDRKKFMDVIGGTGNISADIEKFCTTFSPLLEENHKFLARFGLDDMKAS

SEQ ID NO: 4096 - DNA, 1102 bp, Glycine max
  misc_feature (1)..(1102): useful for making plants with increased salt and oxidative stress resistance as described in USSN 12/922,143
  misc_feature (1)..(1102): Ceres CLONE ID no.539525
  misc_feature (652)..(652): y is t/u or c
  misc_feature (657)..(657): y is t/u or c
  misc_feature (766)..(766): y is t/u or c
  misc_feature (856)..(856): n is a, c, t, g, unknown, or other
  misc_feature (930)..(930): y is t/u or c
  misc_feature (951)..(951): y is t/u or c
  misc_feature (964)..(964): r is g or a
  misc_feature (1004)..(1004): y is t/u or c
  misc_feature (1037)..(1037): y is t/u or c
  misc_feature (1082)..(1082): r is g or a
  misc_feature (1101)..(1101): y is t/u or c
aaatctgattttcattcctcaacgccaacgccaacgccaacgccaattccattcagatcacagtcccttcaattcctgctgcagcatactgtgtgcaacaaagccctaaaatggaggggactgtcttcactcctgcactgcaagaaattgagcatgtaaagtctgatcaaggagaaattctgagcaagcctttcttggatgcgtgcaagcacatattgcctgtaatagataagtttggagctgctatggcccttgttaaatctgacataggtggtaacatatcgagattggaaactatgtattcttccaatccatccagatttaactacctgtacagtttggtacaggtagaggttgaaactaaaacagctaaatcatcatccagttgtaccaatggacttctttggctgacaagagcaatggatttcttggtggctttgttccgaaacttaatcgagcatgaagattggccaatgtcacaagcatgtacagattcgtataacaagactctgaagaagtggcatggttggcttgctagttcaagcttcacggttgtcatgaagcttgctcctgataggaagaagtttatgaacgtgataggaggcactggcgatatcaatgctgatatcgagaaattttgtacaaccttttytcctytccttcaagagattcacaagtttttggctcgatttcgcttagatgatatgaaggcatcatgaatcacagattcagaagttcctgacgagtagctcttgcatgctcactytcatttcatatcaactttattagcatgataaataagcattggctttcatgttgtgccgttaagtactctattaacatcatgtagtgtttntatgtcaatttgttactatcagttggttgtttattatgaaggttaaggctaatggagtttagtaacttgttttytgcaataccgtatagagtatyttggtgattataragtactaattgactagaatcaaactcatcaaactttggcycaacatatggatggctgcttggtcatataaatyttattcaattataaaacttactactgtttatgaaagtgatgaaaratgtgatctgcattctctyt

SEQ ID NO: 4097 - protein, 202 aa, Glycine max
  misc_feature (1)..(202): useful for making plants with increased salt and oxidative stress resistance as described in USSN 12/922,143
  misc_feature (1)..(202): Ceres CLONE ID no.539525
  misc_feature (1)..(202): Bit score of 531.8 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
  misc_feature (181)..(181): Xaa is any aa, unknown or other
  misc_feature (183)..(183): Xaa is any aa, unknown or other
MEGTVFTPALQEIEHVKSDQGEILSKPFLDACKHILPVIDKFGAAMALVKSDIGGNISRLETMYSSNPSRFNYLYSLVQVEVETKTAKSSSSCTNGLLWLTRAMDFLVALFRNLIEHEDWPMSQACTDSYNKTLKKWHGWLASSSFTVVMKLAPDRKKFMNVIGGTGDINADIEKFCTTFXPXLQEIHKFLARFRLDDMKAS

SEQ ID NO: 4098 - DNA, 997 bp, Glycine max
  misc_feature (1)..(997): useful for making plants with increased salt and oxidative stress resistance as described in USSN 12/922,143
  misc_feature (1)..(997): Ceres CLONE ID no.520979
  misc_feature (349)..(349): s is g or c
  misc_feature (547)..(547): m is a or c
  misc_feature (671)..(671): m is a or c
  misc_feature (679)..(679): y is t/u or c
  misc_feature (906)..(906): m is a or c
  misc_feature (920)..(920): s is g or c
aaaaaccaataacaaaaaactacttgtaaattttttgtgatacgtctacctgttgttgttctcagtctaagatcaccgaggctttccttgttcaatcaaaacacaaaaatggaggggactgttttcactcctgcacttgaaggaattaagcttgtaaaatcagagcaaggagaaattttgacccagcctttcttggatgcttgcaagcatatactgcctgttatagacaagtttggagctgctatggcccttgttaaatctgacatcggtggtaacatatcgagattggaatctaagtattcctccaatccaaccaaattcaactacctgtacagtttggtacaagtasaggttgaaactaaaacggctaagtcatcatccagttgtaccaatggacttctttggcttacaagagcaatggatttcttagtggcattattccaaaacttaattgagcatgcagattggtcaatgtcacaagcctgtacagattcctataacaagactctaaagaagtggcatggctggcttgcaagttcaagcttcmctgtagcaatgaagcttgctcctgataggaaaaaattcatggaggtgatacaaggcactggtgatatcagtgctgatatacagaaattttgtactgacttttctcctatctttgaagagaatcmcaagtttytggctcgttgtggcttggatgatatgaaggcgtcatgaagtcacgggttcatgatcagaagtctcttgatgaatgactcttgcattcttactctcatgttgagttctaaaactctatgtttctttgtaggcatccagacccagcatgataaacattcaataacttcaatcgtgtaccgcaaattttttgttttgtgcttggtgggatagaatcttgagatattagcmcaattttacttggstacaaaaaacttgaactcgcatgttgttaatttattatttattattataaaaacacagatgattagttttgaggctc

SEQ ID NO: 4099 - protein, 202 aa, Glycine max
  misc_feature (1)..(202): useful for making plants with increased salt and oxidative stress resistance as described in USSN 12/922,143
  misc_feature (1)..(202): Ceres CLONE ID no.520979
  misc_feature (1)..(202): Bit score of 503.3 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
  misc_feature (81)..(81): Xaa is any aa, unknown or other
  misc_feature (147)..(147): Xaa is any aa, unknown or other
  misc_feature (188)..(188): Xaa is any aa, unknown or other
  misc_feature (191)..(191): Xaa is any aa, unknown or other
MEGTVFTPALEGIKLVKSEQGEILTQPFLDACKHILPVIDKFGAAMALVKSDIGGNISRLESKYSSNPTKFNYLYSLVQVXVETKTAKSSSSCTNGLLWLTRAMDFLVALFQNLIEHADWSMSQACTDSYNKTLKKWHGWLASSSFXVAMKLAPDRKKFMEVIQGTGDISADIQKFCTDFSPIFEENXKFXARCGLDDMKAS

SEQ ID NO: 4100 - protein, 222 aa, Oryza sativa subsp. japonica
  misc_feature (1)..(222): useful for making plants with increased salt and oxidative stress resistance as described in USSN 12/922,143
  misc_feature (1)..(222): Public GI ID no.125600070
  misc_feature (1)..(222): Bit score of 461.5 for HMM based on sequences of FIGURE 13 of USSN 12/922,143.
  misc_feature (10)..(200): Pfam Name: GLTP Pfam Description: Glycolipid transfer protein (GLTP)
  misc_feature (1)..(222): Functional Homolog Of Ceres SEEDLINE ID no. ME08052
MEGTVFTPSLQGIKNVKSESGVILTKPFLEVCKHILPVLDKFGSAMSIVKNDIGGNITRLETKYASDPSKYEQLHSMVKVEISSKTAKSSSSCTNGLLWLTRAMDFLVALFHNLVQHPDWQMSQACSDAYSKTLKKWHGWLASSSFSEYLTIPEFQVAIKLAPDRKKFMEIISGSGDINADIEKFCATFSPLLAENHRFLVAVYNRFVYFQASVGMDDLKAS

SEQ ID NO: 4101 - protein, 440 aa, Sorghum bicolor
  misc_feature (1)..(440): useful for making plants with increased salt and oxidative stress resistance as described in USSN 12/922,143
  misc_feature (1)..(440): Ceres ANNOT ID no.6034905
  misc_feature (1)..(440): Bit score of 52.1 for HMM based on sequences of FIGURE 16 of USSN 12/922,143.
  misc_feature (101)..(119): Pfam Name: IQ Pfam Description: IQ calmodulin-binding motif
  misc_feature (1)..(440): Functional Homolog Of Ceres SEEDLINE ID no. ME24091
MGISARWLKSLVGLRKVERQQQHRKEDADVGRMKGDVADQFHFQNQRSQEDSSIAAQEEIPEVPYGNDPPEVDSNAPSCLEPTCDSAHVPLSQTEEELEEIWAATIIQTAFRAFLARRARRALKGLVRLQALVRGHIVRKQAATTLRCMQALVRVQARVRARRVRMALENQTDQQNTSPEHTIEARVREIEDGWCDSIGSVEDIQAKLLKRQEAAAKRERAMAYALAHQWQASSRQAASFEPDKNSWGWNWLERWMAVRPWESRFLGTYAADGIFVVNETRQPDISATKTPCRKPVKKHDSTLQSNTLNQKVFPSNSEGGGSSTNRSSGSASAKSRLKVLPREGAEEASSRPSVLVVRSTSNPRERTSNINSKERTGDLDCQVHKRFSLPGIGSEAGKHLTKKGTVNRSLKATKDSQILGSRHHLASSIDPVPTRVELET

SEQ ID NO: 4102 - DNA, 1087 bp, Arabidopsis thaliana
  misc_feature (1)..(1087): useful for making plants with increased salt and oxidative stress resistance as described in USSN 12/922,143
  misc_feature (1)..(1087): Ceres CLONE ID no.37919
  misc_feature (25)..(25): m is a or c
atatgtcaggaccggtccgcaggamaagcatgtaataaaactgtgtgttttctacattttctatgaaatgggtgtaattgaaagatactaaatgttagggcttttcagaaacttccgttacgttttaggcgtttaacacaattattattttctaaaacgagagccgtttaacgagaaagagaaatttctaactccagagagcgaagaacacaatcccagagtagcagaatctgatccatcccacctttttcaattctcaggcaaagataagtcaaagttgaaaatggaagggactgtgttcacgccttgtttggaaggaatgaagcatgtcaaatctgatcaaggcgagatgcttactaagccatttttagagctttgcaagaccatcttgcctgttatagataaatttggagctgctatgactctcgtcaaatctgacattggtggcaacataacgaggttggagaagaactacttgtctgatcccgacaagttcaagtacttgtacacctttgttcaagtcgaaattgagtctaagatagcaaaaggatcgtctagctgtacaaacggtcttctctggttaaccagagcaatggatttcttagtggagctgttccgaaacttggtagcacatcaagactggtcaatgccacaagcttgtgctgactcataccaaaaaacactcaagaaatggcacggatggctcgccagctctaccttctctatggctttaaagctagctccggacaggaagaagttcatggatgtcatatctggttctggtaacatccaagccgacatggaaaggttttgtgctgagtttggtccgtttcttcatgataatcataagtttctggctagcgtcggtatggatgacatgaaagcttcttaagtcatcatatgattatcgccggtatcaaatcttctttgccggaatctttgtctgttttaacttttctccttccaattatagaacctccaaaaagaaacagaataatgtgttggtttctatctgaatgttcactttatattacaagttataacatacgaatcaatcttatcaactcttcttgttaatgtttgttac

SEQ ID NO: 4103 - protein, 202 aa, Arabidopsis thaliana
  misc_feature (1)..(202): useful for making plants with increased salt and oxidative stress resistance as described in USSN 12/922,143
  misc_feature (1)..(202): Ceres CLONE ID no.37919
  misc_feature (1)..(202): Bit score of 492.0 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052
MEGTVFTPCLEGMKHVKSDQGEMLTKPFLELCKTILPVIDKFGAAMTLVKSDIGGNITRLEKNYLSDPDKFKYLYTFVQVEIESKIAKGSSSCTNGLLWLTRAMDFLVELFRNLVAHQDWSMPQACADSYQKTLKKWHGWLASSTFSMALKLAPDRKKFMDVISGSGNIQADMERFCAEFGPFLHDNHKFLASVGMDDMKAS

SEQ ID NO: 4104 - DNA, 945 bp, Arabidopsis thaliana
  misc_feature (1)..(945): useful for making plants with increased salt and oxidative stress resistance as described in USSN 12/922,143
  misc_feature (1)..(945): Ceres CLONE ID no.19302
cgttacgttttaggcgtttaacacaattattattttctaaaacgagagccgtttaacgagaaagagaaatttctaactccagagagcgaagaacacaatcccagagtagcagaatctgatccatcccacctttttcaattctcaggcaaagtgtttgttgtcatattcagataagtcaaagttgaaaatggaagggactgtgttcacgccttgtttggaaggaatgaagcatgtcaaatctgatcaaggcgagatgcttactaagccatttttagagctttgcaagaccatcttgcctgttatagataaatttggagctgctatgactctcgtcaaatctgacattggtggcaacataacgaggttggagaagaactacttgtctgatcccgacaagttcaagtacttgtacacctttgttcaagtcgaaattgagtctaagatagcaaaaggatcgtctagctgtacaaacggtcttctctggttaaccagagcaatggatttcttagtggagctgttccgaaacttggtagcacatcaagactggtcaatgccacaagcttgtgctgactcataccaaaaaacactcaagaaatggcacggatggctcgccagctctaccttctctatggctttaaagctagctccggacaggaagaagttcatggatgtcatatctggttctggtaacatccaagccgacatggaaaggttttgtgctgagtttggtccgtttcttcatgataatcataagtttctggctagcgtcggtatggatgacatgaaagcttcttaagtcatcatatgattatcgccggtatcaaatcttctttgccggaatctttgtctgttttaacttttctccttccaattatagaacctccaaaaagaaacagaataatgtgttggtttctatctgaatgttcactttatattacaagttat

SEQ ID NO: 4105 - protein, 202 aa, Arabidopsis thaliana; identical to SEQ ID NO: 4103
  misc_feature (1)..(202): useful for making plants with increased salt and oxidative stress resistance as described in USSN 12/922,143
  misc_feature (1)..(202): Ceres CLONE ID no.19302
  misc_feature (1)..(202): Bit score of 492.0 for HMM based on sequences of FIGURE 13 of USSN 12/922,143.
  misc_feature (10)..(198): Pfam Name: GLTP Pfam Description: Glycolipid transfer protein (GLTP)
  misc_feature (1)..(202): Functional Homolog Of Ceres SEEDLINE ID no. ME08052

SEQ ID NO: 4106 - DNA, 756 bp, Populus balsamifera subsp. trichocarpa
  misc_feature (1)..(756): useful for making plants with increased salt and oxidative stress resistance as described in USSN 12/922,143
  misc_feature (1)..(756): Ceres ANNOT ID no.1512801
atgggggctgatggtctaggaactgtgtttacaccatcattggaaggaatgaagcacgtcaaatctgatcacggagaaatgctcactaaacctttcttggatgtctgcaaattgattttgcctgttatcgataagtttggagctgccatgacccttgtaaaatctgatatcggtacgagattggaaaacaagtatttgtctgatccgtctaaatacaaccacttatacactatgattcaagaggaggttgatgctaaaacagccaaaggatcttccagttgtaccaattgtcttctttggctaaccagagcaatggatttccttgtggaactgttcctgaatttacttgcacacccagattggacaatgtcacaagcctgtacagattcatatcgcaagacactgaagaaatttcatggctgggttgctagttcatattccactgttgtcatgaagcttgttccagacaggaagaagttcatggaagtaatttctggcccaggcaatgtttctgctgacatggagcaattctgtacaacctttcctccatttcttgaagagaatcacaagttcctgaaaccggttatcctgttattttcatttttttttttttttcgattccttcttgggaaattttgtttttgttttgagatattttatttttttatgttattaacttctttattcatattatctatccttcttattttatttagatcatttatttattataatgttgttgattttttttattag

SEQ ID NO: 4107 - protein, 251 aa, Populus balsamifera subsp. trichocarpa
  misc_feature (1)..(251): useful for making plants with increased salt and oxidative stress resistance as described in USSN 12/922,143
  misc_feature (1)..(251): Ceres ANNOT ID no.1512801
  misc_feature (1)..(251): Bit score of 455.2 for HMM based on sequences of FIGURE 13 of USSN 12/922,143.
  misc_feature (14)..(193): Pfam Name: GLTP Pfam Description: Glycolipid transfer protein (GLTP)
  misc_feature (1)..(251): Functional Homolog Of Ceres SEEDLINE ID no. ME08052
MGADGLGTVFTPSLEGMKHVKSDHGEMLTKPFLDVCKLILPVIDKFGAAMTLVKSDIGTRLENKYLSDPSKYNHLYTMIQEEVDAKTAKGSSSCTNCLLWLTRAMDFLVELFLNLLAHPDWTMSQACTDSYRKTLKKFHGWVASSYSTVVMKLVPDRKKFMEVISGPGNVSADMEQFCTTFPPFLEENHKFLKPVILLFSFFFFFRFLLGKFCFCFEIFYFFMLLTSLFILSILLILFRSFIYYNVVDFFY

SEQ ID NO: 4108 - DNA, 615 bp, Populus balsamifera subsp. trichocarpa
  misc_feature (1)..(615): useful for making plants with increased salt and oxidative stress resistance as described in USSN 12/922,143
  misc_feature (1)..(615): Ceres ANNOT ID no.1459528
atgggggctgatggtctaggaactgtgtttacaccatcattggaaggaatgaagcacgtcaaatctgatcacggagaaatgctcactaaacctttcttggatgtctgcaaattgattttgcctgttatcgataagtttggagctgccatgacccttgtaaaatctgatatcggtacgagattggaaaacaagtatttgtctgatccgtctaaatacaaccacttatacactatgattcaagaggaggttgatgctaaaacagccaaaggatcttccagttgtaccaattgtcttctttggctaaccagagcaatggatttccttgtggaactgttcctgaatttacttgcacacccagattggacaatgtcacaagcctgtacagattcatatcgcaagacactgaagaaatttcatggctgggttgctagttcatattccactgttgtcatgaagcttgttccagacaggaagaagttcatggaagtaatttctggcccaggcaatgtttctgctgacatggagcaattctgtacaacctttcctccatttcttgaagagaatcacaagttcctggtattgcgcactgaggaaggcagtgttgcccacccttaa

SEQ ID NO: 4109 - protein, 204 aa, Populus balsamifera subsp. trichocarpa
  misc_feature (1)..(204): useful for making plants with increased salt and oxidative stress resistance as described in USSN 12/922,143
  misc_feature (1)..(204): Ceres ANNOT ID no.1459528
  misc_feature (1)..(204): Bit score of 457.3 for HMM based on sequences of FIGURE 13 of USSN 12/922,143.
  misc_feature (14)..(198): Pfam Name: GLTP Pfam Description: Glycolipid transfer protein (GLTP)
  misc_feature (1)..(204): Functional Homolog Of Ceres SEEDLINE ID no. ME08052
MGADGLGTVFTPSLEGMKHVKSDHGEMLTKPFLDVCKLILPVIDKFGAAMTLVKSDIGTRLENKYLSDPSKYNHLYTMIQEEVDAKTAKGSSSCTNCLLWLTRAMDFLVELFLNLLAHPDWTMSQACTDSYRKTLKKFHGWVASSYSTVVMKLVPDRKKFMEVISGPGNVSADMEQFCTTFPPFLEENHKFLVLRTEEGSVAHP

SEQ ID NO: 4110 - protein, 204 aa, Oryza sativa subsp. indica
  misc_feature (1)..(204): useful for making plants with increased salt and oxidative stress resistance as described in USSN 12/922,143
  misc_feature (1)..(204): Public GI ID no.125558165
  misc_feature (1)..(204): Bit score of 438.1 for HMM based on sequences of FIGURE 13 of USSN 12/922,143.
  misc_feature (10)..(200): Pfam Name: GLTP Pfam Description: Glycolipid transfer protein (GLTP)
  misc_feature (1)..(204): Functional Homolog Of Ceres SEEDLINE ID no. ME08052
MEGTVFTPSLQGIKNVKSESGVILTKPFLEVCKHILPVLDKFGSAMSIVKNDIGGNITRLETKYASDPSKYEQLHSMVKVEISSKTAKSSSSCTNGLLWLTRAMDFLVALFHNLVQHPDWQMSQACSDAYSKTLKKWHGWLASSSFSEYLTIPEFQVAIKLAPDRKKFMEIISGSGDINADIEKFCATFSPLLAENHRFLLLSQ

SEQ ID NO: 4111 - DNA, 627 bp, Populus balsamifera subsp. trichocarpa
  misc_feature (1)..(627): useful for making plants with increased salt and oxidative stress resistance as described in USSN 12/922,143
  misc_feature (1)..(627): Ceres ANNOT ID no.1442716
atggagggaaatgtgtttgctgaagctttggaaaagatggaccatgttaagtctcccgagggagaaattcttgccaagccttttttggatttgtgcaaaacagtattgcctgttttagacaactttggaccagccatgggacctgtaaaatctgacattggtggtaatatatcgaggctggagactaggtatttgtccaatcaatcagaattcaattacttgtacaggatagtacagtcagaaattgaatcgaaaaaggctaaatcttcatccagttgcacaaatgctttactttggctgacaagggccatggatttcttgtcagaactgttccgcaacttaatggtgcatccggactggagcatgtcacaagtttgcactgattcatacgacaagtccctgaaaaaatggcatggctggctggctagttcaagttttagcgtaaacacttgtagcatcaatgttgccttgaagttggctccggataggaagaagtttatgagtgtagtgggtgtcaaaggagatgatgtttctgacattgaagatttctgtggaaggttctcacctttattggaagagaatcacaagttcctcgctagtgttggaatggacaatttgaaagcttga

SEQ ID NO: 4112 - protein, 208 aa, Populus balsamifera subsp. trichocarpa
  misc_feature (1)..(208): useful for making plants with increased salt and oxidative stress resistance as described in USSN 12/922,143
  misc_feature (1)..(208): Ceres ANNOT ID no.1442716
  misc_feature (1)..(208): Bit score of 411.7 for HMM based on sequences of FIGURE 13 of USSN 12/922,143.
  misc_feature (10)..(205): Pfam Name: GLTP Pfam Description: Glycolipid transfer protein (GLTP)
  misc_feature (1)..(208): Functional Homolog Of Ceres SEEDLINE ID no. ME08052
MEGNVFAEALEKMDHVKSPEGEILAKPFLDLCKTVLPVLDNFGPAMGPVKSDIGGNISRLETRYLSNQSEFNYLYRIVQSEIESKKAKSSSSCTNALLWLTRAMDFLSELFRNLMVHPDWSMSQVCTDSYDKSLKKWHGWLASSSFSVNTCSINVALKLAPDRKKFMSVVGVKGDDVSDIEDFCGRFSPLLEENHKFLASVGMDNLKA

SEQ ID NO: 4113 - DNA, 675 bp, Populus balsamifera subsp. trichocarpa
  misc_feature (1)..(675): useful for making plants with increased salt and oxidative stress resistance as described in USSN 12/922,143
  misc_feature (1)..(675): Ceres ANNOT ID no.1505342
atgaaaaggacgagagaaatggagaaaggatcagagatacagtctgcaattgaagaactgtcgatgctgatcgaactcaagcccacaggtgacaatcttgataggactactactgttcatatacccacaaggccctttttaaacgtctgcaaccttgttattcaggttcttgataagataggcccaacaatggcagttttgagacaagatatcaatcagaatattcagagattggagatgctatgtaattctgatccttcaatatactccaatttggtcgagattttaaagaaagaggccgatgaaggcaatgcaagaaagggtgccagctgcagtaaagcctttgtgtggcttgccagatccttggattttacgggtgctttgttacaaagattagtggcggatcctggtcagaaaatggagcaactcgtggaggaatcttacagcatcactttaaagccttggcatggttggatttcaacagctgcttataaagtttctcttaaattactgcctgataataaaacgttcattaatctgctcatgccgaaagatgaaacctacgacaacctaaatgagcatgtgcaaacattcatctcattacttgtaccttttctagaagagatccactctattctgatactatatggattggataggctgaagtctacttag

SEQ ID NO: 4114 - protein, 203 aa, Populus balsamifera subsp. trichocarpa
  misc_feature (1)..(203): useful for making plants with increased salt and oxidative stress resistance as described in USSN 12/922,143
  misc_feature (1)..(203): Ceres ANNOT ID no.1505342
  misc_feature (1)..(203): Bit score of 146.2 for HMM based on sequences of FIGURE 13 of USSN 12/922,143.
  misc_feature (20)..(199): Pfam Name: GLTP Pfam Description: Glycolipid transfer protein (GLTP)
  misc_feature (1)..(203): Functional Homolog Of Ceres SEEDLINE ID no. ME08052
MLIELKPTGDNLDRTTTVHIPTRPFLNVCNLVIQVLDKIGPTMAVLRQDINQNIQRLEMLCNSDPSIYSNLVEILKKEADEGNARKGASCSKAFVWLARSLDFTGALLQRLVADPGQKMEQLVEESYSITLKPWHGWISTAAYKVSLKLLPDNKTFINLLMPKDETYDNLNEHVQTFISLLVPFLEEIHSILILYGLDRLKST

SEQ ID NO: 4115 - DNA, 759 bp, Populus balsamifera subsp. trichocarpa
  misc_feature (1)..(759): useful for making plants with increased salt and oxidative stress resistance as described in USSN 12/922,143
  misc_feature (1)..(759): Ceres ANNOT ID no.1452248
atggagaaaggatcagagatacagtctgcaattgaagaactgtcgatgctgatcgaactcaagcccacaggtgacaatcttgataggactactactgttcatatacccacaaggccctttttaaacgtctgcaaccttgttattcaggttcttgataagataggcccaacaatggcagttttgagacaagatatcaatcagaatattcagagattggagatgctatgtaattctgatccttcaatatactccaatttggtcgagattttaaagaaagaggccgatgaaggcaatgcaagaaagggtgccagctgcagtaaagcctttgtgtggcttgccagatccttggattttacgggtgctttgttacaaagattagtggcggatcctggtcagaaaatggagcaactcgtggaggaatcttacagcatcactttaaagccttggcatggttggatttcaacagctgcttataaagtttctcttaaattactgcctgataataaaacgttcattaatctgctcatgccgaaagatgaaacctacgacaacctaaatgagcatgtgcaaacattcatctcattacttgtaccttttctagaagagatccactctattctggcagtgttcttaatcccaaaagttgtagccataacaatctcgaaaaaagttgctctggcctcttcctcctctgccactctcattagtgcttcagcggtttgtatcagagcttgggctgagcttctagcaacattctaa

SEQ ID NO: 4116 - protein, 237 aa, Populus balsamifera subsp. trichocarpa
  misc_feature (1)..(237): useful for making plants with increased salt and oxidative stress resistance as described in USSN 12/922,143
  misc_feature (1)..(237): Ceres ANNOT ID no.1452248
  misc_feature (1)..(237): Bit score of 135.0 for HMM based on sequences of FIGURE 13 of USSN 12/922,143.
  misc_feature (20)..(199): Pfam Name: GLTP Pfam Description: Glycolipid transfer protein (GLTP)
  misc_feature (1)..(237): Functional Homolog Of Ceres SEEDLINE ID no. ME08052
MLIELKPTGDNLDRTTTVHIPTRPFLNVCNLVIQVLDKIGPTMAVLRQDINQNIQRLEMLCNSDPSIYSNLVEILKKEADEGNARKGASCSKAFVWLARSLDFTGALLQRLVADPGQKMEQLVEESYSITLKPWHGWISTAAYKVSLKLLPDNKTFINLLMPKDETYDNLNEHVQTFISLLVPFLEEIHSILAVFLIPKVVAITISKKVALASSSSATLISASAVCIRAWAELLATF

SEQ ID NO: 4117 - protein, 266 aa, Oryza sativa subsp. japonica
  misc_feature (1)..(266): useful for making plants with increased salt and oxidative stress resistance as described in USSN 12/922,143
  misc_feature (1)..(266): Public GI ID no.38344077
  misc_feature (1)..(266): Bit score of 134.6 for HMM based on sequences of FIGURE 13 of USSN 12/922,143.
  misc_feature (76)..(262): Pfam Name: GLTP Pfam Description: Glycolipid transfer protein (GLTP)
  misc_feature (1)..(266): Functional Homolog Of Ceres SEEDLINE ID no. ME08052
MDDGPCGESEGGGDAAAKAVGAKDAGEGDEPKEEEEDGRDREEEEEEAAKRGWSEIRLAIEELSAVDVERRGGKPPPPLPPPPTLTFLALSHLLLQVLDKIGPTMAVLRLDVQRNIERLQELYLLDPSKYYNLEEILEKEVDEGTARKVDSCARAILWLTRSMDFTIALLQRLEEDSDQKCFAQLVESAYMVTLKPWHGWISSAAYKIAMKLIPDRKMFINLLVGKCQDCAALKEEIRKLAKLLKPFLDDIHAMMAKFRLDRLKST

SEQ ID NO: 4118 - protein, 266 aa, Oryza sativa
  misc_feature (1)..(266): useful for making plants with increased salt and oxidative stress resistance as described in USSN 12/922,143
  misc_feature (1)..(266): Public GI ID no.116309799
  misc_feature (1)..(266): Bit score of 135.1 for HMM based on sequences of FIGURE 13 of USSN 12/922,143.
  misc_feature (62)..(262): Pfam Name: GLTP Pfam Description: Glycolipid transfer protein (GLTP)
  misc_feature (1)..(266): Functional Homolog Of Ceres SEEDLINE ID no. ME08052
MDDGPCGESEGGGDAAAKAVGAKDAGEGDEPKEEEEDGRDREEEEEESAKRGWSEIRLAIEELSAVDVERRGGKPPPPSPPPPTLTFLALSHLLLQVLDKIGPTMAVLRLDVQRNIERLQELYLLDPSKYYNLEEILEKEVDEGTARKVDSCARAILWLTRSMDFTIALLQRLEEDSDQKCFAQLVESAYMVTLKPWHGWISSAAYKIAMKLIPDRKMFINLLVGKCQDCAALKEEIRKLAKLLKPFLDDIHAMMAKFRLDRLKST

SEQ ID NO: 4119 - protein, 233 aa, Arabidopsis thaliana
  misc_feature (1)..(233): useful for making plants with increased salt and oxidative stress resistance as described in USSN 12/922,143
  misc_feature (1)..(233): Public GI ID no.9280228
  misc_feature (1)..(233): Bit score of 141.3 for HMM based on sequences of FIGURE 13 of USSN 12/922,143.
  misc_feature (34)..(229): Pfam Name: GLTP Pfam Description: Glycolipid transfer protein (GLTP)
  misc_feature (1)..(233): Functional Homolog Of Ceres SEEDLINE ID no. ME08052
MKRKRCEMEETTKKKKMTEIGSAIEELSVLSIAKTTIVTTEKEAINIINLPLKPLLSFCNIIVQVLDKIGPTMAVLRHDIDQNIQRLEKMWESDPLVYSNLVEILRKEAKEGSSRKPKSCSRAALWLTRAMDFTLALLQRLVKDMSQNMEQAIEECYNLTIKPWHGWISSAAFKVALKLVPNNNTFINVLAAKDETHQMVQDDITSLISLLIPLLSQLHSILELYEVSKLKSP

SEQ ID NO: 4120 - protein, 223 aa, Arabidopsis thaliana
  misc_feature (1)..(223): useful for making plants with increased salt and oxidative stress resistance as described in USSN 12/922,143
  misc_feature (1)..(223): Public GI ID no.45773920
  misc_feature (1)..(223): Bit score of 139.3 for HMM based on sequences of FIGURE 13 of USSN 12/922,143.
  misc_feature (34)..(219): Pfam Name: GLTP Pfam Description: Glycolipid transfer protein (GLTP)
  misc_feature (1)..(223): Functional Homolog Of Ceres SEEDLINE ID no. ME08052
MKRKRYEMEKKKKTEIQTAIEELSVFIVTKPADKTEATHIPLRPILSFCSLIIQVLDKIGPTMAVLRQDIDQNIQRLEKFYETDSCVYSNLAEILKKEKEEGTSKMVASCGRALFWLTRTMDFTAGLLRLLSKEMSSKMEELVEECYMTTLKPHHGWIASAAFKVCLKLVPDNKTFMEAIGARDESYDTLREDIDTLSSLLTPILKEIYFVLEQYGLSRLRSM

SEQ ID NO: 4121 - DNA, 1183 bp, Panicum virgatum
  misc_feature (1)..(1183): useful for making plants with increased salt and oxidative stress resistance as described in USSN 12/922,143
  misc_feature (1)..(1183): Ceres CLONE ID no.1959299
gctaaaaaaatctttgtttctgctacaataggagagtggagcctgtgattgttgcgacctcccaggcatttgacttcctctcttcccctctcactttttttttgaaagaactctctctccccctcttactccacggagcagcaaagcagcagggaggataagcttggaatgccctggtagcgagagggtgcagcgggagccgacggcgtccatggtggagagcgagagaggcgaggaagaagccattgccctcaccggcggcggtggcggtggacagctgcagcaggatggcgtggtctccggcgcggcggagggcgagagggacggcgaggagggagacgcggaggacggcgaacgggaggaggaggaggaaggccgggacgacgtggacgggtggtcggagataaggctggccatcgacgagctgtccccggcgaggctcatcaagcaccgcggccgcggcggcgatggggatgacgacaagccggccgcgccgtccccgcccacgctgcccttcctggcgctgtcccacctccttctccgcgtgctcgataagatcggcccgaccatggccgtgctgcggctcgacgtccaacggaacatcgagaggctgcaggagctgtacttgatggacccagccaagtactccacgctaacggagatagtggagaaggaggtcaaggagggcactgcaaggaaggtcgatagctgtgcaagggctgtcctgtggcttgctagatccatggatttcacaattgcgctgttacagaaattagaggaggacactgccgagcagagtcttgcacagcttgtcgaagctgcgtacgaggtcagcctaaagccatggcacggctggatctcctcggcggcatgcaagatagcgctgcaactcatccccgagaggaaggtcttcaccagcttgctcctagggatgggtcaagactgctccgctctgaaggatgagatcgagaagctcgcattactgctccggccccttcttgatgacatccactccatgatggccaagttcagactggacaggctcaagtcgacgtgatccatggcactggccggcaaggcccaatgtcccaagctatcagttgccgctctgtgaatattgccctgattgtatttcccagtcctgtaaaggttccatgtccgttttgcagcagctgttctagtt

SEQ ID NO: 4122 - protein, 281 aa, Panicum virgatum
  misc_feature (1)..(281): useful for making plants with increased salt and oxidative stress resistance as described in USSN 12/922,143
  misc_feature (1)..(281): Ceres CLONE ID no.1959299
  misc_feature (1)..(281): Bit score of 128.5 for HMM based on sequences of FIGURE 13 of USSN 12/922,143.
  misc_feature (91)..(277): Pfam Name: GLTP Pfam Description: Glycolipid transfer protein (GLTP)
  misc_feature (1)..(281): Functional Homolog Of Ceres SEEDLINE ID no. ME08052
MVESERGEEEAIALTGGGGGGQLQQDGVVSGAAEGERDGEEGDAEDGEREEEEEGRDDVDGWSEIRLAIDELSPARLIKHRGRGGDGDDDKPAAPSPPTLPFLALSHLLLRVLDKIGPTMAVLRLDVQRNIERLQELYLMDPAKYSTLTEIVEKEVKEGTARKVDSCARAVLWLARSMDFTIALLQKLEEDTAEQSLAQLVEAAYEVSLKPWHGWISSAACKIALQLIPERKVFTSLLLGMGQDCSALKDEIEKLALLLRPLLDDIHSMMAKFRLDRLKST

SEQ ID NO: 4123 - protein, 276 aa, Oryza sativa subsp. japonica
  misc_feature (1)..(276): useful for making plants with increased salt and oxidative stress resistance as described in USSN 12/922,143
  misc_feature (1)..(276): Public GI ID no.39545646
  misc_feature (1)..(276): Bit score of 105.9 for HMM based on sequences of FIGURE 13 of USSN 12/922,143.
  misc_feature (76)..(265): Pfam Name: GLTP Pfam Description: Glycolipid transfer protein (GLTP)
  misc_feature (1)..(276): Functional Homolog Of Ceres SEEDLINE ID no. ME08052
MDDGPCGESEGGGDAAAKAVGAKDAGEGDEPKEEEEDGRDREEEEEEAAKRGWSEIRLAIEELSAVDVERRGGKPPPPLPPPPTLTFLALSHLLLQVLDKIGPTMAVLRLDVQRNIERLQELYLLDPSKYYNLEEILEKEVDEGTARKVDSCARAILWLTRSMDFTIALLQRLEEDSDQKCFAQLVESAYMVTLKPWHGWISSAAYKIAMKLIPDRKMFINLLVGKCQDCAALKEEIRKLAKLLKPFLDDIHAMMFFKIPYSIFNKLIWQNEKISQ

SEQ ID NO: 4124 - protein, 297 aa, Oryza sativa subsp. indica
  misc_feature (1)..(297): useful for making plants with increased salt and oxidative stress resistance as described in USSN 12/922,143
  misc_feature (1)..(297): Public GI ID no.125548401
  misc_feature (1)..(297): Bit score of 106.4 for HMM based on sequences of FIGURE 13 of USSN 12/922,143.
  misc_feature (83)..(286): Pfam Name: GLTP Pfam Description: Glycolipid transfer protein (GLTP)
  misc_feature (1)..(297): Functional Homolog Of Ceres SEEDLINE ID no. ME08052
MVVETETGRDESEAAAATASAMDDGPCGESEGGGDAAAKAVGAKDAGEGDEPKEEEEDGRDREEEEEEAAKRGWSEIRLAIEELSAVDVERRGGKPPPPSPPPPTLTFLALSHLLLQVLDKIGPTMAVLRLDVQRNIERLQELYLLDPSKYYNLEEILEKEVDEGTARKVDSCARAILWLTRSMDFTIALLQRLEEDSDQKCFAQLVESAYMVTLKPWHGWISSAAYKIAMKLIPDRKMFINLLVGKCQDCAALKEEIRKLAKLLKPFLDDIHAMMFFKIPYSIFNKLIWQNEKISQ

SEQ ID NO: 4125 - DNA, 837 bp, Populus balsamifera subsp. trichocarpa
  misc_feature (1)..(837): useful for making plants with increased salt and oxidative stress resistance as described in USSN 12/922,143
  misc_feature (1)..(837): Ceres ANNOT ID no.1443167
atgaaaaggaccagagaaatagagaagggatcagagatcaagtctgcaattgaagaactttcgatgctgatcaaactcaagcctacaggtgacaatcacgataggactactgttcatatacccacaaggccttttatgtatgtctgcaaccttgttattcaggttcttgataagataggcccaacaatgacagttttgagacaagatattgatcagaatattcagagattgaagatgctatgtgattctgatccttcaatgtactccaatttggttgagattttaaagaaagaggccgatgaaggcggtgcaagaaagggtgccagctgcagtaaagcctctgtttggcttgccagatccttggattttacggttgctttgttagaaaggttagtggcggatcctggtcaggaaatggagaaactcgtggaagaatcttacaacatcactttaaagccatggcatggttggatttcatcagccgcttataaagtagctcttaaattagtacctgataataaaaccttgattgatctgctcatgccaaaagacgaaacctacgacacccttaaagaggatgtgcaaacattgatctcactacttgtgccttttttagaagagatccactctgttctgttaccctggcctcttcctccctcgttagcccttcaggggcttgttgtcagagtttgtgttgagctcctagcaacattccaagaaaatatgtcttcaagcgaaggtatctttggtatgagagctagtgaatttttccattgctgcgtccttccacctgatcatagccagcagtggacttcgtaccctatgcaattagattga

SEQ ID NO: 4126 - protein, 257 aa, Populus balsamifera subsp. trichocarpa
  misc_feature (1)..(257): useful for making plants with increased salt and oxidative stress resistance as described in USSN 12/922,143
  misc_feature (1)..(257): Ceres ANNOT ID no.1443167
  misc_feature (1)..(257): Bit score of 116.2 for HMM based on sequences of FIGURE 13 of USSN 12/922,143.
  misc_feature (11)..(202): Pfam Name: GLTP Pfam Description: Glycolipid transfer protein (GLTP)
  misc_feature (1)..(257): Functional Homolog Of Ceres SEEDLINE ID no. ME08052
MLIKLKPTGDNHDRTTVHIPTRPFMYVCNLVIQVLDKIGPTMTVLRQDIDQNIQRLKMLCDSDPSMYSNLVEILKKEADEGGARKGASCSKASVWLARSLDFTVALLERLVADPGQEMEKLVEESYNITLKPWHGWISSAAYKVALKLVPDNKTLIDLLMPKDETYDTLKEDVQTLISLLVPFLEEIHSVLLPWPLPPSLALQGLVVRVCVELLATFQENMSSSEGIFGMRASEFFHCCVLPPDHSQQWTSYPMQLD

SEQ ID NO: 4127 - DNA, 1424 bp, Zea mays
  misc_feature (1)..(1424): useful for making plants with increased salt and oxidative stress resistance as described in USSN 12/922,143
  misc_feature (1)..(1424): Ceres CLONE ID no.264471
gagctcctagtaaagtagtaatagcgtgcctgtttctacagggcttcccgtactgacactgatacctgcctggatattattagtaggatatagtatatattatggtctcaagggctgctaccgattggagggtcaggtcttcattcgcaaaacacagacatttgacttgcgctctccctttctctctctctctgtgtgtatgtgtgtgtgtgtctcaggttctcagcaaagagcagggaggataagcttggaatgcctcggcagtgagagctgcaactgcaacaaagcaaccggcgtccatggtggagagggaaaggggcgagggagaagccagggccctggccagcgggcactgcagcagcagcagcagcaggaaggagcagcggagggcgagagggtcgagaaagaaggagacgagcgggaggaggaggatcgagacgacgaagccgtggagtggtccgagatacggctcgccatcgaggagctgtccccggcggcccatctcaagcgcggcgacggcgatgccaaggcggccgcgtcgtccctgcccacgctccgcttcctggcgctgtcgcacctcctcgttcgagtgctcgataagatcgggccgaccatggccgtgctgaggctcgacgtccaacggaacatcgagaggctgcaggagctgtacctgctggacccagccacgtactcgaccctgacggggatagtggagaaggaagtgaaggagggcacagcgaggaaggtcgacagctgcgcaagggcgatcctatggcttgctagatccatggatttcacagctgcgctgttacagaggctggaggaggactctgcgcagcagcagcagcagagcctcgcgcagctcgtggaagccgcgtacgaggccaccctgaagccgtggcacggctggatctcctcggcggcgtgcaagatagcgtggaagctcatccccgagaggaaggtcttcaccggcatgctgctggggatgggccaggactgctctgcactcggggacgacatcgggcggctcgcgctgttgcttcggcccttcctcgatgacatccactccatgatggccaagttcagactggacaggctcaagtcgacgtgatccatggatggcgaacacgacgcaagcccaagccatggacatggtccccgtccttcgctgtgaatactgcctgccctggctttactcttggagtcgcatttgcttgcggttaggtctagtttagacgctgctgctctctagtctatacataggtcttttgcttgtagaatagactcccaagatctgcatgctgtgcccttttttcgtggtagggtacgtttggacagcgccctcctcaattgcctttgcctgtgccaatacgttggccggccaaactttggctgcccaagaaacggaaaaaaaaacttcgtgc

SEQ ID NO: 4128 - protein, 303 aa, Zea mays
  misc_feature (1)..(303): useful for making plants with increased salt and oxidative stress resistance as described in USSN 12/922,143
  misc_feature (1)..(303): Ceres CLONE ID no.264471
  misc_feature (1)..(303): Bit score of 127.8 for HMM based on sequences of FIGURE 13 of USSN 12/922,143.
  misc_feature (103)..(299): Pfam Name: GLTP Pfam Description: Glycolipid transfer protein (GLTP)
  misc_feature (1)..(303): Functional Homolog Of Ceres SEEDLINE ID no. ME08052
MCVCVSGSQQRAGRISLECLGSESCNCNKATGVHGGEGKGRGRSQGPGQRALQQQQQQEGAAEGERVEKEGDEREEEDRDDEAVEWSEIRLAIEELSPAAHLKRGDGDAKAAASSLPTLRFLALSHLLVRVLDKIGPTMAVLRLDVQRNIERLQELYLLDPATYSTLTGIVEKEVKEGTARKVDSCARAILWLARSMDFTAALLQRLEEDSAQQQQQSLAQLVEAAYEATLKPWHGWISSAACKIAWKLIPERKVFTGMLLGMGQDCSALGDDIGRLALLLRPFLDDIHSMMAKFRLDRLKST

SEQ ID NO: 4129 - protein, 235 aa, Oryza sativa subsp. japonica
  misc_feature (1)..(235): useful for making plants with increased salt and oxidative stress resistance as described in USSN 12/922,143
  misc_feature (1)..(235): Public GI ID no.42408243
  misc_feature (1)..(235): Bit score of 89.1 for HMM based on sequences of FIGURE 13 of USSN 12/922,143.
  misc_feature (50)..(231): Pfam Name: GLTP Pfam Description: Glycolipid transfer protein (GLTP)
  misc_feature (1)..(235): Functional Homolog Of Ceres SEEDLINE ID no. ME08052
MEVRREEMMEKGKSELRIAMEELSLPCPGDDEDEQQQRQKRSSTMDLLCVSKHIIHVLDEIGPTLLVLRQDIQQNVQRLQDVLARDPSKYSSLTAIVTEEVEEGTSKKANSCTRAILWLASAVLRILPIRSINFSKHLLEGLLNTCDQSSLREIVEKAYITTLKPWHGWISSAAYRVAQKLIPEKEIFIALLMGNCQEFEVFAKDVKVLLSIVQPLIEEANAVLVKHNLDKLKST

SEQ ID NO: 4130 - protein, 245 aa, Oryza sativa subsp. japonica
  misc_feature (1)..(245): useful for making plants with increased salt and oxidative stress resistance as described in USSN 12/922,143
  misc_feature (1)..(245): Public GI ID no.115474419
  misc_feature (1)..(245): Bit score of 72.0 for HMM based on sequences of FIGURE 13 of USSN 12/922,143.
  misc_feature (50)..(231): Pfam Name: GLTP Pfam Description: Glycolipid transfer protein (GLTP)
  misc_feature (1)..(245): Functional Homolog Of Ceres SEEDLINE ID no. ME08052
MEVRREEMMEKGKSELRIAMEELSLPCPGDDEDEQQQRQKRSSTMDLLCVSKHIIHVLDEIGPTLLVLRQDIQQNVQRLQDVLARDPSKYSSLTAIVTEEVEEGTSKKANSCTRAILWLASAVLRILPIRSINFSKHLLEGLLNTCDQSSLREIVEKAYITTLKPWHGWISSAAYRVAQKLIPEKEIFIALLMGNCQEFEVFAKDVKVLLSIVQPLIEEANAVLVRAPMIAHLSVKHNLDKLKST

SEQ ID NO: 4131 - DNA, 585 bp, Sorghum bicolor
  misc_feature (1)..(585): useful for making plants with increased salt and oxidative stress resistance as described in USSN 12/922,143
  misc_feature (1)..(585): Ceres ANNOT ID no.6113990
atggcagagacggtgttcaccccatctttggaagggatgaagcatgtcaaggcagagaacggagtcattctcaccaagcccttccttgatgtctgcaagcaaatcttgcctgtcctcgataaatttggagctgctatggcaattgtaaagactgatatcggtggcaatatcacaagactggaaaacaagtattgttcagatccatcaaagtatgaacatttgtacaccatggctcaggaagaagttcaaaacaagaccgcaaaaggttcctcaagctgcacaaatgggcttctgtggctcacgagggccatggatttccttgtcgagttgtttcgtaacctgcttgagcatccagattggaccatgagtcaagcttgcactgattcatacaccaagactctgaagaaatttcatggctggcttgccagttctagttttacggtggccatgaagcttgctcccaatagagataaatttatggaggtcattagtggaactggtgacatcaatgcagatattgagaaattttgcacaaccttctcacctttcctcaaagaaaatcacaactttctgctggaattttag

SEQ ID NO: 4132 - protein, 194 aa, Sorghum bicolor
  misc_feature (1)..(194): useful for making plants with increased salt and oxidative stress resistance as described in USSN 12/922,143
  misc_feature (1)..(194): Ceres ANNOT ID no.6113990
  misc_feature (1)..(194): Bit score of 508.0 for HMM based on sequences of FIGURE 13 of USSN 12/922,143.
  misc_feature (10)..(193): Pfam Name: GLTP Pfam Description: Glycolipid transfer protein (GLTP)
  misc_feature (1)..(194): Functional Homolog Of Ceres SEEDLINE ID no. ME08052
MAETVFTPSLEGMKHVKAENGVILTKPFLDVCKQILPVLDKFGAAMAIVKTDIGGNITRLENKYCSDPSKYEHLYTMAQEEVQNKTAKGSSSCTNGLLWLTRAMDFLVELFRNLLEHPDWTMSQACTDSYTKTLKKFHGWLASSSFTVAMKLAPNRDKFMEVISGTGDINADIEKFCTTFSPFLKENHNFLLEF

SEQ ID NO: 4133 - DNA, 630 bp, Sorghum bicolor
  misc_feature (1)..(630): useful for making plants with increased salt and oxidative stress resistance as described in USSN 12/922,143
  misc_feature (1)..(630): Ceres ANNOT ID no.6041251
atggaggggaccgtgttcacaccctcccttgaggggatgaagcatgtcaagtcggagagtggcgtgatcctgaccaagccgtttctccaagtatgcaagcaaatccttccagtgctagagaaatttgggtcagccatgtcgattgtcaagacggacattggaggcaatatcacgaggctggagacaaaatatgcttctgatcctacaaagtatgaacagttgcacagcttggtgaaagtagaagtcagcgccaagactgccaaaagctctagcagctgtactaatggccttctctggctgacaagagccatggacttcttggttgcgctgttccacaatttggtacatcatccagactggcagatgtcacaagcttgcagtgacgcttacagcaaaacactgaagaaatggcatggctggttggcgagttcgagcttttcggttgccataaagcttgcaccagacaggaagaagttcatggacatcatcagtggttcaggcgacatcaacgctgatattgagaagttctgcgcaacattctcccctttgctggcagaaaaccacaagtttctggctgttgatggtgtttttggatatgtgaaagtatggcattatcaccatcaacaataa

SEQ ID NO: 4134 - protein, 209 aa, Sorghum bicolor
  misc_feature (1)..(209): useful for making plants with increased salt and oxidative stress resistance as described in USSN 12/922,143
  misc_feature (1)..(209): Ceres ANNOT ID no.6041251
  misc_feature (1)..(209): Bit score of 470.3 for HMM based on sequences of FIGURE 13 of USSN 12/922,143.
  misc_feature (10)..(201): Pfam Name: GLTP Pfam Description: Glycolipid transfer protein (GLTP)
  misc_feature (1)..(209): Functional Homolog Of Ceres SEEDLINE ID no. ME08052
MEGTVFTPSLEGMKHVKSESGVILTKPFLQVCKQILPVLEKFGSAMSIVKTDIGGNITRLETKYASDPTKYEQLHSLVKVEVSAKTAKSSSSCTNGLLWLTRAMDFLVALFHNLVHHPDWQMSQACSDAYSKTLKKWHGWLASSSFSVAIKLAPDRKKFMDIISGSGDINADIEKFCATFSPLLAENHKFLAVDGVFGYVKVWHYHHQQ

SEQ ID NO: 4135 - DNA, 846 bp, Sorghum bicolor
  misc_feature (1)..(846): useful for making plants with increased salt and oxidative stress resistance as described in USSN 12/922,143
  misc_feature (1)..(846): Ceres ANNOT ID no.6112309
atggtggagagggaaagagacgagggagaagcagccagggccctgaccaccgggccaccgcagcagcagcagcaggaggaggaggaggaggaggaaggagcagcggagggcgagagcgacgaggaagcgggagacgagcgggaagaggaggaggatcatcgagacgacgacgaagccgtggagtggtcggagatacggctcgccatcgaggagctgtccccgccggcccgtctcaagcacggcggcggcggcgacgatggcaaggcggccgcgtcgtcggtgcccactctgcgcttcctggcgctgtcgcacctcctcctccgcgtgctcgataagatcgggccgaccatggccgtgctgaggctcgacgtccaacggaacatcgagaggctgcaggagctgtacctgttggacccagccaagtactctaccctaacggaggtagtggagaaggaagtcaaggagggcactgcaaggaaggtcgatagctgtgcaagggctgtcctgtggcttgctagatccatggacttcacaattgcgctgttagtgagcatagaagaggactctgatgagcagcagcagcagagcctcgcgcagcttgtcgaagccgcgtacgaggcctgcctgaagccatggcatggctggatctcttcggcggcgtgcaagatagcgctgaagctcatccctgagaggaaggtcttcaccagcctgctgctggggatgggccaagactgctctgatctcaaggatgagatcaggaggctcgcgttgctgctccgccccctccttgatgacatccactccatgatggccaagttcagactggacaggctcaagtcgacgtga

SEQ ID NO: 4136 - protein, 281 aa, Sorghum bicolor
  misc_feature (1)..(281): useful for making plants with increased salt and oxidative stress resistance as described in USSN 12/922,143
  misc_feature (1)..(281): Ceres ANNOT ID no.6112309
  misc_feature (1)..(281): Bit score of 126.7 for HMM based on sequences of FIGURE 13 of USSN 12/922,143.
  misc_feature (79)..(277): Pfam Name: GLTP Pfam Description: Glycolipid transfer protein (GLTP)
  misc_feature (1)..(281): Functional Homolog Of Ceres SEEDLINE ID no. ME08052
MVERERDEGEAARALTTGPPQQQQQEEEEEEEGAAEGESDEEAGDEREEEEDHRDDDEAVEWSEIRLAIEELSPPARLKHGGGGDDGKAAASSVPTLRFLALSHLLLRVLDKIGPTMAVLRLDVQRNIERLQELYLLDPAKYSTLTEVVEKEVKEGTARKVDSCARAVLWLARSMDFTIALLVSIEEDSDEQQQQSLAQLVEAAYEACLKPWHGWISSAACKIALKLIPERKVFTSLLLGMGQDCSDLKDEIRRLALLLRPLLDDIHSMMAKFRLDRLKST

SEQ ID NO: 4137 - DNA, 693 bp, Sorghum bicolor
  misc_feature (1)..(693): useful for making plants with increased salt and oxidative stress resistance as described in USSN 12/922,143
  misc_feature (1)..(693): Ceres ANNOT ID no.6030204
atggagaggaaacggaaggagatggagaagggcaagtctgagctgagagtggccatggaggagcttcgtttgtgcagctcaggagatggggaggaggatcaggtgcaggtgcagcaggtgaaagtgcaggagcagcccaagtcatccaccatggacctcctctctgtctccaagcagctcatccatgtccttgatgagattggaccaacgttgctagtcctgaggcaggacattcagcaaaatgttcagagattacaagatctgcatgaaagagactcttccaaatatgctagcttgacgacgatagttactgaggaaattgagcaagggacagcaaagaagaccaaaagctgcaccagagctatcatctggctgtctaggtcgataaatttctcaaaatatttactggagaagctgctaaaaacacctgagtcaagcctggaagagattgtcgaagaagcctatggaaatactctgaagccatggcatggctggatctcatcagctgcttacaaggtagcactgaagctcatcccagaaagagaattcttcatagcgctgctgatgggtaattgtcaagactttgaggatcttgcagaagatgccaagacgttggcctatgctgtccagcccctgttagaggagatcgatgcaatttcggtcagggcttcgaacttcacatctgtttgctaa

SEQ ID NO: 4138 - protein, 230 aa, Sorghum bicolor
  misc_feature (1)..(230): useful for making plants with increased salt and oxidative stress resistance as described in USSN 12/922,143
  misc_feature (1)..(230): Ceres ANNOT ID no.6030204
  misc_feature (1)..(230): Bit score of 96.7 for HMM based on sequences of FIGURE 13 of USSN 12/922,143.
  misc_feature (54)..(218): Pfam Name: GLTP Pfam Description: Glycolipid transfer protein (GLTP)
  misc_feature (1)..(230): Functional Homolog Of Ceres SEEDLINE ID no. ME08052
MERKRKEMEKGKSELRVAMEELRLCSSGDGEEDQVQVQQVKVQEQPKSSTMDLLSVSKQLIHVLDEIGPTLLVLRQDIQQNVQRLQDLHERDSSKYASLTTIVTEEIEQGTAKKTKSCTRAIIWLSRSINFSKYLLEKLLKTPESSLEEIVEEAYGNTLKPWHGWISSAAYKVALKLIPEREFFIALLMGNCQDFEDLAEDAKTLAYAVQPLLEEIDAISVRASNFTSVC

SEQ ID NO: 4139 - DNA, 1732 bp, Arabidopsis thaliana
  misc_feature (1)..(1732): useful for making plants with increased salt and oxidative stress resistance as described in USSN 12/922,143
  misc_feature (1)..(1732): Ceres SEEDLINE ID no.ME08564
actcttccgtttcgagctctctctcacacacattgaatttcaaggtcgcgacgcgaaatatgagctctgaataacaaacaaacagagttggtgtcgatatcaaggcatgagagatggttagagaaaatgctgtaatgggtggtgccagtgaagagcgtggtgttcgggtcactcgagcaatggctagagctgttttgggtggggtctctgcctcttctagaccgtccttcaagaagcaacacaagaacaacaagggtttcggtagggtagcactagcagatgtcactaacataagcaagaaagggtgtgctacatcaaaatctcaggcaagaggaggttacaagaagactaacacaaagggagcttccaatgtctccattcaagttttgtcaactcaagaagatgttagagcaaaattagcaaaagatttaccctcaatatcaatggtacagtcacatgacgctaatgtagctgaaaggcaggaaggcacagaggtagtgcaaccttctatgtctgttatggcaggtcctctgctttcaatgcaggactctatgaagtctgatgaaatccttcgctctccaaacaaagacgttgatatgatgattactgagaaactaaaactttcagatggtttggacattgtggacattgattcaagtggagttaaaggatcctcaagtttggagttcatatgcccctgatatatacaatagtatatttgtcagggagtttgaaaggagaccgtcaagtgattacatggatatgttgcagcaagatatcactccaagcatgcgagggattctgattgattggcttgtggaggtttctgaggaatataagctacttccagatactctttaccttacagtgaatctgattgatcggtctctttctcaaagtttggttcagaaacaaaggctccagttgctgggtgttacttgcatgctgattgcatcaaagtatgaagagatttgtgctcctcgggtggaagaattttgcttcatcacagataatacgtacacaaaagcagaggtattgaaaatggagagtgaggttctaaatctgttgcattttcagttatctgttcccaccacaaaaacatttctcaggaggttcatcctagcatcacaatcttcttacaaggtttcatatgttgaactggaatttctggcaaattatttagcagagcttactcttgttgaatacagcttcttgcagtttctaccttccttgatagctgcatctgctgtattactcgccagatggaccctcaaccaatcagagcatccatggaattcaaccatggaacactatacgaattacaaagtgtcagagcttaaaactaccgtccttgcactggcagatttgcaacatgatatgaaaggctgttctctgaattctatacgcgaaaaatataaacagcagaagttcaggagtgtggcaaatttgtctccgaaaccggtgcagtcacttttcaaggctcaagtataaaactgtaaatgatgcatctatgaagactaaatattgactttcagaatttctgatactggaaaggtgtattatctttggttgtaattatttggccattctaattattgttaattcccaatcaccgcctgatcagtagttgtaacttgtaggatggtaccaagctctggtacttctagatcttgtaacatgaaattgttacatcatgatgattgatacaattaaagctgagaattatagtact

SEQ ID NO: 4140 - DNA, 1731 bp, Arabidopsis thaliana
  misc_feature (1)..(1731): useful for making plants with increased salt and oxidative stress resistance as described in USSN 12/922,143
  misc_feature (1)..(1731): Ceres SEEDLINE ID no.ME08564
  misc_feature (1)..(1731): Inplanta Sequence
actcttccgtttcgagctctctctcacacacattgaatttcaaggtcgcgacgcgaaatatgagctctgaataacaaacaaacagagttggtgtcgatatcaaggcatgagagatggttagagaaaatgctgtaatgggtggtgccagtgaagagcgtggtgttcgggtcactcgagcaatggctagagctgttttgggtggggtctctgcctcttctagaccgtccttcaagaagcaacacaagaacaacaagggtttcggtagggtagcactagcagatgtcactaacataagcaagaaagggtgtgctacatcaaaatctcaggcaagaggaggttacaagaagactaacacaaagggagcttccaatgtctccattcaagttttgtcaactcaagaagatgttagagcaaaattagcaaaagatttaccctcaatatcaatggtacagtcacatgacgctaatgtagctgaaaggcaggaaggcacagaggtagtgcaaccttctatgtctgttatggcaggtcctctgctttcaatgcaggactctatgaagtctgatgaaatccttcgctctccaaacaaagacgttgatatgatgattactgagaaactaaaactttcagatggtttggacattgtggacattgattcagtggagttaaaggatcctcaagtttggagttcatatgcccctgatatatacaatagtatatttgtcagggagtttgaaaggagaccgtcaagtgattacatggatatgttgcagcaagatatcactccaagcatgcgagggattctgattgattggcttgtggaggtttctgaggaatataagctacttccagatactctttaccttacagtgaatctgattgatcggtctctttctcaaagtttggttcagaaacaaaggctccagttgctgggtgttacttgcatgctgattgcatcaaagtatgaagagatttgtgctcctcgggtggaagaattttgcttcatcacagataatacgtacacaaaagcagaggtattgaaaatggagagtgaggttctaaatctgttgcattttcagttatctgttcccaccacaaaaacatttctcaggaggttcatcctagcatcacaatcttcttacaaggtttcatatgttgaactggaatttctggcaaattatttagcagagcttactcttgttgaatacagcttcttgcagtttctaccttccttgatagctgcatctgctgtattactcgccagatggaccctcaaccaatcagagcatccatggaattcaaccatggaacactatacgaattacaaagtgtcagagcttaaaactaccgtccttgcactggcagatttgcaacatgatatgaaaggctgttctctgaattctatacgcgaaaaatataaacagcagaagttcaggagtgtggcaaatttgtctccgaaaccggtgcagtcacttttcaaggctcaagtataaaactgtaaatgatgcatctatgaagactaaatattgactttcagaatttctgatactggaaaggtgtattatctttggttgtaattatttggccattctaattattgttaattcccaatcaccgcctgatcagtagttgtaacttgtaggatggtaccaagctctggtacttctagatcttgtaacatgaaattgttacatcatgatgattgatacaattaaagctgagaattatagtact

SEQ ID NO: 4141 - protein, 458 aa, Arabidopsis thaliana
  misc_feature (1)..(458): useful for making plants with increased salt and oxidative stress resistance as described in USSN 12/922,143
  misc_feature (1)..(458): Ceres SEEDLINE ID no.ME08564
  misc_feature (1)..(458): Bit score of 1146.3 for HMM based on sequences of FIGURE 9 of USSN 12/922,143.
  misc_feature (196)..(323): Pfam Name: Cyclin_N Pfam Description: Cyclin, N-terminal domain
  misc_feature (325)..(452): Pfam Name: Cyclin_C Pfam Description: Cyclin, C-terminal domain
MVRENAVMGGASEERGVRVTRAMARAVLGGVSASSRPSFKKQHKNNKGFGRVALADVTNISKKGCATSKSQARGGYKKTNTKGASNVSIQVLSTQEDVRAKLAKDLPSISMVQSHDANVAERQEGTEVVQPSMSVMAGPLLSMQDSMKSDEILRSPNKDVDMMITEKLKLSDGLDIVDIDSVELKDPQVWSSYAPDIYNSIFVREFERRPSSDYMDMLQQDITPSMRGILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKVSYVELEFLANYLAELTLVEYSFLQFLPSLIAASAVLLARWTLNQSEHPWNSTMEHYTNYKVSELKTTVLALADLQHDMKGCSLNSIREKYKQQKFRSVANLSPKPVQSLFKAQV

SEQ ID NO: 4142 - protein, 274 aa, Picea abies
  misc_feature (1)..(274): useful for making plants with increased salt and oxidative stress resistance as described in USSN 12/922,143
  misc_feature (1)..(274): Public GI ID no.12583565
  misc_feature (1)..(274): Bit score of 280.4 for HMM based on sequences of FIGURE 9 of USSN 12/922,143.
  misc_feature (163)..(265): Pfam Name: Cyclin_C Pfam Description: Cyclin, C-terminal domain
  misc_feature (8)..(135): Pfam Name: Cyclin_N Pfam Description: Cyclin, N-terminal domain
  misc_feature (1)..(274): Functional Homolog Of Ceres SEEDLINE ID no. ME08564
MCTAYVTDIYANMRVVELKRRPLPNFMETIQRDINANMRSVLIDWLVEVSEEYKLVPDTLYLTISYIDRFLSANVVNRQRLQLLGVSCMLVASKYEEICAPPVEEFCYITDNTYKKEEVLDMEINVLNRLQYDLTNTKPLRPFSGVSFEQLKHPVRFQACIWEFMGNYLAELTLVEYDFLKYLPSLIAAAAVFLARMTLDPMVHPWNSTLQHYTGYKVSDMRDCICAIHDLQLNRKGCTLAAIRDKYNQPKFKCVANLFPPPVISPQFFIDNEV

SEQ ID NO: 4143 - protein, 502 aa, Zea mays
  misc_feature (1)..(502): useful for making plants with increased salt and oxidative stress resistance as described in USSN 12/922,143
  misc_feature (1)..(502): Public GI ID no.1399510
  misc_feature (1)..(502): Bit score of 456.7 for HMM based on sequences of FIGURE 9 of USSN 12/922,143.
  misc_feature (237)..(364): Pfam Name: Cyclin_N Pfam Description: Cyclin, N-terminal domain
  misc_feature (366)..(493): Pfam Name: Cyclin_C Pfam Description: Cyclin, C-terminal domain
  misc_feature (1)..(502): Functional Homolog Of Ceres SEEDLINE ID no. ME08564
MSTHAASRRSSSSSAVAKRPAIAEGATKAAGPGPTAAQAKKRTALVNITNVAAPGARVAAVGKVAPPVTGAKLNPATSGAPLKKPSLANARTIRGSAAKSASIKPAPPVSRHDSSSEQKHNVPVPTTVHVPSRAPALVPYSSFVSPGRSGDSVSTDETMSTCDSMKSPDFEYIDNGGCSMLASLQRRADEHLRTSEDRDVEENKWKKNGPAPMEIDSICEVDSNFEDPQLCAALASDIYMHLREAEMKKRPSTDFMETIQKDVNPSMRAILIDWLVEVAEEYRLAPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLANYIAELSLLEYSLLSYPPSLIAASAIFLARFVLQPTKYPWNSTLAHYTQYKPSELSECVKALHRLSSVGPGSNLPAIREKYSQHKYKFVAKKQSPPQIPAEFFRDAAC

SEQ ID NO: 4144 - protein, 347 aa, Zea mays
  misc_feature (1)..(347): useful for making plants with increased salt and oxidative stress resistance as described in USSN 12/922,143
  misc_feature (1)..(347): Public GI ID no.516550
  misc_feature (1)..(347): Bit score of 359.0 for HMM based on sequences of FIGURE 9 of USSN 12/922,143.
  misc_feature (208)..(335): Pfam Name: Cyclin_C Pfam Description: Cyclin, C-terminal domain
  misc_feature (79)..(206): Pfam Name: Cyclin_N Pfam Description: Cyclin, N-terminal domain
  misc_feature (1)..(347): Functional Homolog Of Ceres SEEDLINE ID no. ME08564
MSTCDSMKSPDFEYVDNQDTSMLASLQRRTSEHLRISEDRDVEENKRKKNAVAPMEIDRICDVDSEYEDPQLCATLASDIYMHLREAETKKRPSTDFMEMIQKDVNPSMRAILIDWLVEVAEEYRLVPDTLYLTVNYIDRYLSGNEIRRKRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPSLEFFRDATCLD

SEQ ID NO: 4145 - DNA, 1826 bp, Glycine max
  misc_feature (1)..(1826): useful for making plants with increased salt and oxidative stress resistance as described in USSN 12/922,143
  misc_feature (1)..(1826): Ceres CLONE ID no.541501
attcatttctctctctcccaaagaagtgtcgaaaacaaagaagcaaacgaaactaaagcactaaagacagtaacgctgtcttccttgcttcgttcttgaataagagagaattcaaaatgtcgacccagaatcgtcgttcgtcgttttcgtcctcaacgacgtcgtccttggccaaacgccatgtatccgcctcaacgacgtcgtcgtctttggccgctcctgcaaacatggccaagaagcgtcctcctctctccaacctcaccaacaccgttgctcaccgcaactcttcctctttggttccatgcgcagctaaatttgccaagaccaagaaagaggttgttccggcgtgttcagggaacaaaagaccaacattggcgaatgttaaacccactagcgcagctatttttccgaaggctaattctttccctgtaagggatgaagctcctcctccggttgccaccgttactgttccggctccggtggtggatgtttcacctagtaaatcagatgcaatgtcggtttctatggatgagtcaatgtcttcttgtgactccttcaagagccctgacattgaatatgtggacaacatcgatgttgcagccgttgattcaattgagaggaaaacattcagcaatctcaacatctctgattctacagaagggaacatttgtagtagagacatacttgttgagttggagaagggagaaaattttgtcaatgttgataataattacgcggatcctcagctctgtgcaacctttgcttgtgatatctacaagcaccttcgtgcatctgaggccaagaaaaggccttccacagacttcatggagagaattcagaaggagataaaccccagcatgcgtgctatattgattgactggcttgtggaggtggctgaagagtatagactagtacctgatacattgtatttgacagtaaactacattgatcggtatctttcagggaatgtgatgaacagacagaggttacaattacttggtgttgcctccatgatgattgcctctaaatacgaggaaatttgtgcgcctcaggtggaggaattttgttacataactgataacacatacttcaaagaagaggttttgcagatggaatctgctgtcttgaattttctcaagtttgaaatgacagccccaacagtaaaatgtttcttgagaagatttgtacgtgcagctcaaggagtcgatgaggtcccttccctacaactagagtgcttgacaaactatattgccgaattgtctctcatggagtacagtatgcttggttatgctccatcacttatagccgcttctgcaattttcctggccaaattcatacttttcccttcaaagaaaccatggacttccacattacagcattacacgttgtacaagccttctgatctgtgtgtttgcgtgagggatcttcaccgtctttgttgtaacagccccaattctaatttgcctgcaattagggagaaatacagtcagcacaagtacaaatatgtggccaagaagtactgccctccttcaatacccccagaatttttccagaattgagcagagatgacagtctaatttttggttgggataggcttagattgatataacttcttgtctccagagaagatgcttctcttacactgtacaatgtagtagccaaccaacccttccatctcaattagaattcttgtatctgcttttattgacgtgcatactcttatgcccacaaattcacaaaaaaataacgcttcaagaagcaacttgtattattagctaagctactgcttcagtagcatcattaatggctaaaaggagccaacgcct

SEQ ID NO: 4146 - protein, 480 aa, Glycine max
  misc_feature (1)..(480): useful for making plants with increased salt and oxidative stress resistance as described in USSN 12/922,143
  misc_feature (1)..(480): Ceres CLONE ID no.541501
  misc_feature (1)..(480): Bit score of 451.4 for HMM based on sequences of FIGURE 9 of USSN 12/922,143.
  misc_feature (218)..(345): Pfam Name: Cyclin_N Pfam Description: Cyclin, N-terminal domain
  misc_feature (347)..(474): Pfam Name: Cyclin_C Pfam Description: Cyclin, C-terminal domain
  misc_feature (1)..(480): Functional Homolog Of Ceres SEEDLINE ID no. ME08564
MSTQNRRSSFSSSTTSSLAKRHVSASTTSSSLAAPANMAKKRPPLSNLTNTVAHRNSSSLVPCAAKFAKTKKEVVPACSGNKRPTLANVKPTSAAIFPKANSFPVRDEAPPPVATVTVPAPVVDVSPSKSDAMSVSMDESMSSCDSFKSPDIEYVDNIDVAAVDSIERKTFSNLNISDSTEGNICSRDILVELEKGENFVNVDNNYADPQLCATFACDIYKHLRASEAKKRPSTDFMERIQKEINPSMRAILIDWLVEVAEEYRLVPDTLYLTVNYIDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLIAASAIFLAKFILFPSKKPWTSTLQHYTLYKPSDLCVCVRDLHRLCCNSPNSNLPAIREKYSQHKYKYVAKKYCPPSIPPEFFQN

SEQ ID NO: 4147 - protein, 484 aa, Glycine max
  misc_feature (1)..(484): useful for making plants with increased salt and oxidative stress resistance as described in USSN 12/922,143
  misc_feature (1)..(484): Public GI ID no.857397
  misc_feature (1)..(484): Bit score of 450.9 for HMM based on sequences of FIGURE 9 of USSN 12/922,143.
  misc_feature (222)..(349): Pfam Name: Cyclin_N Pfam Description: Cyclin, N-terminal domain
  misc_feature (351)..(478): Pfam Name: Cyclin_C Pfam Description: Cyclin, C-terminal domain
  misc_feature (1)..(484): Functional Homolog Of Ceres SEEDLINE ID no. ME08564
MSTQNRRSSFSSSTTSSLAKRHASASTTSSLAAAPTNMAKKRPPLSNLTNTVAHRNSSSSVPCAAKFAKTKKDVVPACSGNKRPTLANVKPASAVIFPKANSFPVKNEAPPTPPPPVATVTVPAPVVDVSPSKSDTMSVSTDESMSSCDSFKSPDIEYVDNSDVAAVDSIERKTFSHLNISDSTEGNICSREILVELEKGDKFVNVDNNYADPQLCATFACDIYKHLRASEAKKRPSTDFMEKIQKEINSSMRAILIDWLVEVAEEYRLVPDTLYLTVNYIDRYLSGNVMNRQRLQLLGVASMMIASKYEEICAPQVEEFCYITDNTYFKEEVLQMESAVLNFLKFEMTAPTVKCFLRRFVRAAQGVDEVPSLQLECLTNYIAELSLMEYSMLGYAPSLVAASAIFLAKFILFPSKKPWNSTLQHYTLYQPSDLCVCVKDLHRLCCNSPNSNLPAIREKYSQHKYKYVAKKYCPPSIPPEFFQN

SEQ ID NO: 4148 - protein, 483 aa, Nicotiana tabacum
  misc_feature (1)..(483): useful for making plants with increased salt and oxidative stress resistance as described in USSN 12/922,143
  misc_feature (1)..(483): Public GI ID no.1064927
  misc_feature (1)..(483): Bit score of 462.0 for HMM based on sequences of FIGURE 9 of USSN 12/922,143.
  misc_feature (218)..(345): Pfam Name: Cyclin_N Pfam Description: Cyclin, N-terminal domain
  misc_feature (347)..(474): Pfam Name: Cyclin_C Pfam Description: Cyclin, C-terminal domain
  misc_feature (1)..(483): Functional Homolog Of Ceres SEEDLINE ID no. ME08564
MATTQNRRSSVSSATAKRQAMTANSSLENNNHGKLVAKKRPALTNISNHTTASARNSLSHSSKLAPCTSKAVSIKKSNSNAASSVLPTSSFVKPISKTVSIPRSDAAIPKITAIPLPATCSMDISPSHSDGSLVSMDETMSTSDSLRSPDVEYIDDNQTAAFDSIEKKAFSTLYISEDVKAADICKRDVLVDIESGDKIANIDNNFVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVVALHSLCCNNNNSSLPAIREKYSQHKYKFVAKKYCPPTIPVEFFQNISC

SEQ ID NO: 4149 - DNA, 1083 bp, Populus balsamifera subsp. trichocarpa; identical to SEQ ID NO: 1345
  misc_feature (1)..(1083): useful for making plants with increased salt and oxidative stress resistance as described in USSN 12/922,143
  misc_feature (1)..(1083): Ceres ANNOT ID no.1443786

SEQ ID NO: 4150 - protein, 360 aa, Populus balsamifera subsp. trichocarpa; identical to SEQ ID NO: 1346
  misc_feature (1)..(360): useful for making plants with increased salt and oxidative stress resistance as described in USSN 12/922,143
  misc_feature (1)..(360): Ceres ANNOT ID no.1443786
  misc_feature (1)..(360): Bit score of 385.0 for HMM based on sequences of FIGURE 9 of USSN 12/922,143.
  misc_feature (226)..(353): Pfam Name: Cyclin_C Pfam Description: Cyclin, C-terminal domain
  misc_feature (95)..(224): Pfam Name: Cyclin_N Pfam Description: Cyclin, N-terminal domain
  misc_feature (1)..(360): Functional Homolog Of Ceres SEEDLINE ID no. ME08564

SEQ ID NO: 4151 - protein, 483 aa, Nicotiana tabacum
  misc_feature (1)..(483): useful for making plants with increased salt and oxidative stress resistance as described in USSN 12/922,143
  misc_feature (1)..(483): Public GI ID no.849070
  misc_feature (1)..(483): Bit score of 460.7 for HMM based on sequences of FIGURE 9 of USSN 12/922,143.
  misc_feature (218)..(345): Pfam Name: Cyclin_N Pfam Description: Cyclin, N-terminal domain
  misc_feature (347)..(474): Pfam Name: Cyclin_C Pfam Description: Cyclin, C-terminal domain
  misc_feature (1)..(483): Functional Homolog Of Ceres SEEDLINE ID no. ME08564
MATTQNRRSSVSSATTKRQAMTSNSSLENNNHGKLVAKKRPALTNISNHTTASARNSLSHSSKLAPCTSKAVSIKKSNSNAASSVLPTSSFVKPISKTVSIPRSDAAIPKITAIPLPATCSMDISPSHSDGSLVSMDETMSTSDSLRSPDVEYIDDNQTAAFDSIEKKAFSTLYISEDVKAADICKRDVLVDIESGDKIANIDNNFVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVVALHSLCCNNNNSSLPAIREKYSQHKYKFVAKKYCPPTIPVEFFQNISC

SEQ ID NO: 4152 - protein, 496 aa, Scutellaria baicalensis
  misc_feature (1)..(496): useful for making plants with increased salt and oxidative stress resistance as described in USSN 12/922,143
  misc_feature (1)..(496): Public GI ID no.70568819
  misc_feature (1)..(496): Bit score of 465.4 for HMM based on sequences of FIGURE 9 of USSN 12/922,143.
  misc_feature (231)..(358): Pfam Name: Cyclin_N Pfam Description: Cyclin, N-terminal domain
  misc_feature (360)..(487): Pfam Name: Cyclin_C Pfam Description: Cyclin, C-terminal domain
  misc_feature (1)..(496): Functional Homolog Of Ceres SEEDLINE ID no. ME08564
MASSAGVRRPTTSSLAKRHASSASDNVGKVASSASASKKRPALANVTNQRHGTGSANAGRAPLPESSKIAPCTTKIVSIKKGPSASTNSGFPGAILPTSSSVKQNIVAVGRSTFIPKSDVVLPKTLAAPVSCSMDVSPDKSDSLSVSMDESMSTCDSLKSPDVEHVDYIDVAAVDSIERKASNMLCISDHMEIAGNLCKRDALASLESGDKIVDVDENLDDPQLCATIACDIYKHLRASEAKKRPATNFMERVQKDINASMRAILIDWLVEVAEEYRLVPDTLYLTVNYIDRYLSGNVMDRQRLQLLGIACMMIASKYEEICAPQVEEFCYITDNTYFKDEVLEMESAVLNYLKFEMTAPTAKCFLRRFVRAAQGVNETPLLQFECLANYITELSLLEYSMLCFAPSLIAAASIFLARFILLPSKRPWNHTLRHYTLYQPYDLRDCVLALHGFCCNSHNSSLPAIREKYSQHKYKFVAKKYCPLSIPPEYFHNVSS

SEQ ID NO: 4153 - protein, 482 aa, Nicotiana tabacum
  misc_feature (1)..(482): useful for making plants with increased salt and oxidative stress resistance as described in USSN 12/922,143
  misc_feature (1)..(482): Public GI ID no.1064929
  misc_feature (1)..(482): Bit score of 465.8 for HMM based on sequences of FIGURE 9 of USSN 12/922,143.
  misc_feature (217)..(344): Pfam Name: Cyclin_N Pfam Description: Cyclin, N-terminal domain
  misc_feature (346)..(473): Pfam Name: Cyclin_C Pfam Description: Cyclin, C-terminal domain
  misc_feature (1)..(482): Functional Homolog Of Ceres SEEDLINE ID no. ME08564
MATTQNRRNSVSSAVAKRQAMAENNHGKLPAGGAKKRPALTNISNHTTASARNSLSHSSKLAPCTSKVVSIKKNNSNAASSVLPTSSSFVKPISKTVSLPRSDAAVPKITAIPPLPSTCSMDISPSHSDGSLVSMDETMSTSNSLRSPDVEYIDDNQTAAFDSIEKKAFSTLYISEDVKAADICKRDVLVDMESGDKIANIDNNLVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVMALHSLCCNNNNSSLPAIREKYSQHKYKFVAKKYCPPTIPVEFFQNISC

SEQ ID NO: 4154 - protein, 487 aa, Silene latifolia
  misc_feature (1)..(487): useful for making plants with increased salt and oxidative stress resistance as described in USSN 12/922,143
  misc_feature (1)..(487): Public GI ID no.28208266
  misc_feature (1)..(487): Bit score of 446.7 for HMM based on sequences of FIGURE 9 of USSN 12/922,143.
  misc_feature (223)..(350): Pfam Name: Cyclin_N Pfam Description: Cyclin, N-terminal domain
  misc_feature (352)..(478): Pfam Name: Cyclin_C Pfam Description: Cyclin, C-terminal domain
  misc_feature (1)..(487): Functional Homolog Of Ceres SEEDLINE ID no. ME08564
MSTQAHRNRLLGTENGNGGGGVKVVNNPKLTKKRPPLSNLTNHPRPSLVPSAITKSTKAKRDSSTGVRSTSFPAENPSATLNSKPSAVVPLKTAFTRSNVLVSCKASLPNGKGEQSHITRHPASCTMDTTPTPEDAQSVSMDESMSTCDSLKSPEVEYMDENDVAALCSIERKTSKNLYISDDMETTGSFCKREIVSAMEIDKVVDVDDNHMDPQFCSTIACDIYKHLRESETQKRPSTDFMEQTQKDINASMRAILVDWLVEVAEEYRLVPDTLYLTVNYIDRYLSGNAMNRQRLQLLGVACMMIAAKYEEICAPQVEEFCYITDNTYFKEEVLQMESGVLNFLKFEMTAPTTKNFLRRFVRAAQVMNEVPAFQLECLANYVAELSLLEYSMLKYAPSLIAASSVFLAKYMLTSSRPWNATLRHYTLYEASDLEECVKALHQLCLNSHISSLPAIREKYSHHKYKSVAKKHCPSSIPAEYFQNSSC

SEQ ID NO: 4155 - DNA, 1919 bp, Panicum virgatum
  misc_feature (1)..(1919): useful for making plants with increased salt and oxidative stress resistance as described in USSN 12/922,143
  misc_feature (1)..(1919): Ceres CLONE ID no.1878113
atcctcctcctctcttgtatttctccccctctaggctccctccctccctccctccccaaaccccctcgccgctcctgtcgggacgccccaaacccctagccctaagcccgacgaggaggatgtcgaccatcgccgcctcccgccgcgcctcctccgccaccgccaagcgccccgccatggccgagagcgccggggggcccaaggcggcgagcgccgccgccgcgcaggccaagaagcgcgtcgcgcttggcaacatcaccaacgtcgccgttgccgcgcaagcgggcagggccgccgggaagctcgcgccaccgccggccagcgcgaagttgaattcagttacctcagctgcacccttgaagaagccatcattggcaagtgctcgcagtgtgagctccgttcggggtcctgatttgaaatcagcttcaatcaagccagctccacccctttctcgccatgacagcacgacgcagaaccataatgttcctcttcctaaagtgcctaccgttctccaggcgcccagtcgcatacctgctttggttccctgcaacacctttgtgtctcctggaccctctggagactcggtttctgtcgatgagacaatgtcgacttgtgactccatgaaaagcccagactttgagtacatagacaatgaggactcctcaatgctcgcctcattgcagcgacgcgcaaatgaacacctacgtatctcagatgatagagatgttgaagaaaataagtggaagaaaaatgcctctgccccaatgaaaattgaccgcatttgtgatgttgacaatgacttagaggatccacagttgtgcgctactctggcttctgacatttacatgcatatgcgagaggctgagacgaagaaaagaccatctactgatttcatggaaacaattcaaaaggatgtcaacccaagcatgagggcaattttgatagactggcttgttgaagttgctgaagaatatcgtcttgtccctgatactctgtacctgacagttaactacattgaccgttatctttctggcaacgaaatcaaccgccaaaggctgcaattacttggtgttgcttgcatgcttatagctgcaaaatacgaggagatatgtgcaccacaagtagaagaattctgctacataactgacaacacttacttcagagatgaggttttggaaatggaagcttctgtactgaattacttgaagtttgaaatgaccgcaccaacagcgaaatgctttttgaggagatttgctcgtgctgcacaagcgtgtgatgaggatccagctctgcatcttgagtttctggccaattacatcgctgagctatcactccttgagtacagcctactctcataccctccatcgctaatagctgcctcagctattttcttggcaaagtttgtactccagccaacaaagtatccttggaattctacccttgctcactgcacacaatacaagccgtcggaattgtgcgattgcgtaaaggcattgcaccgcttattcggtgttagtcctgggagcaaccttcctgctatcagagaaaagtacagtcaacataagtacaaatttgtggcaaagaagcactgtccaacattgattcccaccgaattcttccgagatgtggtgtgctaggcttagaagaagcccaggagtagttccagttgcttactgaattcttgctcttgtggctgaaatgcccagtagcacccgcactgactgtgcaggtggttagttgatgcaggaggttggtgatgcccccctgttgtttcaggggattagaagagtgtagattctagattgaggctttgaagtttgtggccatgtattcctgtcctgcttcctgctgtaatcttcctgtatctagacccatgtttgcaggtgcatgtaaattggagttctgtagaagtagatgat

SEQ ID NO: 4156 - protein, 505 aa, Panicum virgatum
  misc_feature (1)..(505): useful for making plants with increased salt and oxidative stress resistance as described in USSN 12/922,143
  misc_feature (1)..(505): Ceres CLONE ID no.1878113
  misc_feature (1)..(505): Bit score of 459.0 for HMM based on sequences of FIGURE 9 of USSN 12/922,143.
  misc_feature (240)..(367): Pfam Name: Cyclin_N Pfam Description: Cyclin, N-terminal domain
  misc_feature (369)..(496): Pfam Name: Cyclin_C Pfam Description: Cyclin, C-terminal domain
  misc_feature (1)..(505): Functional Homolog Of Ceres SEEDLINE ID no. ME08564
MSTIAASRRASSATAKRPAMAESAGGPKAASAAAAQAKKRVALGNITNVAVAAQAGRAAGKLAPPPASAKLNSVTSAAPLKKPSLASARSVSSVRGPDLKSASIKPAPPLSRHDSTTQNHNVPLPKVPTVLQAPSRIPALVPCNTFVSPGPSGDSVSVDETMSTCDSMKSPDFEYIDNEDSSMLASLQRRANEHLRISDDRDVEENKWKKNASAPMKIDRICDVDNDLEDPQLCATLASDIYMHMREAETKKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEMTAPTAKCFLRRFARAAQACDEDPALHLEFLANYIAELSLLEYSLLSYPPSLIAASAIFLAKFVLQPTKYPWNSTLAHCTQYKPSELCDCVKALHRLFGVSPGSNLPAIREKYSQHKYKFVAKKHCPTLIPTEFFRDVVC

SEQ ID NO: 4157 - protein, 372 aa, Catharanthus roseus; identical to SEQ ID NO: 1372
  misc_feature (1)..(372): useful for making plants with increased salt and oxidative stress resistance as described in USSN 12/922,143
  misc_feature (1)..(372): Public GI ID no.2190259
  misc_feature (1)..(372): Bit score of 399.5 for HMM based on sequences of FIGURE 9 of USSN 12/922,143.
  misc_feature (107)..(236): Pfam Name: Cyclin_N Pfam Description: Cyclin, N-terminal domain
  misc_feature (238)..(365): Pfam Name: Cyclin_C Pfam Description: Cyclin, C-terminal domain
  misc_feature (1)..(372): Functional Homolog Of Ceres SEEDLINE ID no. ME08564

SEQ ID NO: 4158 - protein, 345 aa, Oryza sativa subsp. japonica
  misc_feature (1)..(345): useful for making plants with increased salt and oxidative stress resistance as described in USSN 12/922,143
  misc_feature (1)..(345): Public GI ID no.108862534
  misc_feature (1)..(345): Bit score of 366.0 for HMM based on sequences of FIGURE 9 of USSN 12/922,143.
  misc_feature (209)..(336): Pfam Name: Cyclin_C Pfam Description: Cyclin, C-terminal domain
  misc_feature (80)..(207): Pfam Name: Cyclin_N Pfam Description: Cyclin, N-terminal domain
  misc_feature (1)..(345): Functional Homolog Of Ceres SEEDLINE ID no. ME08564
MSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEVLEMEASVLNYLKFEMTAPTAKCFLRRFVRVAQVSDEDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRDSTC

SEQ ID NO: 4159 - protein, 442 aa, Arabidopsis thaliana
  misc_feature (1)..(442): useful for making plants with increased salt and oxidative stress resistance as described in USSN 12/922,143
  misc_feature (1)..(442): Public GI ID no.22330698
  misc_feature (1)..(442): Bit score of 362.3 for HMM based on sequences of FIGURE 9 of USSN 12/922,143.
  misc_feature (181)..(308): Pfam Name: Cyclin_N Pfam Description: Cyclin, N-terminal domain
  misc_feature (310)..(437): Pfam Name: Cyclin_C Pfam Description: Cyclin, C-terminal domain
  misc_feature (1)..(442): Functional Homolog Of Ceres SEEDLINE ID no. ME08564
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKKYSQHKYKFAAKKLCPTSLPQELFL

SEQ ID NO: 4160 - DNA, 1092 bp, Populus balsamifera subsp. trichocarpa; identical to SEQ ID NO: 1347
  misc_feature (1)..(1092): useful for making plants with increased salt and oxidative stress resistance as described in USSN 12/922,143
  misc_feature (1)..(1092): Ceres ANNOT ID no.1486570

SEQ ID NO: 4161 - protein, 363 aa, Populus balsamifera subsp. trichocarpa; identical to SEQ ID NO: 1348
  misc_feature (1)..(363): useful for making plants with increased salt and oxidative stress resistance as described in USSN 12/922,143
  misc_feature (1)..(363): Ceres ANNOT ID no.1486570
  misc_feature (1)..(363): Bit score of 390.2 for HMM based on sequences of FIGURE 9 of USSN 12/922,143.
  misc_feature (229)..(356): Pfam Name: Cyclin_C Pfam Description: Cyclin, C-terminal domain
  misc_feature (98)..(227): Pfam Name: Cyclin_N Pfam Description: Cyclin, N-terminal domain
  misc_feature (1)..(363): Functional Homolog Of Ceres SEEDLINE ID no. ME08564

SEQ ID NO: 4162 - protein, 355 aa, Arabidopsis thaliana; identical to SEQ ID NO: 1355
  misc_feature (1)..(355): useful for making plants with increased salt and oxidative stress resistance as described in USSN 12/922,143
  misc_feature (1)..(355): Public GI ID no.15239172
  misc_feature (1)..(355): Bit score of 342.8 for HMM based on sequences of FIGURE 9 of USSN 12/922,143.
  misc_feature (219)..(346): Pfam Name: Cyclin_C Pfam Description: Cyclin, C-terminal domain
  misc_feature (90)..(217): Pfam Name: Cyclin_N Pfam Description: Cyclin, N-terminal domain
  misc_feature (1)..(355): Functional Homolog Of Ceres SEEDLINE ID no. ME08564

SEQ ID NO: 4163 - protein, 384 aa, Nicotiana tabacum; identical to SEQ ID NO: 1374
  misc_feature (1)..(384): useful for making plants with increased salt and oxidative stress resistance as described in USSN 12/922,143
  misc_feature (1)..(384): Public GI ID no.1064931
  misc_feature (1)..(384): Bit score of 401.6 for HMM based on sequences of FIGURE 9 of USSN 12/922,143.
  misc_feature (116)..(245): Pfam Name: Cyclin_N Pfam Description: Cyclin, N-terminal domain
  misc_feature (247)..(374): Pfam Name: Cyclin_C Pfam Description: Cyclin, C-terminal domain
  misc_feature (1)..(384): Functional Homolog Of Ceres SEEDLINE ID no. ME08564

SEQ ID NO: 4164 - DNA, 1868 bp, Zea mays
  misc_feature (1)..(1868): useful for making plants with increased salt and oxidative stress resistance as described in USSN 12/922,143
  misc_feature (1)..(1868): Ceres CLONE ID no.1390716
aaaaaaaaactggtcccctccgccctccgccgtaccaccgcgcctccgcatttcgcatcaagccagagcgggggcagaggcgcctctcccgccggagacccgagcgagaaccgccgcttccccctccttctcctcattttgaaatcgcgttttggcggcctatctcctccgcaccgcgcaccatctctcctccgctgcaacgctacttaaccgcctcgatttgctccccatttccccgtccagcctagatagacctgagccgaaaccctaggaccccgcgcctccgcttccgcttccccctctcccgcagctgacgaggccgacgatgggggacaaggagaacgcacctcccttgggggcccggggcgcggcggcgccccggctcacgcgggccgcggccaagcgagctgcggcggcggcggcggcggcggagggtccgggcgacgccaagcggcggcgggtggcgctcggggagctcccggcgctcgccaacaacgccggcctccgcgcgccgtcctgccccgtcaagccctcgaagcctgcgtccaggcccgggaggcacgcgaggaatgttgcgccggaggcccgcgggccctcctccgcccacgaggccgagcgctgcgcgtcctccccgccgcgcaccgccgacgccgacgccgagtctaactccgtctccaaccccgcgccgcgcgccaccgcctacgccgactcctgcgcttcctcctcgccgccgcgcgccgccgccgccggggcgcccgccgacccccagctctgcgggtcctacgcctccgacatctacacctacctccgctccctggaggtggagccgcagcggcggtccagacccgattacatcgaggcggtgcaggcggacgttacggcgcacatgcgcggcatcctcgtcgactggctggtcgaggtcgccgaggagtataagctcgtcgccgacaccctgtacctcgccatctcctatgtggatcgcttcctctccgtcaatgcgctcggccgcgacaagctgcagctccttggcgtcgcctccatgctcattgctgcgaagtatgaggagatcagcccgccgcacccggaggacttttgctacatcacagacaacacctacaccaaagaggagctcctcaagatggagagcgatatactcaagcttctcaagttcgagttgggcaatcctaccattaagaccttcctgaggcggttcacaagatctgcccatgaagacaagaagcgctccatcttgttaatggaattcttggggagctacctggctgagttgagtctactggattatggctgtctccgattcttgccatcagtagttgctgcttcagttatgttcgttgctaggctgaccattgatccaaatgccaatccttggaacatgaagctgcagaagacgacaggctacaaagtttctgaactcaaggattgcatcgtagccatacgtgacttgcagctcaacaggaaatttccatcattaacggcaattcgagacaagtacaagcaacacaagttcaaatgtgtgtcaacgcttcttccccctgttgtggtccctacttcatactttgaagacttagctgagtagctgctcttggactgcaccactgtgaggctaacaatctgagctctccttgagctcttagggacgggagaataactgtgttatgagcttcttctcagttaagtagggttccaaaagctatttaagtgaggttctttaggaatcgcagctgagttactagtagtgaggccaggcattctcttgttttgtgaattgtattctttgtatgatatcctagtcacatcttgcctgttgcccacaatgtaatgtttgatacgttagacctttccgtctc

SEQ ID NO: 4165 - protein, 423 aa, Zea mays
  misc_feature (1)..(423): useful for making plants with increased salt and oxidative stress resistance as described in USSN 12/922,143
  misc_feature (1)..(423): Ceres CLONE ID no.1390716
  misc_feature (1)..(423): Bit score of 385.4 for HMM based on sequences of FIGURE 9 of USSN 12/922,143.
  misc_feature (156)..(285): Pfam Name: Cyclin_N Pfam Description: Cyclin, N-terminal domain
  misc_feature (287)..(414): Pfam Name: Cyclin_C Pfam Description: Cyclin, C-terminal domain
  misc_feature (1)..(423): Functional Homolog Of Ceres SEEDLINE ID no. ME08564
MGDKENAPPLGARGAAAPRLTRAAAKRAAAAAAAAEGPGDAKRRRVALGELPALANNAGLRAPSCPVKPSKPASRPGRHARNVAPEARGPSSAHEAERCASSPPRTADADAESNSVSNPAPRATAYADSCASSSPPRAAAAGAPADPQLCGSYASDIYTYLRSLEVEPQRRSRPDYIEAVQADVTAHMRGILVDWLVEVAEEYKLVADTLYLAISYVDRFLSVNALGRDKLQLLGVASMLIAAKYEEISPPHPEDFCYITDNTYTKEELLKMESDILKLLKFELGNPTIKTFLRRFTRSAHEDKKRSILLMEFLGSYLAELSLLDYGCLRFLPSVVAASVMFVARLTIDPNANPWNMKLQKTTGYKVSELKDCIVAIRDLQLNRKFPSLTAIRDKYKQHKFKCVSTLLPPVVVPTSYFEDLAE

SEQ ID NO: 4166 - DNA, 1077 bp, Populus balsamifera subsp. trichocarpa; identical to SEQ ID NO: 1349
  misc_feature (1)..(1077): useful for making plants with increased salt and oxidative stress resistance as described in USSN 12/922,143
  misc_feature (1)..(1077): Ceres ANNOT ID no.1539981

SEQ ID NO: 4167 - protein, 358 aa, Populus balsamifera subsp. trichocarpa; identical to SEQ ID NO: 1350
  misc_feature (1)..(358): useful for making plants with increased salt and oxidative stress resistance as described in USSN 12/922,143
  misc_feature (1)..(358): Ceres ANNOT ID no.1539981
  misc_feature (1)..(358): Bit score of 380.8 for HMM based on sequences of FIGURE 9 of USSN 12/922,143.
  misc_feature (229)..(351): Pfam Name: Cyclin_C Pfam Description: Cyclin, C-terminal domain
  misc_feature (98)..(227): Pfam Name: Cyclin_N Pfam Description: Cyclin, N-terminal domain
  misc_feature (1)..(358): Functional Homolog Of Ceres SEEDLINE ID no. ME08564

SEQ ID NO: 4168 - DNA, 1482 bp, Populus balsamifera subsp. trichocarpa
  misc_feature (1)..(1482): useful for making plants with increased salt and oxidative stress resistance as described in USSN 12/922,143
  misc_feature (1)..(1482): Ceres ANNOT ID no.1452143
atgtcgacgcagacacgccgttcgtcgttttcctcttcaacgtcgtcgtctcttgcaaaaagacacgcgtcttcttcatcgacagagaatgtaggcaaggccacggcggttgcgcctcatttggccaagaaacgagcccctcttggtgacattacgaatcaaaagaatgtgactcaaaaagggtcaagaaccttaattccatcatctactttggcaccattctcaaataaatttgccaaggtgaagaagggacctcctgcttctaatagcagtactttacctgcattcttaaatgcgaaatcgagtgctgttggtgtttgtaaggtgatctctatctcaacaagagacgaaagtgtccctcctgttgctgctgtttctgttccatgcagcaatgatgtttctccaagtaaatctgatgatctttcaatttctttggatgaatcaatgtccacctgtgattcttttaagagccccgaggttgaatatatagataacaatgaaataatagcaattgattctatcaataagaagaccttgagcaatctgtacatctcagatcatttggaaactgcagaaaatgtatgcatcagagatactcgtactgatatggaaacagatgataaaattgttaatgttgatgacaattaccaggatccgcagctttgtgcaaccattgcctgtgatatttacaagcatttgcgtgcatctgagatgaagaaaagaccctccacagacttcatggaaagaattcagaaagacataaatgccagcatgcgtgcaatactggttgactggcttgtggaggtagctgaagagtacaggcttgtaccagataccctgtatttgaccgtgaactacattgatcgatatctgtctggcaatgtgatgaacaggcaacgactgcagctgcttggtattgcctgcatgatggttgctgcgaaatacgaggaaatatgtgcaccccaggtggaagagttttgctacattaccgataacacatatttcagagatgaggttctggaaatggaatcaactgttttgaactacttgaagtttgaaatgacagccccaacagctaaatgttttttgaggcgatttgttcgtgctgctcaaggaatcaatgaggttccatcaatgcagttggaatgcttggccaactacattgcagaattatctctcctggaatatactatgctttgctatgctccgtcgctggtagctgcctctgccattttcctggccaaatatatacttcttccttcaaagagaccgtggaattccacattgcaacattacacactttacgagcctgttgatttgtgtcactgtgtaaaggatctctatcgcctgtgttgtggaagccataattctactttacccgcaatcagggagaaatacagtcagcataagtacaaatttgtagctaagaagtactgtccaccttccatacccgaggaattcttccagaacctaagctgctag

SEQ ID NO: 4169 - protein, 493 aa, Populus balsamifera subsp. trichocarpa
  misc_feature (1)..(493): useful for making plants with increased salt and oxidative stress resistance as described in USSN 12/922,143
  misc_feature (1)..(493): Ceres ANNOT ID no.1452143
  misc_feature (1)..(493): Bit score of 431.0 for HMM based on sequences of FIGURE 9 of USSN 12/922,143.
  misc_feature (228)..(355): Pfam Name: Cyclin_N Pfam Description: Cyclin, N-terminal domain
  misc_feature (357)..(484): Pfam Name: Cyclin_C Pfam Description: Cyclin, C-terminal domain
  misc_feature (1)..(493): Functional Homolog Of Ceres SEEDLINE ID no. ME08564
MSTQTRRSSFSSSTSSSLAKRHASSSSTENVGKATAVAPHLAKKRAPLGDITNQKNVTQKGSRTLIPSSTLAPFSNKFAKVKKGPPASNSSTLPAFLNAKSSAVGVCKVISISTRDESVPPVAAVSVPCSNDVSPSKSDDLSISLDESMSTCDSFKSPEVEYIDNNEIIAIDSINKKTLSNLYISDHLETAENVCIRDTRTDMETDDKIVNVDDNYQDPQLCATIACDIYKHLRASEMKKRPSTDFMERIQKDINASMRAILVDWLVEVAEEYRLVPDTLYLTVNYIDRYLSGNVMNRQRLQLLGIACMMVAAKYEEICAPQVEEFCYITDNTYFRDEVLEMESTVLNYLKFEMTAPTAKCFLRRFVRAAQGINEVPSMQLECLANYIAELSLLEYTMLCYAPSLVAASAIFLAKYILLPSKRPWNSTLQHYTLYEPVDLCHCVKDLYRLCCGSHNSTLPAIREKYSQHKYKFVAKKYCPPSIPEEFFQNLSC

SEQ ID NO: 4170 - protein, 425 aa, Brassica napus; identical to SEQ ID NO: 1363
  misc_feature (1)..(425): useful for making plants with increased salt and oxidative stress resistance as described in USSN 12/922,143
  misc_feature (1)..(425): Public GI ID no.562190
  misc_feature (1)..(425): Bit score of 382.7 for HMM based on sequences of FIGURE 9 of USSN 12/922,143.
  misc_feature (160)..(287): Pfam Name: Cyclin_N Pfam Description: Cyclin, N-terminal domain
  misc_feature (289)..(416): Pfam Name: Cyclin_C Pfam Description: Cyclin, C-terminal domain
  misc_feature (1)..(425): Functional Homolog Of Ceres SEEDLINE ID no. ME08564

SEQ ID NO: 4171 - DNA, 1773 bp, Glycine max; identical to SEQ ID NO: 1365
  misc_feature (1)..(1773): useful for making plants with increased salt and oxidative stress resistance as described in USSN 12/922,143
  misc_feature (1)..(1773): Ceres CLONE ID no.602910

SEQ ID NO: 4172 - protein, 367 aa, Glycine max; identical to SEQ ID NO: 1366
  misc_feature (1)..(367): useful for making plants with increased salt and oxidative stress resistance as described in USSN 12/922,143
  misc_feature (1)..(367): Ceres CLONE ID no.602910
  misc_feature (1)..(367): Bit score of 334.9 for HMM based on sequences of FIGURE 9 of USSN 12/922,143.
  misc_feature (226)..(353): Pfam Name: Cyclin_C Pfam Description: Cyclin, C-terminal domain
  misc_feature (95)..(224): Pfam Name: Cyclin_N Pfam Description: Cyclin, N-terminal domain
  misc_feature (1)..(367): Functional Homolog Of Ceres SEEDLINE ID no. ME08564

SEQ ID NO: 4173 - protein, 373 aa, Oryza sativa subsp. japonica
  misc_feature (1)..(373): useful for making plants with increased salt and oxidative stress resistance as described in USSN 12/922,143
  misc_feature (1)..(373): Public GI ID no.115454079
  misc_feature (1)..(373): Bit score of 340.7 for HMM based on sequences of FIGURE 9 of USSN 12/922,143.
  misc_feature (106)..(235): Pfam Name: Cyclin_N Pfam Description: Cyclin, N-terminal domain
  misc_feature (237)..(364): Pfam Name: Cyclin_C Pfam Description: Cyclin, C-terminal domain
  misc_feature (1)..(373): Functional Homolog Of Ceres SEEDLINE ID no. ME08564
MAGKENAAAAQPRLTRAAAKRAAAVTAVAVAAKRKRVALSELPTLSNNNAVVLKPQPAPRGGKRAASHAAEPKKPAPPPAPAVVVVVDDDEEGEGDPQLCAPYASDINSYLRSMEVQAKRRPAADYIETVQVDVTANMRGILVDWLVEVAEEYKLVSDTLYLTVSYIDRFLSAKSINRQKLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDSDTNPWSKKLQEVTGYRASELKDCITCIHDLQLNRKGSSLMAIRDKYKQHRFKGVSTLLPPVEIPASYFEDLNE

SEQ ID NO: 4174 - protein, 521 aa, Oryza sativa subsp. japonica
  misc_feature (1)..(521): useful for making plants with increased salt and oxidative stress resistance as described in USSN 12/922,143
  misc_feature (1)..(521): Public GI ID no.56783937
  misc_feature (1)..(521): Bit score of 416.5 for HMM based on sequences of FIGURE 9 of USSN 12/922,143.
  misc_feature (239)..(366): Pfam Name: Cyclin_N Pfam Description: Cyclin, N-terminal domain
  misc_feature (391)..(512): Pfam Name: Cyclin_C Pfam Description: Cyclin, C-terminal domain
  misc_feature (1)..(521): Functional Homolog Of Ceres SEEDLINE ID no. ME08564
MAAKRPAAGEGGGKAAAGAAAAKKRVALVNITNVAAAANNAVNRLNSLEGLLAPSKVQNKSFLGIREKFNSATWAAPVKKGSLASGRNVCTNRVSAVKSASAKPAPAISRHESAPQKESVIPPKVLSIVPTAAPAPVTVPCSSFVSPMHSGDSVSVDETMSMCDSMKSPDFEYIDNGDSSSVLGSLQRRANENLRISEDRDVEETKWNKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRCWNESNSNNSLIAYNRRFVRVAQVSDEDPALHLEFLANYVAELSLLEYNLLSYPPSLVAASAIFLAKFILQPTKHPWQNSTLAHYTQYKSSELSDCVKALHRLFSVGPGSNLPAIREKYTQHKYKFVAKKHCPPSVPSEFFRDATC

SEQ ID NO: 4175 - protein, 373 aa, Oryza sativa subsp. indica
  misc_feature (1)..(373): useful for making plants with increased salt and oxidative stress resistance as described in USSN 12/922,143
  misc_feature (1)..(373): Public GI ID no.125544822
  misc_feature (1)..(373): Bit score of 338.7 for HMM based on sequences of FIGURE 9 of USSN 12/922,143.
  misc_feature (106)..(235): Pfam Name: Cyclin_N Pfam Description: Cyclin, N-terminal domain
  misc_feature (237)..(364): Pfam Name: Cyclin_C Pfam Description: Cyclin, C-terminal domain
  misc_feature (1)..(373): Functional Homolog Of Ceres SEEDLINE ID no. ME08564
MAGKENAAAAQPRLTRAAAKRAAAVTAVAVAAKRKRVALSELPTLSNNNAVVLKPQPAPRGGKRTASHAAEPKKPAPAPAPAVVVVVDDDEEGEGDPQLCAPYASDINSYLRSMEVQPKRRPAADYIETVQVDVTANMRAILVDWLVEVAEEYKLVSDTLYLTVSYIDRFLSAKAINRQKLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDPDTNPWSKKLQEVTGYRASELKDCITCIHDLQLNRKGSSLMAIRDKYKQHRFKGVSTLLPPVEIPASYFEDLNE

SEQ ID NO: 4176 - DNA, 1323 bp, Sorghum bicolor
  misc_feature (1)..(1323): useful for making plants with increased salt and oxidative stress resistance as described in USSN 12/922,143
  misc_feature (1)..(1323): Ceres ANNOT ID no.6034905
atgggcatctcggcgaggtggctcaagtcgttagttgggttgaggaaggtggagcggcagcagcagcatcgtaaggaggatgcagatgttggacgaatgaaaggcgatgttgccgatcagtttcattttcagaatcagcgctctcaagaagacagcagcattgctgcacaagaagaaattccagaggttccttatggaaatgatccacctgaagttgattctaatgcaccttcatgcttggaacccacttgtgattcagctcatgtgccactgtctcaaaccgaagaggaactggaagagatctgggctgctacgattattcagacagcatttagagcattcctggctaggagagcccgtcgagctttaaaagggctggttaggcttcaagcccttgtaaggggtcatatagtaagaaagcaagctgccacgacactccgctgtatgcaagctttggtcagagttcaggcccgtgttagagcaaggcgagttcgcatggctttggaaaaccagactgaccagcaaaatacttcaccagagcacacgattgaggcacgtgttagagaaattgaggatggctggtgtgatagtatcggttctgtggaagatatccaagcaaaacttctaaagaggcaggaagcagcagctaaacgggagcgagccatggcctatgctctagctcatcagtggcaagcaagttcaagacaagctgcatcatttgaacctgacaagaacagctggggctggaattggctagagagatggatggctgttcggccttgggagagtcggttccttggcacttacgctgcagatgggatttttgtagttaatgaaaccaggcaacctgacataagtgcaacgaagaccccatgcagaaaacctgttaaaaagcatgattcaacccttcaatcaaacacattgaaccagaaggtcttcccatcaaactcagagggtggtggctcctcgacaaaccgatccagtggttcggcatcagctaaatctagactgaaggttttacccagagaaggcgctgaggaagcttcatctcgtccttctgtacttgttgtgcggtccactagtaacccaagggagaggacttccaatattaattcaaaagagaggactggggacttggattgtcaagttcataaaagattctccttgcctggcattggttcagaagctggcaaacacctgacaaagaaaggcacggttaaccgatccctgaaggccacaaaagattcccaaatactggggtcaaggcaccatcttgccagttccattgatccagttcccactagagttgagctagagacttga

SEQ ID NO: 4177 - DNA, 1461 bp, Arabidopsis thaliana; identical to SEQ ID NO: 1356
  misc_feature (1)..(1461): useful for making plants with increased salt and oxidative stress resistance as described in USSN 12/922,143
  misc_feature (1)..(1461): Ceres CLONE ID no.37206

SEQ ID NO: 4178 - protein, 369 aa, Arabidopsis thaliana; identical to SEQ ID NO: 1357
  misc_feature (1)..(369): useful for making plants with increased salt and oxidative stress resistance as described in USSN 12/922,143
  misc_feature (1)..(369): Ceres CLONE ID no.37206
  misc_feature (1)..(369): Bit score of 297.1 for HMM based on sequences of FIGURE 9 of USSN 12/922,143.
  misc_feature (229)..(356): Pfam Name: Cyclin_C Pfam Description: Cyclin, C-terminal domain
  misc_feature (98)..(227): Pfam Name: Cyclin_N Pfam Description: Cyclin, N-terminal domain
  misc_feature (1)..(369): Functional Homolog Of Ceres SEEDLINE ID no. ME08564

SEQ ID NO: 4179 - protein, 355 aa, Pisum sativum; identical to SEQ ID NO: 1370
  misc_feature (1)..(355): useful for making plants with increased salt and oxidative stress resistance as described in USSN 12/922,143
  misc_feature (1)..(355): Public GI ID no.7242793
  misc_feature (1)..(355): Bit score of 325.7 for HMM based on sequences of FIGURE 9 of USSN 12/922,143.
  misc_feature (216)..(344): Pfam Name: Cyclin_C Pfam Description: Cyclin, C-terminal domain
  misc_feature (85)..(214): Pfam Name: Cyclin_N Pfam Description: Cyclin, N-terminal domain
  misc_feature (1)..(355): Functional Homolog Of Ceres SEEDLINE ID no. ME08564

SEQ ID NO: 4180 - DNA, 1774 bp, Panicum virgatum
  misc_feature (1)..(1774): useful for making plants with increased salt and oxidative stress resistance as described in USSN 12/922,143
  misc_feature (1)..(1774): Ceres CLONE ID no.1861068
cgaccccaggtcagacgggatcacccgctgagtttaagcatataaataagcggaggagaagaaacttacaaggattcccctagtaacggcgagcgaaccgggagcagcccagcttgactccggacccagcgccgccaaaccctaggagcccgtgccgccgccgacgaggaggatggcggacaaggagaacgcgccggcggcggcggccgcggggccccggctcacccgatccgccgccaagcgcgcggccgaggccgccgccggcgcccccgccaagcgcaagcgggtggcgctcggggagctcccggcgctcgccgccaacgccgccaccgtccaccgcaccccgctggcccgcccggtcaagcccgcgaggggcgccgccaaggccgccaggcccggcaagccggtccccagacccgcagccgcccccgcggctgcggccgacgccgaagccgagcgctgcggatcctcctcgccgcggcgcgccgcgggggccgccgaccccgacctcgactcctccgcgtccaactcccctccgcgcgcggccgccgccgcggaccccgaccgcgactcctccgcctcctcctcccccccgccgcgcgctgccggggcgggggctctcggcaacccgcagctctgcgggtcctacgcctccgacatctacacctaccaccgcgctctggaggtggagccgcggcggcggccgagatccgactacattgaggccgtgcagtcggacgtcacggccaacatgcggaccatcctcgtcgactggctcgtcgaggtcgccgaggagtacaagctcgtcgccgacacgctctacctcgccatctcctacgtcgaccgcttcctctccgccaacgcgctcagccgtgacaagctgcaactccttggcgtcgctgccatgctcatcgccgcgaagtacgaagagatcagcccccctcatgcggaggacttctgctacatcactgacaatacctacactaagcaggagcttcttaagacagagagtgacatactcaagctgctccagtttgagttgggcaatcctacaattaagaccttcctgaggcggttcacaagatcggcccatgaagacaaaaagcgctccatcttattaatggagttcttggggagctaccttgctgagctgagtctgctggactatggctgtctccggttcttgccatcagtagttgctgcttcagtgatgtttgttgctaggctgaccattgatccagatgtcaatccttggaacaagaagttgcagaaggtgacaggctacaaggtttctgaactcaaggattgcattgtagccatacatgacttgcagctcaacaagaagtgttcatcagtgatggcaattcgggacaagtacaagcaacacaagttcaaatttgtatcgaccctgcttcctcctgttgtgatccctactccatactttgaagacttagcggagtagctggtcatggacccacaccactgtaaggctaacaatctgagctcttcttgagctcttagggataggggagaactactactattgatgtgctgcttctcagtgaagtagatactgattgctgaaagccatttatgtgctcgtggttctttaggagttgctagtagtgagacaaggcattcttctgttttgtgaattgtattttttgtatcatatcttaggacatgttgccttggtctgttggccacaaacttgtaatgtttgatatgttggctcattccttctgaatctcattgatttcaataacaaattctg

SEQ ID NO: 4181 - protein, 429 aa, Panicum virgatum
  misc_feature (1)..(429): useful for making plants with increased salt and oxidative stress resistance as described in USSN 12/922,143
  misc_feature (1)..(429): Ceres CLONE ID no.1861068
  misc_feature (1)..(429): Bit score of 371.4 for HMM based on sequences of FIGURE 9 of USSN 12/922,143.
  misc_feature (162)..(291): Pfam Name: Cyclin_N Pfam Description: Cyclin, N-terminal domain
  misc_feature (293)..(420): Pfam Name: Cyclin_C Pfam Description: Cyclin, C-terminal domain
  misc_feature (1)..(429): Functional Homolog Of Ceres SEEDLINE ID no. ME08564
MADKENAPAAAAAGPRLTRSAAKRAAEAAAGAPAKRKRVALGELPALAANAATVHRTPLARPVKPARGAAKAARPGKPVPRPAAAPAAAADAEAERCGSSSPRRAAGAADPDLDSSASNSPPRAAAAADPDRDSSASSSPPPRAAGAGALGNPQLCGSYASDIYTYHRALEVEPRRRPRSDYIEAVQSDVTANMRTILVDWLVEVAEEYKLVADTLYLAISYVDRFLSANALSRDKLQLLGVAAMLIAAKYEEISPPHAEDFCYITDNTYTKQELLKTESDILKLLQFELGNPTIKTFLRRFTRSAHEDKKRSILLMEFLGSYLAELSLLDYGCLRFLPSVVAASVMFVARLTIDPDVNPWNKKLQKVTGYKVSELKDCIVAIHDLQLNKKCSSVMAIRDKYKQHKFKFVSTLLPPVVIPTPYFEDLAE

SEQ ID NO: 4182 - protein, 370 aa, Arabidopsis thaliana; identical to SEQ ID NO: 1358
  misc_feature (1)..(370): useful for making plants with increased salt and oxidative stress resistance as described in USSN 12/922,143
  misc_feature (1)..(370): Public GI ID no.42571785
  misc_feature (1)..(370): Bit score of 288.3 for HMM based on sequences of FIGURE 9 of USSN 12/922,143.
  misc_feature (230)..(357): Pfam Name: Cyclin_C Pfam Description: Cyclin, C-terminal domain
  misc_feature (98)..(228): Pfam Name: Cyclin_N Pfam Description: Cyclin, N-terminal domain
  misc_feature (1)..(370): Functional Homolog Of Ceres SEEDLINE ID no. ME08564

SEQ ID NO: 4183 - protein, 443 aa, Sorghum bicolor
  misc_feature (1)..(443): useful for making plants with increased salt and oxidative stress resistance as described in USSN 12/922,143
  misc_feature (1)..(443): Ceres ANNOT ID no.6100259
  misc_feature (1)..(443): Bit score of 28.0 for HMM based on sequences of FIGURE 16 of USSN 12/922,143.
  misc_feature (107)..(127): Pfam Name: IQ Pfam Description: IQ calmodulin-binding motif
  misc_feature (1)..(443): Functional Homolog Of Ceres SEEDLINE ID no. ME24091
MGGSGKWVKSLIGLKKPDKEDCCKEKLQFPSVHGGLRGKGRKWKLWRTSSGDQGSIWRGSRGGSQRSAASEASDDASSVAAPADPFTAAVATVTRAPARDFMAVRQEWAAIRIQTAFRGFLARRALRALKGLVRLQAIVRGRQVRKQAAVTLRCMQALVRVQARIRARRVRMSTEGQAVQKLLEARRTQMDILREAEEGWCDSQGTLEQVRVKLQKRQEGAIKRERAIAYAYSQQADGAAKCNPPKLTSNGRVNPSGMLLKHQNFDKSNVNWSWLERWMAARPWENRLMEEHNQTNSSSPDFRSSKNCEDSFGVLGDFSEPNSVKVRKNNVSKRVCAKPPGPTHAHGHHQRLKAQSISSLSTELHNDESSASSSSCFASTPISFSTFVTSEKTEDNVRTRPNYMSMTESIKAKQKACNAQRTVALKQSDDRKVMSAELMAAQV

SEQ ID NO: 4184 - DNA, 1444 bp, Arabidopsis thaliana; identical to SEQ ID NO: 1359
  misc_feature (1)..(1444): useful for making plants with increased salt and oxidative stress resistance as described in USSN 12/922,143
  misc_feature (1)..(1444): Ceres CLONE ID no.121607

SEQ ID NO: 4185 - protein, 372 aa, Arabidopsis thaliana; identical to SEQ ID NO: 1360
  misc_feature (1)..(372): useful for making plants with increased salt and oxidative stress resistance as described in USSN 12/922,143
  misc_feature (1)..(372): Ceres CLONE ID no.121607
  misc_feature (1)..(372): Bit score of 340.0 for HMM based on sequences of FIGURE 9 of USSN 12/922,143.
  misc_feature (105)..(234): Pfam Name: Cyclin_N Pfam Description: Cyclin, N-terminal domain
  misc_feature (236)..(363): Pfam Name: Cyclin_C Pfam Description: Cyclin, C-terminal domain
  misc_feature (1)..(372): Functional Homolog Of Ceres SEEDLINE ID no. ME08564

SEQ ID NO: 4186 - protein, 371 aa, Nicotiana tabacum; identical to SEQ ID NO: 1375
  misc_feature (1)..(371): useful for making plants with increased salt and oxidative stress resistance as described in USSN 12/922,143
  misc_feature (1)..(371): Public GI ID no.2196455
  misc_feature (1)..(371): Bit score of 302.2 for HMM based on sequences of FIGURE 9 of USSN 12/922,143.
  misc_feature (107)..(236): Pfam Name: Cyclin_N Pfam Description: Cyclin, N-terminal domain
  misc_feature (238)..(365): Pfam Name: Cyclin_C Pfam Description: Cyclin, C-terminal domain
  misc_feature (1)..(371): Functional Homolog Of Ceres SEEDLINE ID no. ME08564

SEQ ID NO: 4187 - protein, 371 aa, Nicotiana tabacum; identical to SEQ ID NO: 1376
  misc_feature (1)..(371): useful for making plants with increased salt and oxidative stress resistance as described in USSN 12/922,143
  misc_feature (1)..(371): Public GI ID no.1064925
  misc_feature (1)..(371): Bit score of 300.5 for HMM based on sequences of FIGURE 9 of USSN 12/922,143.
  misc_feature (107)..(236): Pfam Name: Cyclin_N Pfam Description: Cyclin, N-terminal domain
  misc_feature (238)..(365): Pfam Name: Cyclin_C Pfam Description: Cyclin, C-terminal domain
  misc_feature (1)..(371): Functional Homolog Of Ceres SEEDLINE ID no. ME08564

SEQ ID NO: 4188 - DNA, 1381 bp, Zea mays; identical to SEQ ID NO: 1341
  misc_feature (1)..(1381): useful for making plants with increased salt and oxidative stress resistance as described in USSN 12/922,143
  misc_feature (1)..(1381): Ceres CLONE ID no.339439

SEQ ID NO: 4189 - protein, 345 aa, Zea mays; identical to SEQ ID NO: 1342
  misc_feature (1)..(345): useful for making plants with increased salt and oxidative stress resistance as described in USSN 12/922,143
  misc_feature (1)..(345): Ceres CLONE ID no.339439
  misc_feature (1)..(345): Bit score of 279.1 for HMM based on sequences of FIGURE 9 of USSN 12/922,143.
  misc_feature (209)..(336): Pfam Name: Cyclin_C Pfam Description: Cyclin, C-terminal domain
  misc_feature (78)..(207): Pfam Name: Cyclin_N Pfam Description: Cyclin, N-terminal domain
  misc_feature (1)..(345): Functional Homolog Of Ceres SEEDLINE ID no. ME08564

SEQ ID NO: 4190 - protein, 365 aa, Brassica rapa; identical to SEQ ID NO: 1364
  misc_feature (1)..(365): useful for making plants with increased salt and oxidative stress resistance as described in USSN 12/922,143
  misc_feature (1)..(365): Public GI ID no.83032266
  misc_feature (1)..(365): Bit score of 306.4 for HMM based on sequences of FIGURE 9 of USSN 12/922,143.
  misc_feature (228)..(355): Pfam Name: Cyclin_C Pfam Description: Cyclin, C-terminal domain
  misc_feature (96)..(226): Pfam Name: Cyclin_N Pfam Description: Cyclin, N-terminal domain
  misc_feature (1)..(365): Functional Homolog Of Ceres SEEDLINE ID no. ME08564

SEQ ID NO: 4191 - protein, 338 aa, Daucus carota
  misc_feature (1)..(338): useful for making plants with increased salt and oxidative stress resistance as described in USSN 12/922,143
  misc_feature (1)..(338): Public GI ID no.116167
  misc_feature (1)..(338): Bit score of 251.7 for HMM based on sequences of FIGURE 9 of USSN 12/922,143.
  misc_feature (205)..(331): Pfam Name: Cyclin_C Pfam Description: Cyclin, C-terminal domain
  misc_feature (74)..(203): Pfam Name: Cyclin_N Pfam Description: Cyclin, N-terminal domain
  misc_feature (1)..(338): Functional Homolog Of Ceres SEEDLINE ID no. ME08564
MTTPEPASKRRVVLGEISNNSSAVSGNEDLLCREFEVPKCVAQKKRKRGVKEDVGVDFGEKFDDPQMCSAYVSDVYEYLKQMEMETKRRPMMNYIEQVQKDVTSNMRGVLVDWLVEVSLEYKLLPETLYLAISYVDRYLSVNVLNRQKLQLLGVSSFLIASKYEEIKPKNVADFVDITDNTYSQQEVVKMEADLLKTLKFEMGSPTVKTFLGFIRAVQENPDVPKLKFEFLANYLAELSLLDYGCLEFVPSLIAASVTFLARFTIRPNVNPWSIALQKCSGYKSKDLKECVLLLHDLQMGRRGGSLSAVRDKYKKHKFKCVSTLSPAPEIPESIFNDV

SEQ ID NO: 4192 - protein, 385 aa, Oryza sativa subsp. indica; identical to SEQ ID NO: 1381
  misc_feature (1)..(385): useful for making plants with increased salt and oxidative stress resistance as described in USSN 12/922,143
  misc_feature (1)..(385): Public GI ID no.125537180
  misc_feature (1)..(385): Bit score of 306.2 for HMM based on sequences of FIGURE 9 of USSN 12/922,143.
  misc_feature (118)..(247): Pfam Name: Cyclin_N Pfam Description: Cyclin, N-terminal domain
  misc_feature (249)..(376): Pfam Name: Cyclin_C Pfam Description: Cyclin, C-terminal domain
  misc_feature (1)..(385): Functional Homolog Of Ceres SEEDLINE ID no. ME08564

SEQ ID NO: 4193 - protein, 385 aa, Oryza sativa subsp. japonica; identical to SEQ ID NO: 1382
  misc_feature (1)..(385): useful for making plants with increased salt and oxidative stress resistance as described in USSN 12/922,143
  misc_feature (1)..(385): Public GI ID no.115489300
  misc_feature (1)..(385): Bit score of 306.9 for HMM based on sequences of FIGURE 9 of USSN 12/922,143.
  misc_feature (118)..(247): Pfam Name: Cyclin_N Pfam Description: Cyclin, N-terminal domain
  misc_feature (249)..(376): Pfam Name: Cyclin_C Pfam Description: Cyclin, C-terminal domain
  misc_feature (1)..(385): Functional Homolog Of Ceres SEEDLINE ID no. ME08564

SEQ ID NO: 4194 - protein, 392 aa, Oryza sativa subsp. japonica
  misc_feature (1)..(392): useful for making plants with increased salt and oxidative stress resistance as described in USSN 12/922,143
  misc_feature (1)..(392): Public GI ID no.125587082
  misc_feature (1)..(392): Bit score of 301.5 for HMM based on sequences of FIGURE 9 of USSN 12/922,143.
  misc_feature (106)..(254): Pfam Name: Cyclin_N Pfam Description: Cyclin, N-terminal domain
  misc_feature (256)..(383): Pfam Name: Cyclin_C Pfam Description: Cyclin, C-terminal domain
  misc_feature (1)..(392): Functional Homolog Of Ceres SEEDLINE ID no. ME08564
MAGKENAAAAQPRLTRAAAKRAAAVTAVAVAAKRKRFALSELPTLSNNKAVVLKPQPAPRGGKRAASHAAEPKKPAPPPAPAVVVVVDDDEEGEGDPQLCAPYASDINSYLRSMEVQAKRRPAADYIETVQVDVTANMRGILVDWLVEVAEEYKLVSDTLYLTVSYIDRFLSAKSINRQKLQLLGVSAMLIASFTHQFKNRYLLRIGLVDPGKYEEISPPNVEDFGYITDNTYMKQEVVKMERDILNVLKFEMGNPTTKTFLRMFIRSSQEDDKYPSLPLEFMCSYLAELSLLEYGCVRLLPSVVAASVVFVARLTLDSDTNPWSKKLQEVTGYRASELKDCITCIHDLQLNRKGSSLMAIRDKYKQHRFKGVSTLLPPVEIPASYFEDLNE

SEQ ID NO: 4195 - protein, 378 aa, Solanum lycopersicum; identical to SEQ ID NO: 1373
  misc_feature (1)..(378): useful for making plants with increased salt and oxidative stress resistance as described in USSN 12/922,143
  misc_feature (1)..(378): Public GI ID no.5420278
  misc_feature (1)..(378): Bit score of 287.7 for HMM based on sequences of FIGURE 9 of USSN 12/922,143.
  misc_feature (114)..(243): Pfam Name: Cyclin_N Pfam Description: Cyclin, N-terminal domain
  misc_feature (245)..(372): Pfam Name: Cyclin_C Pfam Description: Cyclin, C-terminal domain
  misc_feature (1)..(378): Functional Homolog Of Ceres SEEDLINE ID no. ME08564

SEQ ID NO: 4196 - protein, 454 aa, Oryza sativa subsp. japonica
  misc_feature (1)..(454): useful for making plants with increased salt and oxidative stress resistance as described in USSN 12/922,143
  misc_feature (1)..(454): Public GI ID no.125569644
  misc_feature (1)..(454): Bit score of 335.9 for HMM based on sequences of FIGURE 9 of USSN 12/922,143.
  misc_feature (200)..(310): Pfam Name: Cyclin_N Pfam Description: Cyclin, N-terminal domain
  misc_feature (326)..(450): Pfam Name: Cyclin_C Pfam Description: Cyclin, C-terminal domain
  misc_feature (1)..(454): Functional Homolog Of Ceres SEEDLINE ID no. ME08564
MSSNLAASRRSSSSSSVAAAAAAKRPAVGEGGGGGGGKAAAGAAAAKKRVALSNISNVAAGGGAPGKAGNAVRDGSLVGGLGSFFFLFSKALFFARFGFEIFRSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKIYAADVIDLNMMIQRDS

SEQ ID NO: 4197 - protein, 327 aa, Arabidopsis thaliana; identical to SEQ ID NO: 1361
  misc_feature (1)..(327): useful for making plants with increased salt and oxidative stress resistance as described in USSN 12/922,143
  misc_feature (1)..(327): Public GI ID no.15220145
  misc_feature (1)..(327): Bit score of 205.3 for HMM based on sequences of FIGURE 9 of USSN 12/922,143.
  misc_feature (190)..(317): Pfam Name: Cyclin_C Pfam Description: Cyclin, C-terminal domain
  misc_feature (59)..(188): Pfam Name: Cyclin_N Pfam Description: Cyclin, N-terminal domain
  misc_feature (1)..(327): Functional Homolog Of Ceres SEEDLINE ID no. ME08564

SEQ ID NO: 4198 - DNA, 1332 bp, Sorghum bicolor
  misc_feature (1)..(1332): useful for making plants with increased salt and oxidative stress resistance as described in USSN 12/922,143
  misc_feature (1)..(1332): Ceres ANNOT ID no.6100259
atgggagggtccgggaagtgggtcaagtcgctcatagggctcaagaagcccgacaaggaagactgctgcaaggaaaagctgcaattcccatcagtgcatggaggactgcgaggcaagggccgcaagtggaagctgtggcggacctcctccggcgaccagggctccatctggcgcggctccagaggcggcagccagcgctcggcggcgtcggaggcctcggacgacgcgtcctcggtggccgcccccgccgacccgttcacggccgccgtcgccaccgtcacccgcgccccggcgcgggacttcatggccgtccgccaggagtgggccgccatccgcatccagaccgcgttccgcgggttcttggctcgccgtgcgctgagggcgctcaaggggctggtgcggctgcaggcgatcgtgcgcgggcggcaggtgcggaagcaggcggcggtgacgctgcgctgcatgcaggcgctggtgcgggtgcaggcgcgcatccgggcgcgccgcgtgcgcatgtccaccgagggccaggccgtgcagaagctgctcgaggcgcgccgtacccagatggacatcctcagggaagcagaggaaggatggtgtgacagtcaggggacacttgaacaagtgagggtgaagctgcagaagcggcaggagggcgcaatcaagcgcgagcgagctattgcgtacgcatattcacagcaggctgatggtgctgccaaatgcaatccaccgaagcttacttccaatggccgggtgaacccctccggtatgctgctcaagcaccagaattttgacaagagcaatgtcaactggagctggctggagaggtggatggcagcacgcccatgggagaatagattgatggaggagcacaaccagaccaactccagctcccctgacttccggtcctccaagaactgcgaggattcttttggtgtgctcggcgatttctctgaaccaaattcagtgaaggtgcgcaagaacaatgtcagcaaacgggtctgtgcaaaaccacctgggccaacacacgcccatggacatcatcagcgcctcaaagcccagtcgatctcgtctctgagcactgaactgcacaacgatgagagctctgcatcatcgtcgtcttgtttcgcatcgacccctatatcattctccacatttgtgacttcagagaagaccgaggacaatgtcaggacgagacccaactacatgagcatgacagagtcgatcaaggcgaagcagaaggcatgcaacgcccagagaacggtggcgctgaagcagtcagatgataggaaagtcatgagcgctgagttgatggccgctcaggtgtga

SEQ ID NO: 4199 - protein, 348 aa, Glycine max; identical to SEQ ID NO: 1367
  misc_feature (1)..(348): useful for making plants with increased salt and oxidative stress resistance as described in USSN 12/922,143
  misc_feature (1)..(348): Public GI ID no.857393
  misc_feature (1)..(348): Bit score of 198.8 for HMM based on sequences of FIGURE 9 of USSN 12/922,143.
  misc_feature (214)..(341): Pfam Name: Cyclin_C Pfam Description: Cyclin, C-terminal domain
  misc_feature (83)..(212): Pfam Name: Cyclin_N Pfam Description: Cyclin, N-terminal domain
  misc_feature (1)..(348): Functional Homolog Of Ceres SEEDLINE ID no. ME08564

SEQ ID NO: 4200 - DNA, 1498 bp, Glycine max; identical to SEQ ID NO: 1368
  misc_feature (1)..(1498): useful for making plants with increased salt and oxidative stress resistance as described in USSN 12/922,143
  misc_feature (1)..(1498): Ceres CLONE ID no.561499

SEQ ID NO: 4201 - protein, 358 aa, Glycine max; identical to SEQ ID NO: 1369
  misc_feature (1)..(358): useful for making plants with increased salt and oxidative stress resistance as described in USSN 12/922,143
  misc_feature (1)..(358): Ceres CLONE ID no.561499
  misc_feature (1)..(358): Bit score of 184.3 for HMM based on sequences of FIGURE 9 of USSN 12/922,143.
  misc_feature (216)..(343): Pfam Name: Cyclin_C Pfam Description: Cyclin, C-terminal domain
  misc_feature (85)..(214): Pfam Name: Cyclin_N Pfam Description: Cyclin, N-terminal domain
  misc_feature (1)..(358): Functional Homolog Of Ceres SEEDLINE ID no. ME08564

SEQ ID NO: 4202 - protein, 681 aa, Oryza sativa subsp. japonica
  misc_feature (1)..(681): useful for making plants with increased salt and oxidative stress resistance as described in USSN 12/922,143
  misc_feature (1)..(681): Public GI ID no.115435502
  misc_feature (1)..(681): Bit score of 234.6 for HMM based on sequences of FIGURE 9 of USSN 12/922,143.
  misc_feature (396)..(505): Pfam Name: Cyclin_N Pfam Description: Cyclin, N-terminal domain
  misc_feature (521)..(646): Pfam Name: Cyclin_C Pfam Description: Cyclin, C-terminal domain
  misc_feature (1)..(681): Functional Homolog Of Ceres SEEDLINE ID no. ME08564
MALVCAECRLVDIVRVHANLMVPEMEIQLGEEVGVAKFIKQFVENQNGKHVLGSHRVEGSVVHVEAPWLVDQQNRRREWRRVGADGELVSALFLQFVVLKLWVAIRSNHYRGLAGLEVDVMIDGSGRWEAGWSAKRSSNSASKDGRRSSACSAAQLRSRAKQSTSNTSVATYRRSPCTTPAPRMRSLSATTTRRPWRTGWRGRPMRWASLVVMKLCVEAGVNKGHHLLGRDTRHEAHRASAIDTENRVERDVWFIGVVCVVPFAEISRGVVVLKRPCLQRSGNSAGERQRNWCPGTSQGHGLLEILGLLELDIDADVVGEPRCEELNLLAVGEEVGRAATQRQKALLVRRHRANLSEMLEFTQGIVADRRSILTVTELLERIPIRRTHVLLIMEVPFLCSSSEMTRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKILHAADVIDLNMANAFKNVKILCQCPCQCNLLEEVMLKLFPYWKLSTAV

SEQ ID NO: 4203 - protein, 531 aa, Oryza sativa subsp. japonica
  misc_feature (1)..(531): useful for making plants with increased salt and oxidative stress resistance as described in USSN 12/922,143
  misc_feature (1)..(531): Public GI ID no.125569641
  misc_feature (1)..(531): Bit score of 234.6 for HMM based on sequences of FIGURE 9 of USSN 12/922,143.
  misc_feature (246)..(355): Pfam Name: Cyclin_N Pfam Description: Cyclin, N-terminal domain
  misc_feature (371)..(496): Pfam Name: Cyclin_C Pfam Description: Cyclin, C-terminal domain
  misc_feature (1)..(531): Functional Homolog Of Ceres SEEDLINE ID no. ME08564
MMSTQLRSRAKQSTSNTSVATYRRSPCTTPAPRMRSLSATTTRRPWRTGWRGRPMRWASLVVMKLCVEAGVNKGHHLLGRDTRHEAHRASAIDTENRVERDVWFIGVVCVVPFAEISRGVVVLKRPCLQRSGNSAGERQRNWCPGTSQGHGLLEILGLLELDIDADVVGEPRCEELNLLAVGEEVGRAATQRQKALLVRRHRANLSEMLEFTQGIVADRRSILTVTELLERIPIRRTHVLLIMEVPFLCSSSEMTRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKILHAADVIDLNMANAFKNVKILCQCPCQCNLLEEVMLKLFPYWKLSTAV

SEQ ID NO: 4204 - protein, 396 aa, Medicago truncatula
  misc_feature (1)..(396): useful for making plants with increased salt and oxidative stress resistance as described in USSN 12/922,143
  misc_feature (1)..(396): Public GI ID no.87241424
  misc_feature (1)..(396): Bit score of 263.4 for HMM based on sequences of FIGURE 9 of USSN 12/922,143.
  misc_feature (280)..(385): Pfam Name: Cyclin_C Pfam Description: Cyclin, C-terminal domain
  misc_feature (94)..(223): Pfam Name: Cyclin_N Pfam Description: Cyclin, N-terminal domain
  misc_feature (1)..(396): Functional Homolog Of Ceres SEEDLINE ID no. ME08564
MEPKSVNPTRRPQREAKKKAVAALCEQQRKRKRVPLGEITNDVNTNANANANDVVLPTQKKRNVSTSSNSDGTPVPEKLEKFEDPQLCETYVSDIYDYLRNMEVDSSKRPLCDYIQKVQRDVNASMRGVLVDWLVEVAEEYKLVSDTLYFSVSYIDRFLSLNDLTRQKLQLLGVASMLVASKYEEIKPPEVEDFCYITDNTYSKEEVLTMEADILKSLKFELGGPTIKTFLRHVCFIDYVSLYVEWYYCFCIVAHISFSFSVCRRFITKVGLEGVDASELQFEFLCSYLAELSLLDYNCVKFLPSMVAASVVFLARFMLSPKTHPWNSAIYEFTRYKPADLKECVLNIHDLYLGRKGGSLQAVRDKYKQHKFKCVATTPSPPEISLSFFEFRGADP

SEQ ID NO: 4205 - DNA, 1170 bp, Populus balsamifera subsp. trichocarpa; identical to SEQ ID NO: 1351
  misc_feature (1)..(1170): useful for making plants with increased salt and oxidative stress resistance as described in USSN 12/922,143
  misc_feature (1)..(1170): Ceres ANNOT ID no.1514366

SEQ ID NO: 4206 - protein, 389 aa, Populus balsamifera subsp. trichocarpa; identical to SEQ ID NO: 1352
  misc_feature (1)..(389): useful for making plants with increased salt and oxidative stress resistance as described in USSN 12/922,143
  misc_feature (1)..(389): Ceres ANNOT ID no.1514366
  misc_feature (1)..(389): Bit score of 285.4 for HMM based on sequences of FIGURE 9 of USSN 12/922,143.
  misc_feature (122)..(251): Pfam Name: Cyclin_N Pfam Description: Cyclin, N-terminal domain
  misc_feature (253)..(370): Pfam Name: Cyclin_C Pfam Description: Cyclin, C-terminal domain
  misc_feature (1)..(389): Functional Homolog Of Ceres SEEDLINE ID no. ME08564

SEQ ID NO: 4207 - DNA, 1497 bp, Sorghum bicolor
  misc_feature (1)..(1497): useful for making plants with increased salt and oxidative stress resistance as described in USSN 12/922,143
  misc_feature (1)..(1497): Ceres ANNOT ID no.6016012
atgggtaagaaaggaaagtggtttagtgcggtgaagaaagtcttcagctcctctggtacagatggaaaggaagcaaaggctgagaaagcagacaagtcaaaatccaagaggagatggccattcggaaaaacgaagaagcactccgagccttcgatctcaacggtggcagggactgctccggtagctccgttgccatcaccaccaccaactcagccccactctctggagattaaagatgtcaatccacttgaaacagacagtgagcagaacaagcatgcctactctgttgcgcttgcatctgctgtcgctgctgaagctgcagcggttgctgcccaggctgctgcggaggttgtccgcctcacagcagttaccacggctgcaccaaaaatgcctgttagttcaatggaagaacttgctgccaccaagattcagactgccttcaggggttatctggcaaggagagcattgcgggcactaagagggctagttagattgaagtcgcttgttgatggaaatgctgtcaaacgccaaaccgctcacaccttgcaatgcacacaaacaatgacaagagttcaaactcaaatctattctagaagggtgaagttggaggaggagaaacaggctcttcaaaggcagctccaattgaaacatcaaagagaacttgagaaaatgaagattgatgaagactgggatcacagccatcaatccaaagagcaaattgaggccaaccttatgatgaaacaggaagctgcaatgagacgagaaagagcccttgcatatgcattttctcaccagtggaggacttctggtcgaactataacccctacttttacggaacctgggaaccctaactggggctggagctggatggaacgctggatgaccgctagaccttgggagagccgattggtggcatcagacaaggatcctaaagaacgtgctctgacaaagaatccaagcaccattactgttcaagccgcatctgtaccccgtgccatctcaatccagagaccagctacaccaaacaagtcaagccggccaccaagccggcagtcaccttcaactccaccatcgaaggccccatcaacctcaggaaagaccaggccagcaagtccaaggggcaattggctgtacaaggaggatgacctgaggagcatcacaagcatccgctctgagcgcccaaggaggcagagcacaggtggaggaggctcagtccgggatgatgcaagcctgacgagcacaccacctctccccagttacatgcaatcgacagagtctgcaagggcgaagtctcgataccgcagtctactgactgagaagcttgaggttcctgagagagcacctttggtccactctgttgttaagaagcgcctgtcgttccctgtcgtcgataagccaagtgttgtgccgacagataagccaaaggaaagagtgagacgccattcagatcctccgaaggtcgatcctgcaacactgaaggatgtccctgctgcttga

SEQ ID NO: 4208 - protein, 473 aa, Sorghum bicolor
  misc_feature (1)..(473): useful for making plants with increased salt and oxidative stress resistance as described in USSN 12/922,143
  misc_feature (1)..(473): Ceres ANNOT ID no.6054472
  misc_feature (1)..(473): Bit score of 1104.8 for HMM based on sequences of FIGURE 16 of USSN 12/922,143.
  misc_feature (107)..(127): Pfam Name: IQ Pfam Description: IQ calmodulin-binding motif
  misc_feature (1)..(473): Functional Homolog Of Ceres SEEDLINE ID no. ME24091
MGKKGKWFGAVKKVFSPESKEKKEERLRRKSAASNPAPLDLTPSTSLEVNVSVPPPPAPAPPPVLHQAEEVRVPEPEQEQSKHVTVEEPPAVPAQPSVLPPGVPTEELAAVKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNFDRGSVKSMSLNLGEGEITKAFNRRDSKPEKPSPPTPKPTRPAWQSPSTPSAKVAPIPARRKSATPKNGLSQVDDDARSVLSVQSERPRRHSIATSTVRDDESLASSPSLPSYMVPTESARAKSRLQGSSMTNGAETPEKGGSTGPVKKRLSFQGGTAAASPMRRHSGPPKVESAVKDIVAPPQPEALVVNGGSK

SEQ ID NO: 4209 - protein, 469 aa, Glycine max
  misc_feature (1)..(469): useful for making plants with increased salt and oxidative stress resistance as described in USSN 12/922,143
  misc_feature (1)..(469): Public GI ID no.857395
  misc_feature (1)..(469): Bit score of 1007.6 for HMM based on sequences of FIGURE 9 of USSN 12/922,143.
  misc_feature (207)..(334): Pfam Name: Cyclin_N Pfam Description: Cyclin, N-terminal domain
  misc_feature (336)..(463): Pfam Name: Cyclin_C Pfam Description: Cyclin, C-terminal domain
  misc_feature (1)..(469): Functional Homolog Of Ceres SEEDLINE ID no. ME08564
MDKVNRVCAKDEERPLRITRARARALRGITPYSRPSLKNEQKNVLRANSKRAASSGNKTFAVVPAVVQQKGRAVLSDISNMCAKPHDKCTKASKFQAKGVCTKKNTKLAASSVSTDVSSSHDDVRAKLAEELSTIKMVESNDTLREGVTADTSLSMQNSVKSDELRNSPNKDIDIICEKLGASDSLTIVDIDSELKDPQLWSFYAPDIYSNIRVTELQRKPLTNYMDKLQKDINPSMRGILVDWLVEVSEEYKLVPDTLYLTVNLIDRYLSTRLIQKQKLQLLGVTCMLIASKYEEMCAPRVEEFCFITDNTYTKEEVLKMEREVLNLVHFQLSVPTIKTFLRRFIQAAQSSYKAPYVELEFLANYLAELALVECSFFQFLPSLIAASAVFLAKWTLNESEHPWNPTLEHYTKYKASDLKTVVLALQDLQLNTKGCFLNAVREKYKQQKFNCVANLSPKSVQSLFQNQV

SEQ ID NO: 4210 - DNA, 1329 bp, Glycine max
  misc_feature (1)..(1329): useful for making plants with increased salt and oxidative stress resistance as described in USSN 12/922,143
  misc_feature (1)..(1329): Ceres CLONE ID no.533924
atcaaaatttcaggccaaaggagtttgtacaaagaaaaacaccaagcttgcagcctcaagtgtttccactgacgtttcatcctcacatgacgatgttagagcaaagttagctgaagaattatccacaataaagatggttgaatcaaatgacaccttaagagaaggtgtaacagcagacacctcactttcaatgcaaaactctgtgaaatctgatgaactccggaactctccaaacaaagacatagatataatttgtgagaagctgggagcctcagactccctgactattgtggacattgattcagagttaaaggatcctcaactgtggagtttttatgcccctgacatatacagcaatattcgagtcacagagcttcaaaggaaaccattgaccaactacatggacaagttgcagaaagatattaatccaagcatgcgtggaattctggttgattggcttgtggaggtttctgaggaatacaagttggttccagacactctttacctgaccgtgaacctcattgatcggtatctctcaacaagactcattcagaagcaaaagctccagttgctcggtgttacttgcatgttgattgcatcaaaatatgaagagatgtgtgcacctcgagtggaggaattttgcttcatcacagataatacatacacaaaagaagaggtattgaaaatggagagagaagtactgaatcttgtgcattttcagttatctgtccccacaatcaaaacttttctcaggagattcatccaagcagcacaatcttcttacaaggctccttatgttgaactggaattcctggcaaattatttagcagagcttgctcttgttgaatgcagcttcttccagtttctaccttcccttatagctgcatctgctgtgttccttgccaaatggaccctgaatgagtcagaacatccatggaatccaactctggagcactatacaaaatacaaagcttcagacctcaaaactgttgttcttgcactgcaagatctgcaacttaataccaaaggatgcttcctgaatgctgtccgcgagaagtataagcaacagaagttcaattgtgtggcaaacttgtctccaaaatcgttgcagtcactcttccagaaccaagtgtctctttgttttgcaaagggaaaactgttgcgggatgatacagttcaaagagtgagttgatgtactaacaccaattagagactcattttaaggttctcattaagcaacaaagtcgtatagttcctttcaacattttgtaccgaaacatttgtatgtaattcaaattacattacctacaatttatttttcatttctag

SEQ ID NO: 4211 - protein, 352 aa, Glycine max
  misc_feature (1)..(352): useful for making plants with increased salt and oxidative stress resistance as described in USSN 12/922,143
  misc_feature (1)..(352): Ceres CLONE ID no.533924
  misc_feature (1)..(352): Bit score of 715.8 for HMM based on sequences of FIGURE 9 of USSN 12/922,143.
  misc_feature (200)..(327): Pfam Name: Cyclin_C Pfam Description: Cyclin, C-terminal domain
  misc_feature (71)..(198): Pfam Name: Cyclin_N Pfam Description: Cyclin, N-terminal domain
  misc_feature (1)..(352): Functional Homolog Of Ceres SEEDLINE ID no. ME08564
MVESNDTLREGVTADTSLSMQNSVKSDELRNSPNKDIDIICEKLGASDSLTIVDIDSELKDPQLWSFYAPDIYSNIRVTELQRKPLTNYMDKLQKDINPSMRGILVDWLVEVSEEYKLVPDTLYLTVNLIDRYLSTRLIQKQKLQLLGVTCMLIASKYEEMCAPRVEEFCFITDNTYTKEEVLKMEREVLNLVHFQLSVPTIKTFLRRFIQAAQSSYKAPYVELEFLANYLAELALVECSFFQFLPSLIAASAVFLAKWTLNESEHPWNPTLEHYTKYKASDLKTVVLALQDLQLNTKGCFLNAVREKYKQQKFNCVANLSPKSLQSLFQNQVSLCFAKGKLLRDDTVQRVS

SEQ ID NO: 4212 - DNA, 1856 bp, Gossypium hirsutum
  misc_feature (1)..(1856): useful for making plants with increased salt and oxidative stress resistance as described in USSN 12/922,143
  misc_feature (1)..(1856): Ceres CLONE ID no.1928887
gtgagcttagggagctgatacaaacaaagtgagaatttttttttaaagttcctctctcgacctatccgaacctcttcgttttcgatctcggagttcgtcgaagcacaaaatgcaggttcaatgacaaacttttcaatttgaaaatcatacatcgctctgggaaaaggcaagcaagtatgaataaagaaaatgaacctaccgaagaagttgaagagcctacaggaagaattacgcgagcaaggtataaagccttgcgggcggctggaggaatatgctcctcctcaaaaccatctttcaaacaggaacagaaacgtgttcttcgattgaactccaaaagagcagcatcagatgagaacaaggcttctgtgcctgctactgttggccttcagcctaaaagaagggcagtgcttaaaaatgtaaccaatgtcggcgatgacactttgtacatggactgcacaaatgcaactaaaaatcggatcaccaagcagaccattacagaccataatgagaagaacacagaaatgtttgaggatattgccatggaaatcccatcagctgaagaggatgtgaaagctaaattagctgattccttatcgaaaataaggatggtggaaacgcaagaaatcactttaccagtaataccggaggaaagagaattactggaatctaagtgttgtgcaaaagaacgtgctactgcagatgcaatgcctccaaaacatatttccgcaatggatgttgaagagcaaagccatcagaaaatagatcaaaacgaggcttgcaagaaactaggagcctcgaaagatgtcgtggatattgattccaacctaaaagatcctcaagcatgtggcttgtatgccccagacatatacaataacatgcgtgttactgagcttaaccaaagaccctcaacaaattatatggaacagttgcagcgggatattaccccaagcatgcgaggaattttggttgactggttagttgaggtttctgaagaatataagttagtcccagacacgctttacctcaccgtgagcctcattgatcgttttctttctcacaattttatagaaaaacaaaggctccagctacttggcgttgcttgcatgctaattgcctcaaagtatgaagagatttgtgcaccaagagtggaagaattttgcttcatcactgataatacctacacaagagaagaggtgctgaaaatggagagcaaagttctaaacttcttgtattttcagttgtcagttccaaccacaaaaacatttctcaggagattcattcaagcagcacaagcaagttacaaggttccttgtttagaactagagttcttagccaagtatttagcagagttgactcttcttgagtacagcttcttaaagttcttaccttcaaacatcgctgcatctgctgttttccttgccagatggactctcaatcaatcagaccatccatggaacccaaccctggagcattacactagttataaagcatcagagctgaaaaatacggttcttgcattggaagatctgcagctcaacactaatggttgctccctgaatgctatacgcgagaagtataggcaacagaagttcaaatgtgtagcaatgatgacttccccggaaagtgttggatcagtctttttaagatgaagaagaaagctgatttaatgttctaaaccattccccctcttggagaatgaatctgatccaaatatttaaaaatattactttttttttttaagttgtccgttttgttgtaacattttgtctgtcaagttctggtgcttccagacctactgtaaccttgtaacattctacaccatcgatctttattttcttttgtcttttagagctttc

SEQ ID NO: 4213 - protein, 490 aa, Gossypium hirsutum
  misc_feature (1)..(490): useful for making plants with increased salt and oxidative stress resistance as described in USSN 12/922,143
  misc_feature (1)..(490): Ceres CLONE ID no.1928887
  misc_feature (1)..(490): Bit score of 1309.4 for HMM based on sequences of FIGURE 9 of USSN 12/922,143.
  misc_feature (229)..(356): Pfam Name: Cyclin_N Pfam Description: Cyclin, N-terminal domain
  misc_feature (358)..(485): Pfam Name: Cyclin_C Pfam Description: Cyclin, C-terminal domain
  misc_feature (1)..(490): Functional Homolog Of Ceres SEEDLINE ID no. ME08564
MNKENEPTEEVEEPTGRITRARYKALRAAGGICSSSKPSFKQEQKRVLRLNSKRAASDENKASVPATVGLQPKRRAVLKNVTNVGDDTLYMDCTNATKNRITKQTITDHNEKNTEMFEDIAMEIPSAEEDVKAKLADSLSKIRMVETQEITLPVIPEERELLESKCCAKERATADAMPPKHISAMDVEEQSHQKIDQNEACKKLGASKDVVDIDSNLKDPQACGLYAPDIYNNMRVTELNQRPSTNYMEQLQRDITPSMRGILVDWLVEVSEEYKLVPDTLYLTVSLIDRFLSHNFIEKQRLQLLGVACMLIASKYEEICAPRVEEFCFITDNTYTREEVLKMESKVLNFLYFQLSVPTTKTFLRRFIQAAQASYKVPCLELEFLAKYLAELTLLEYSFLKFLPSNIAASAVFLARWTLNQSDHPWNPTLEHYTSYKASELKNTVLALEDLQLNTNGCSLNAIREKYRQQKFKCVAMMTSPESVGSVFLR

SEQ ID NO: 4214 - DNA, 1647 bp, Populus balsamifera subsp. trichocarpa
  misc_feature (1)..(1647): useful for making plants with increased salt and oxidative stress resistance as described in USSN 12/922,143
  misc_feature (1)..(1647): Ceres ANNOT ID no.1531064
atgaataaagaaaatgcaactgctgccaaacatgaagagcccactactcgaattacacgggcacgtgctaaagcttcggggacttcagtaggattatttcctgcctcaaaaccctcctttaaacaggatcaaaagcatcctcttagagaaaagaccaaaagagcagcatcagatgagaacaaatcttgttcaacctcagttgctggtcttaagcataagagaagggcagtgcttaaagatgtgaccaacgtcctttgtgagaattctcatctgaactgcaacattgcaacaaaacaacatactagcaaacaagctagaaaatgtcctcgaaataagaatgcagaggtggctgctcatatctccatggaaatttcaccggctcaggaggatgtaaaagaaatgttagctgaagagctgtcaaaaataagaatgggggaagcacaagattttacttcaccagcaaagttagaaggaaaaaaacaaagcgattgtcatggcacaagagaaggtggtgtagcagatccaaggcttctagtacctctttccacaaaaacttccggagttgaaaggcctctaaagaaagaagaaagtgaaatttctgagaaactggatgcctcagttggcgtgagcgtagtggatattgattcaaacataaaagaccttcaactctgcagcttgtacgcccctgatatatttaacaatatacgtgctaaggagcttgaccaaaggccttcgattgattacatggagaagttgcagcatgatattagtcctagcatgcgaggaattctgatcgactggcttgtggaggtttctgaagaatatacattggttccagatacactttacctcactgtcaatctcattgatcgattcctctcacagaactatattgaaaaacaaagactccaactgcttggtgttacttgcatgttgattgcctctaagtatgaagaaatttgtgcgccaagagtggaagagttttgcttcatcactgacaatacttacacaagaggagaggttctgaagatggagagtcaagtcctgaatttcttgcactttcatttatcagttcccaccacgaaatcatttctgaggagattcattcaagcagcccaagcttcctgcaaggtcccttgtgtcgagctggagttcttggcaaattatctagcagagttgactcttgttgagtacaacttcctaaagttattaccttccctcatagccgcatctgttgtttttcttgcccgatggacactcaatcaatcagaccacccatggaactcaacactagagcactacactagttacacaacatcagaactgaaaactacagtgcttgccctggaagatttgcagctgaacactgatggttgttgcctaaatgctatacgggacaaatatagacaacagaaggtaaagaactcgtactatttggagagactgtatgcaagcttctgggcttcacatttcccttttatgtcattctcacaaatggttgtcgttgtggcagttcaaatccgtagcaactttgacctccgtacaacgagtttcatcgcttttctgaggacgaaggaaaacgggtcctgcattaacaagcaaaccgctccctctgagggtgatatcgactctaatcatagaatttaa

SEQ ID NO: 4215 - protein, 548 aa, Populus balsamifera subsp. trichocarpa
  misc_feature (1)..(548): useful for making plants with increased salt and oxidative stress resistance as described in USSN 12/922,143
  misc_feature (1)..(548): Ceres ANNOT ID no.1531064
  misc_feature (1)..(548): Bit score of 1162.7 for HMM based on sequences of FIGURE 9 of USSN 12/922,143.
  misc_feature (230)..(357): Pfam Name: Cyclin_N Pfam Description: Cyclin, N-terminal domain
  misc_feature (359)..(486): Pfam Name: Cyclin_C Pfam Description: Cyclin, C-terminal domain
  misc_feature (1)..(548): Functional Homolog Of Ceres SEEDLINE ID no. ME08564
MNKENATAAKHEEPTTRITRARAKASGTSVGLFPASKPSFKQDQKHPLREKTKRAASDENKSCSTSVAGLKHKRRAVLKDVTNVLCENSHLNCNIATKQHTSKQARKCPRNKNAEVAAHISMEISPAQEDVKEMLAEELSKIRMGEAQDFTSPAKLEGKKQSDCHGTREGGVADPRLLVPLSTKTSGVERPLKKEESEISEKLDASVGVSVVDIDSNIKDLQLCSLYAPDIFNNIRAKELDQRPSIDYMEKLQHDISPSMRGILIDWLVEVSEEYTLVPDTLYLTVNLIDRFLSQNYIEKQRLQLLGVTCMLIASKYEEICAPRVEEFCFITDNTYTRGEVLKMESQVLNFLHFHLSVPTTKSFLRRFIQAAQASCKVPCVELEFLANYLAELTLVEYNFLKLLPSLIAASVVFLARWTLNQSDHPWNSTLEHYTSYTTSELKTTVLALEDLQLNTDGCCLNAIRDKYRQQKVKNSYYLERLYASFWASHFPFMSFSQMVVVVAVQIRSNFDLRTTSFIAFLRTKENGSCINKQTAPSEGDIDSNHRI

SEQ ID NO: 4216 - DNA, 1596 bp, Populus balsamifera subsp. trichocarpa
  misc_feature (1)..(1596): useful for making plants with increased salt and oxidative stress resistance as described in USSN 12/922,143
  misc_feature (1)..(1596): Ceres ANNOT ID no.1455474
atgaacaaagaaaatgcaactactgccaaacttgaagagcccgctactcgaattacacgggcacgtgctaaagccttgggggcttcggtaggaatatatcctgcctcaaaaccctccttcaagcaggagcagaggcatcctcttagagcaaagaccaaaagagcagcatcagatgagaataaatctgcttcgacctcgattgctggctttaagcataagagaagggcggtgcttaaagatgtgagcaacatcttttgtgagaattctcatcaaaactgcatccatgcaactaaacaatatactagtaaactagctagaaaatgtcctccgaaaacaaatgcagaggtggctgctcgtatctctatgaaaatttcaccggttcaggaggatgtaaaagaaaagttagctgaagagctgtcaaaaataagaatgggagaagcacaaaattttacttcaccagcaaagttagaggtaaaacaagatagtttgtgtcatggcacaggagaaggtggtgtagcagatccgatgcttctaataccagtttccacaaaattttctggagttgaaagccctctaaagaaagaagtaaacgagatttcaaaaaaactggatgcctcaagtggtgcgagcgtagtggatattgatttaaacataaaagaccctcagttctgcagcttgtatgcccctcatatatataacaatatacgtgtgaaggagcttgacctaagaccttcagttgattacatggaaaagttgcagcgcgatatcagtccaggaatgcgaggaattctgattgactggcttgtggaggtttctgaagaatatacgttggttccagatactctttacctcactgtcaatctcattgatcgattcctctcacagaactatattgaaaaacaaagactccaactgcttggtgttacttgcatgttaattgcctctaagtatgaagaaattattccgccaagagtggaagggttttgcttcatcactgacaatacttacacaagaggagaggttctgaaaatggagagtcaggtcctgaatttcttgtactttcagttatcagttcctaccacgaaaacattcctgaggagattcattcaagcagcacaagcttcttgcaaggttccttgtgtcgaactggtgttcttggcaaattatttggcagagttgactcttgttgagtacaacttcctaaagttcttaccttccctcatagctgcatccgctgtttttcttgcccgatggacactcaatcagtcagatcatccatggaactcaactcttgagcactacactagatacacagcatcagaactgaaaactacagtactttctctggaagatttgcagctgaacaccaatggttgttgcctaaatgctatacgcgacaaatatagacaacagaagttcgtgtcattctcacaattggttatcattgtgacagttcaaatctgtagcaacattgacctcagtgcgacgagtttcatcgcttttctgaagacgaagaaaaactggtcctgcattaacaagcacagcactctgattcgacactttgagggtgatatcgattctaatcatagagtttaa

SEQ ID NO: 4217 - protein, 531 aa, Populus balsamifera subsp. trichocarpa
  misc_feature (1)..(531): useful for making plants with increased salt and oxidative stress resistance as described in USSN 12/922,143
  misc_feature (1)..(531): Ceres ANNOT ID no.1455474
  misc_feature (1)..(531): Bit score of 1286.7 for HMM based on sequences of FIGURE 9 of USSN 12/922,143.
  misc_feature (230)..(357): Pfam Name: Cyclin_N Pfam Description: Cyclin, N-terminal domain
  misc_feature (359)..(486): Pfam Name: Cyclin_C Pfam Description: Cyclin, C-terminal domain
  misc_feature (1)..(531): Functional Homolog Of Ceres SEEDLINE ID no. ME08564
MNKENATTAKLEEPATRITRARAKALGASVGIYPASKPSFKQEQRHPLRAKTKRAASDENKSASTSIAGFKHKRRAVLKDVSNIFCENSHQNCIHATKQYTSKLARKCPPKTNAEVAARISMKISPVQEDVKEKLAEELSKIRMGEAQNFTSPAKLEVKQDSLCHGTGEGGVADPMLLIPVSTKFSGVESPLKKEVNEISKKLDASSGASVVDIDLNIKDPQFCSLYAPHIYNNIRVKELDLRPSVDYMEKLQRDISPGMRGILIDWLVEVSEEYTLVPDTLYLTVNLIDRFLSQNYIEKQRLQLLGVTCMLIASKYEEIIPPRVEGFCFITDNTYTRGEVLKMESQVLNFLYFQLSVPTTKTFLRRFIQAAQASCKVPCVELVFLANYLAELTLVEYNFLKFLPSLIAASAVFLARWTLNQSDHPWNSTLEHYTRYTASELKTTVLSLEDLQLNTNGCCLNAIRDKYRQQKFVSFSQLVIIVTVQICSNIDLSATSFIAFLKTKKNWSCINKHSTLIRHFEGDIDSNHRV

SEQ ID NO: 4218 - protein, 493 aa, Nicotiana tabacum
  misc_feature (1)..(493): useful for making plants with increased salt and oxidative stress resistance as described in USSN 12/922,143
  misc_feature (1)..(493): Public GI ID no.849072
  misc_feature (1)..(493): Bit score of 1246.9 for HMM based on sequences of FIGURE 9 of USSN 12/922,143.
  misc_feature (234)..(361): Pfam Name: Cyclin_N Pfam Description: Cyclin, N-terminal domain
  misc_feature (363)..(490): Pfam Name: Cyclin_C Pfam Description: Cyclin, C-terminal domain
  misc_feature (1)..(493): Functional Homolog Of Ceres SEEDLINE ID no. ME08564
MRHANIKHGSFHLEEHNMRITRARARVSGSSGRLPPLHPSTKQDKKQALGAESKRSKRSASDENRPGTSSIATGVQPKRRAVLKDMKNVLHENSHMNCINGSKIQVKKGSDKRNNKAKPAVSLKLSQLQEKGKEDIADKVKKVKVEGSQEISSGANCKEDMLPQLSRDVTPAQCGLVHLVPVNRSSCKAFPLQNVMKKDESKVCQKQEGFANLGIADIDSRHKDPLMCSLYAPDIYNNLHAIEFDRSPSVDYLEKLQLDINKGMRGILIDWLVEVSEEYRLVPDTLYLTVNLIDRFLSENYIEKQKLQLLGVTCMLIASKFEEICAPRVEEFCFITDNTYSKEEVIKMESRVLNLLSFQLASPTTKKFLRRFIQAAQASYKVPSVELEFMANYLAELTLVDYGFLKFLPSLTAASAVFLARWTLDQSNHPWNPTLEHYTRYKVSELRTTVFALQELQMNTSGCTLNAIREKYRQPKFKSVATLAASKPVQSLF

SEQ ID NO: 4219 - DNA, 1716 bp, Populus balsamifera subsp. trichocarpa
  misc_feature (1)..(1716): useful for making plants with increased salt and oxidative stress resistance as described in USSN 12/922,143
  misc_feature (1)..(1716): Ceres ANNOT ID no.1477575
atgaataaagaaaatgcaactgctgccaaacatgaagagcccactactcgaattacacgggcacgtgctaaagcttcggggacttcagtaggattatttcctgcctcaaaaccctcctttaaacaggatcaaaagcatcctcttagagaaaagaccaaaagagcagcatcagatgagaacaaatcttgttcaacctcagttgctggtcttaagcataagagaagggcagtgcttaaagatgtgaccaacgtcctttgtgagaattctcatctgaactgcaacattgcaacaaaacaacatactagcaaacaagctagaaaatgtcctcgaaataagaatgcagaggtggctgctcatatctccatggaaatttcaccggctcaggaggatgtaaaagaaatgttagctgaagagctgtcaaaaataagaatgggggaagcacaagattttacttcaccagcaaagttagaaggaaaaaaacaaagcgattgtcatggcacaagagaaggtggtgtagcagatccaaggcttctagtacctctttccacaaaaacttccggagttgaaaggcctctaaagaaagaagaaagtgaaatttctgagaaactggatgcctcagttggcgtgagcgtagtggatattgattcaaacataaaagaccttcaactctgcagcttgtacgcccctgatatatttaacaatatacgtgctaaggagcttgaccaaaggccttcgattgattacatggagaagttgcagcatgatattagtcctagcatgcgaggaattctgatcgactggcttgtggagatgttgaacgggtatgagattgataatctatatgcactctttcaggtttctgaagaatatacattggttccagatacactttacctcactgtcaatctcattgatcgattcctctcacagaactatattgaaaaacaaagactccaactgcttggtgttacttgcatgttgattgcctctaagtatgaagaaatttgtgcgccaagagtggaagagttttgcttcatcactgacaatacttacacaagaggagaggcttctaacacgatactatggcaggttctgaagatggagagtcaagtcctgaatttcttgcactttcatttatcagttcccaccacgaaatcatttctgaggagattcattcaagcagcccaagcttcctgcaaggtcccttgtgtcgagctggagttcttggcaaattatctagcagagttgactcttgttgagtacaacttcctaaagttattaccttccctcatagccgcatctgttgtttttcttgcccgatggacactcaatcaatcagaccacccatggaactcaacactagagcactacactagttacacaacatcagaactgaaaactacagtgcttgccctggaagatttgcagctgaacactgatggttgttgcctaaatgctatacgggacaaatatagacaacagaaggtaaagaactcgtactatttggagagactgtatgcaagcttctgggcttcacatttcccttttatgtcattctcacaaatggttgtcgttgtggcagttcaaatccgtagcaactttgacctccgtacaacgagtttcatcgcttttctgaggacgaaggaaaacgggtcctgcattaacaagcaaaccgctccctctgagggtgatatcgactctaatcatagaatttaa

SEQ ID NO: 4220 - protein, 571 aa, Populus balsamifera subsp. trichocarpa
  misc_feature (1)..(571): useful for making plants with increased salt and oxidative stress resistance as described in USSN 12/922,143
  misc_feature (1)..(571): Ceres ANNOT ID no.1477575
  misc_feature (1)..(571): Bit score of 1118.6 for HMM based on sequences of FIGURE 9 of USSN 12/922,143.
  misc_feature (230)..(380): Pfam Name: Cyclin_N Pfam Description: Cyclin, N-terminal domain
  misc_feature (382)..(509): Pfam Name: Cyclin_C Pfam Description: Cyclin, C-terminal domain
  misc_feature (1)..(571): Functional Homolog Of Ceres SEEDLINE ID no. ME08564
MNKENATAAKHEEPTTRITRARAKASGTSVGLFPASKPSFKQDQKHPLREKTKRAASDENKSCSTSVAGLKHKRRAVLKDVTNVLCENSHLNCNIATKQHTSKQARKCPRNKNAEVAAHISMEISPAQEDVKEMLAEELSKIRMGEAQDFTSPAKLEGKKQSDCHGTREGGVADPRLLVPLSTKTSGVERPLKKEESEISEKLDASVGVSVVDIDSNIKDLQLCSLYAPDIFNNIRAKELDQRPSIDYMEKLQHDISPSMRGILIDWLVEMLNGYEIDNLYALFQVSEEYTLVPDTLYLTVNLIDRFLSQNYIEKQRLQLLGVTCMLIASKYEEICAPRVEEFCFITDNTYTRGEASNTILWQVLKMESQVLNFLHFHLSVPTTKSFLRRFIQAAQASCKVPCVELEFLANYLAELTLVEYNFLKLLPSLIAASVVFLARWTLNQSDHPWNSTLEHYTSYTTSELKTTVLALEDLQLNTDGCCLNAIRDKYRQQKVKNSYYLERLYASFWASHFPFMSFSQMVVVVAVQIRSNFDLRTTSFIAFLRTKENGSCINKQTAPSEGDIDSNHRI

SEQ ID NO: 4221 - DNA, 1554 bp, Populus balsamifera subsp. trichocarpa
  misc_feature (1)..(1554): useful for making plants with increased salt and oxidative stress resistance as described in USSN 12/922,143
  misc_feature (1)..(1554): Ceres ANNOT ID no.1508676
atgaacaaagaaaatgcaactactgccaaacttgaagagcccgctactcgaattacacgggcacgtgctaaagccttgggggcttcggtaggaatatatcctgcctcaaaaccctccttcaagcaggagcagaggcatcctcttagagcaaagaccaaaagagcagcatcagatgagaataaatctgcttcgacctcgattgctggctttaagcataagagaagggcggtgcttaaagatgtgagcaacatcttttgtgagaattctcatcaaaactgcatccatgcaactaaacaatatactagtaaactagctagaaaatgtcctccgaaaacaaatgcagaggtggctgctcgtatctctatgaaaatttcaccggttcaggaggatgtaaaagaaaagttagctgaagagctgtcaaaaataagaatgggagaagcacaaaattttacttcaccagcaaagttagaggtaaaacaagatagtttgtgtcatggcacaggagaaggtggtgtagcagatccgatgcttctaataccagtttccacaaaattttctggagttgaaagccctctaaagaaagaagtaaacgagatttcaaaaaaactggatgcctcaagtggtgcgagcgtagtggatattgatttaaacataaaagaccctcagttctgcagcttgtatgcccctcatatatataacaatatacgtgtgaaggagcgcgatatcagtccaggaatgcgaggaattctgattgactggcttgtggaggtttctgaagaatatacgttggttccagatactctttacctcactgtcaatctcattgatcgattcctctcacagaactatattgaaaaacaaagactccaactgcttggtgttacttgcatgttaattgcctctaagtatgaagaaattattccgccaagagtggaagggttttgcttcatcactgacaatacttacacaagaggagaggttctgaaaatggagagtcaggtcctgaatttcttgtactttcagttatcagttcctaccacgaaaacattcctgaggagattcattcaagcagcacaagcttcttgcaaggttccttgtgtcgaactggtgttcttggcaaattatttggcagagttgactcttgttgagtacaacttcctaaagttcttaccttccctcatagctgcatccgctgtttttcttgcccgatggacactcaatcagtcagatcatccatggaactcaactcttgagcactacactagatacacagcatcagaactgaaaactacagtactttctctggaagatttgcagctgaacaccaatggttgttgcctaaatgctatacgcgacaaatatagacaacagaagttcgtgtcattctcacaattggttatcattgtgacagttcaaatctgtagcaacattgacctcagtgcgacgagtttcatcgcttttctgaagacgaagaaaaactggtcctgcattaacaagcacagcactctgattcgacactttgagggtgatatcgattctaatcatagagtttaa

SEQ ID NO: 4222 - protein, 517 aa, Populus balsamifera subsp. trichocarpa
  misc_feature (1)..(517): useful for making plants with increased salt and oxidative stress resistance as described in USSN 12/922,143
  misc_feature (1)..(517): Ceres ANNOT ID no.1508676
  misc_feature (1)..(517): Bit score of 1219.9 for HMM based on sequences of FIGURE 9 of USSN 12/922,143.
  misc_feature (240)..(343): Pfam Name: Cyclin_N Pfam Description: Cyclin, N-terminal domain
  misc_feature (345)..(472): Pfam Name: Cyclin_C Pfam Description: Cyclin, C-terminal domain
  misc_feature (1)..(517): Functional Homolog Of Ceres SEEDLINE ID no. ME08564
MNKENATTAKLEEPATRITRARAKALGASVGIYPASKPSFKQEQRHPLRAKTKRAASDENKSASTSIAGFKHKRRAVLKDVSNIFCENSHQNCIHATKQYTSKLARKCPPKTNAEVAARISMKISPVQEDVKEKLAEELSKIRMGEAQNFTSPAKLEVKQDSLCHGTGEGGVADPMLLIPVSTKFSGVESPLKKEVNEISKKLDASSGASVVDIDLNIKDPQFCSLYAPHIYNNIRVKERDISPGMRGILIDWLVEVSEEYTLVPDTLYLTVNLIDRFLSQNYIEKQRLQLLGVTCMLIASKYEEIIPPRVEGFCFITDNTYTRGEVLKMESQVLNFLYFQLSVPTTKTFLRRFIQAAQASCKVPCVELVFLANYLAELTLVEYNFLKFLPSLIAASAVFLARWTLNQSDHPWNSTLEHYTRYTASELKTTVLSLEDLQLNTNGCCLNAIRDKYRQQKFVSFSQLVIIVTVQICSNIDLSATSFIAFLKTKKNWSCINKHSTLIRHFEGDIDSNHRV

SEQ ID NO: 4223 - protein, 475 aa, Solanum lycopersicum
  misc_feature (1)..(475): useful for making plants with increased salt and oxidative stress resistance as described in USSN 12/922,143
  misc_feature (1)..(475): Public GI ID no.5420276
  misc_feature (1)..(475): Bit score of 1028.2 for HMM based on sequences of FIGURE 9 of USSN 12/922,143.
  misc_feature (216)..(343): Pfam Name: Cyclin_N Pfam Description: Cyclin, N-terminal domain
  misc_feature (345)..(472): Pfam Name: Cyclin_C Pfam Description: Cyclin, C-terminal domain
  misc_feature (1)..(475): Functional Homolog Of Ceres SEEDLINE ID no. ME08564
MRITRARAKTLGSSGGLPPLHPSVRQDKKQGLVTQGTKSKRPAPDENKPANSSSTASQQPKRRAVLRDVTNVLCENPYMNCINGSKFQVKKFSDKRNSKVTPALLVKKPELEDRKESVIEEAKMVKVEESQEHCSQAHFKDHPFTQPSEYITAAQSGLVDLMPVNRSSCNDITLQTTTPKDESKVCLKQEGSNSLSIADIDSKHKDPLMCSLYAPDIYNNLQAMELDRRPSFNYMEKLQRDINKGMRSILIDWLVEVSEEYRLVPDTLYLTVHLIDRFLSEHYIEKQKLQLLGVTCMLIASKYEEICAPRVEEFCFITDNTYSKEEVVRMESLVLNFLGFQLAAPTTKKFLRRFVQASQASYEVPSVELEFMANYLAELTLAEYSFLKFLPSVTAASAVFLARWTLDQSNHPWNSTLEHYTTYKASDLKTTVLLLQDLQMNTSGSTLNAIREKYKQPKFKSVATLSSPKPVQSLF

SEQ ID NO: 4224 - protein, 436 aa, Arabidopsis thaliana
  misc_feature (1)..(436): useful for making plants with increased salt and oxidative stress resistance as described in USSN 12/922,143
  misc_feature (1)..(436): Public GI ID no.22326727
  misc_feature (1)..(436): Bit score of 1078.2 for HMM based on sequences of FIGURE 9 of USSN 12/922,143.
  misc_feature (175)..(302): Pfam Name: Cyclin_N Pfam Description: Cyclin, N-terminal domain
  misc_feature (304)..(431): Pfam Name: Cyclin_C Pfam Description: Cyclin, C-terminal domain
  misc_feature (1)..(436): Functional Homolog Of Ceres SEEDLINE ID no. ME08564
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 4225 - protein, 436 aa, Arabidopsis thaliana
  misc_feature (1)..(436): useful for making plants with increased salt and oxidative stress resistance as described in USSN 12/922,143
  misc_feature (1)..(436): Public GI ID no.784946
  misc_feature (1)..(436): Bit score of 1068.4 for HMM based on sequences of FIGURE 9 of USSN 12/922,143.
  misc_feature (175)..(302): Pfam Name: Cyclin_N Pfam Description: Cyclin, N-terminal domain
  misc_feature (304)..(431): Pfam Name: Cyclin_C Pfam Description: Cyclin, C-terminal domain
  misc_feature (1)..(436): Functional Homolog Of Ceres SEEDLINE ID no. ME08564
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRREVLSMEIQILNFVHFRLSVPTTKTFLRRFIKAAQASYKVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTLLFSR

SEQ ID NO: 4226 - protein, 443 aa, Arabidopsis thaliana
  misc_feature (1)..(443): useful for making plants with increased salt and oxidative stress resistance as described in USSN 12/922,143
  misc_feature (1)..(443): Public GI ID no.509425
  misc_feature (1)..(443): Bit score of 856.7 for HMM based on sequences of FIGURE 9 of USSN 12/922,143.
  misc_feature (182)..(309): Pfam Name: Cyclin_N Pfam Description: Cyclin, N-terminal domain
  misc_feature (311)..(438): Pfam Name: Cyclin_C Pfam Description: Cyclin, C-terminal domain
  misc_feature (1)..(443): Functional Homolog Of Ceres SEEDLINE ID no. ME08564
MHRASSKHTNAKKEAISTSKIRDNNVRVTRSRAKALGVSNSPSKPAFKHETKRVARPSNKRMASDNITVCNQKRRAVLKDVTNTLAESIISTEGNVRQACKRGGKETKQIEEDGLVDVDGEKSKLAEDLSKIRMVESLDASASKELVDCAEEDRSDVTDCVQIVDIDSGVQDPQFCSLYAASIYDSINVAELEQRPSTSYMVQLQRDIDPTMRGILIDWLVEVSEEYKLVSDTLYLTVNLIDRFMSHNYIEKRKLQLLGVTCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNKTLQHYTRYETSALKNAVLAMEDLQLNTSGSTLIAIRTKYNQQKFKRVATLTSPERVNTLFSR

SEQ ID NO: 4227 - protein, 490 aa, Oryza sativa subsp. japonica
  misc_feature (1)..(490): useful for making plants with increased salt and oxidative stress resistance as described in USSN 12/922,143
  misc_feature (1)..(490): Public GI ID no.115488682
  misc_feature (1)..(490): Bit score of 1241.8 for HMM based on sequences of FIGURE 9 of USSN 12/922,143.
  misc_feature (230)..(357): Pfam Name: Cyclin_N Pfam Description: Cyclin, N-terminal domain
  misc_feature (359)..(486): Pfam Name: Cyclin_C Pfam Description: Cyclin, C-terminal domain
  misc_feature (1)..(490): Functional Homolog Of Ceres SEEDLINE ID no. ME08564
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASELIRRPRSNYMEALQRDITKGMRGILIDWLVEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNVPSITLGYLANYLAELTLIDYSFLKFLPSVVAASAVFLARWTLDQSDIPWNHTLEHYTSYKSSDIQICVCALRELQHNTSNCPLNAIREKYRQQKFECVANLTSPELGQSLFS

SEQ ID NO: 4228 - protein, 437 aa, Arabidopsis thaliana
  misc_feature (1)..(437): useful for making plants with increased salt and oxidative stress resistance as described in USSN 12/922,143
  misc_feature (1)..(437): Public GI ID no.22327058
  misc_feature (1)..(437): Bit score of 851.2 for HMM based on sequences of FIGURE 9 of USSN 12/922,143.
  misc_feature (176)..(303): Pfam Name: Cyclin_N Pfam Description: Cyclin, N-terminal domain
  misc_feature (305)..(432): Pfam Name: Cyclin_C Pfam Description: Cyclin, C-terminal domain
  misc_feature (1)..(437): Functional Homolog Of Ceres SEEDLINE ID no. ME08564
MHRASSKHTNAKKEAISTSKIRDNNVRVTRSRAKALGVSNSPSKPAFKHETKRVARPSNKRMASDNITVCNQKRRAVLKDVTNTLAESIISTEGNVKACKRGGKETKQIEEDGLVDVDGEKSKLAEDLSKIRMVESLDASASKQKEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 4229 - protein, 434 aa, Arabidopsis thaliana
  misc_feature (1)..(434): useful for making plants with increased salt and oxidative stress resistance as described in USSN 12/922,143
  misc_feature (1)..(434): Public GI ID no.8953392
  misc_feature (1)..(434): Bit score of 998.1 for HMM based on sequences of FIGURE 9 of USSN 12/922,143.
  misc_feature (175)..(302): Pfam Name: Cyclin_N Pfam Description: Cyclin, N-terminal domain
  misc_feature (304)..(429): Pfam Name: Cyclin_C Pfam Description: Cyclin, C-terminal domain
  misc_feature (1)..(434): Functional Homolog Of Ceres SEEDLINE ID no. ME08564
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLSALFLIIILQVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 4230 - DNA, 1898 bp, Glycine max
  misc_feature (1)..(1898): useful for making plants with increased salt and oxidative stress resistance as described in USSN 12/922,143
  misc_feature (1)..(1898): Ceres CLONE ID no.527699
ggctcccaagaaaagaaaggctttcttacaaccctctctttctctctctctgtctgtgagctcctatctctcttcaatggaggtagtggagcttgcaagatagacccagaattcacacggcgcgattgtattttttcgtgctgttcagaataattgcagagatgaagaaagaaaacagtgttatgctgaaagctggggagctccctggtcgattgactcgtgctcgagctgctgctgctcttcgtgcatatggacagctaccccctttgaaagagagagcacagcaaaatcagaatcagttatccagagtcaattcaaaaagagcagtttctgataatacatgtgttcagcgtaaaaggaaggctgttcttcaggaagttactaatgtttgctgtgaaaatgcctacaaggcttgtctcaactcaactaatattcaggctaggaaaagcaagctggctaaggctggtcaaattaatgtgtccaaagtggctccttctgttactgtggagccacgacaatttcaagttgactccaaagcaaaggaaacagcattgcaatcagaagatactatgtgctcaattaatttggaaaacaatgaacttctacaactgaatgccaatgattgtagcaaggactttagattgcctgaaagtcagatgtctggaatatctgctcaccctttgatttctcagaagaaagacacgaaagataaccttccaaaacttttgactgcattgaaggattcagacatcactaatatagatgatgatgatcttgaagatcctcagtcgtgcagcctctatgctgctgatatctacgacaccattcgcgttgctgagcttgcgagaaggccttatccgaactttatggagacagtgcagcgagatattactcaaagcatgcgtggaatactggttgattggcttgtagaggtttctgaggaatacaaattggttacagacactctttacctcactgtgtatctcatagattggtttctgtccaaaaattacattgaaagacaaagacttcagctacttggcatcacctgcatgctaattgcctcgaagtacgaagaaatcaatgccccacgtattgaagatttctgcttcatcacagacaatacatacacgaaagctgaggtactaaaaatggagagtcaagtgttgaagtcgtctgaatatcaactgtatactcccactatacaaactttcctcaggaggtttcttcgggcagcacaagcttcatacaaggaccaaagccttgaattggagtgcctggccaattacctagctgaactaacactgatggactatggtttcttgaatttccttccctctattattgctgcatcagctgtatttcttgcaaggtggacactagatcagtcaaaccacccatggaatccaactcttcaacactatgcctgttacaaagcatcggatttgaaaaccacagttcttgcactacaagacctacagctgaatactgatggctgttctctaactgccgtccgcacgaaatacagacaagacaattttaaatgtgtagcggccttgtcttcaccaaaactgcttgaaactttgttctgaagacaaagatgattagcaaggcaatgcaagggactcctaactgataacaaagaaatcctcattcctaatctaatcttcccttcaacttccattcattaatccatgagatatcttctgtatgtacattacattctaagctgtctaatatgtacacaacaaatatattctgtttcagtatgtacattacatgctaagctgtctcagatagaactagaaccccaagatgacttgggtgttttgaacgtacatgtagtaatgattattgttgggttaacaaaatggcatatgttgaattgccttggactt

SEQ ID NO: 4231 - protein, 476 aa, Glycine max
  misc_feature (1)..(476): useful for making plants with increased salt and oxidative stress resistance as described in USSN 12/922,143
  misc_feature (1)..(476): Ceres CLONE ID no.527699
  misc_feature (1)..(476): Bit score of 937.5 for HMM based on sequences of FIGURE 9 of USSN 12/922,143.
  misc_feature (217)..(344): Pfam Name: Cyclin_N Pfam Description: Cyclin, N-terminal domain
  misc_feature (346)..(473): Pfam Name: Cyclin_C Pfam Description: Cyclin, C-terminal domain
  misc_feature (1)..(476): Functional Homolog Of Ceres SEEDLINE ID no. ME08564
MKKENSVMLKAGELPGRLTRARAAAALRAYGQLPPLKERAQQNQNQLSRVNSKRAVSDNTCVQRKRKAVLQEVTNVCCENAYKACLNSTNIQARKSKLAKAGQINVSKVAPSVTVEPRQFQVDSKAKETALQSEDTMCSINLENNELLQLNANDCSKDFRLPESQMSGISAHPLISQKKDTKDNLPKLLTALKDSDITNIDDDDLEDPQSCSLYAADIYDTIRVAELARRPYPNFMETVQRDITQSMRGILVDWLVEVSEEYKLVTDTLYLTVYLIDWFLSKNYIERQRLQLLGITCMLIASKYEEINAPRIEDFCFITDNTYTKAEVLKMESQVLKSSEYQLYTPTIQTFLRRFLRAAQASYKDQSLELECLANYLAELTLMDYGFLNFLPSIIAASAVFLARWTLDQSNHPWNPTLQHYACYKASDLKTTVLALQDLQLNTDGCSLTAVRTKYRQDNFKCVAALSSPKLLETLF

SEQ ID NO: 4232 - protein, 461 aa, Arabidopsis thaliana
  misc_feature (1)..(461): useful for making plants with increased salt and oxidative stress resistance as described in USSN 12/922,143
  misc_feature (1)..(461): Public GI ID no.15220120
  misc_feature (1)..(461): Bit score of 889.0 for HMM based on sequences of FIGURE 9 of USSN 12/922,143.
  misc_feature (200)..(327): Pfam Name: Cyclin_N Pfam Description: Cyclin, N-terminal domain
  misc_feature (329)..(455): Pfam Name: Cyclin_C Pfam Description: Cyclin, C-terminal domain
  misc_feature (1)..(461): Functional Homolog Of Ceres SEEDLINE ID no. ME08564
MGKENAVSGNSIPIHGRPVTRALASALRASSKLITSSEVAATTQNQGRVLRAKSKRTALDEKKANAPKKRAVLKDITNVTCENSYTSCFSVAVENIKQIKKGRQSSSSSKVASSSATSQVTDAKVEVVSNSAGASLSVFTDTSLGTNETSYSIIAKPSSRSPPRPFGTVERSCGGASSPKFVDIDSDDKDPLLCSLYAPDIYYNLRVAELKRRPFPDFMEKTQRDVTETMRGILVDWLVEVSEEYTLVPDTLYLTVYLIDWFLHGNYVERQRLQLLGITCMLIASKYEEIHAPRIEEFCFITDNTYTRDQVLEMESQVLKHFSFQIYTPTSKTFLRRFLRAAQVSFPNQSLEMEFLANYLTELTLMDYPFLKFLPSIIAASAVFLAKWTLNQSSHPWNPTLEHYTTYKASDLKASVHALQDLQLNTKGCSLNSIRMKYRQDKFKSVAVFSSGELPDKLFIS

SEQ ID NO: 4233 - protein, 434 aa, Brassica napus
  misc_feature (1)..(434): useful for making plants with increased salt and oxidative stress resistance as described in USSN 12/922,143
  misc_feature (1)..(434): Public GI ID no.562188
  misc_feature (1)..(434): Bit score of 1052.7 for HMM based on sequences of FIGURE 9 of USSN 12/922,143.
  misc_feature (175)..(302): Pfam Name: Cyclin_N Pfam Description: Cyclin, N-terminal domain
  misc_feature (304)..(431): Pfam Name: Cyclin_C Pfam Description: Cyclin, C-terminal domain
  misc_feature (1)..(434): Functional Homolog Of Ceres SEEDLINE ID no. ME08564
MGKENVVSRPLTRAFASALRASTTENQQRANTKRPASEDVNVTAPPNKKKKRAVLGDISNASFSAAKLEARDIKQVKKSQGLASASCVTSEVTDLQSGTEAKAEVVSVTAGNTNDTADNCIEKHKLPPRPLGRSSASIVEKSGVIRSSTALDLPKFTDIDSDDKDPLLCCLYAPEIYYNLRVSELKRRPVPNFMERIQKDVTQSMRGILVDWLVEVSEEYTLVPDTLYQTVYLIDWFLHGNYLERQRLQLLGITCMLIASKYEEINAPRIEEFCFITDNTYTRDQVLEMENQVLAHFSFQIYTPTPKTFLRRFLRAAQASYLIPRRELECLASYLTEVTLIDYHFLKFLPSVIAASAVFLAKWTLDQSNHPWNPTLEHYTTYKASDLKASVHALQDLQLNTKGCPLSAIRMKYKQEKFKSVAVLMSPKLLDTLF

SEQ ID NO: 4234 - protein, 452 aa, Medicago sativa subsp. falcata
  misc_feature (1)..(452): useful for making plants with increased salt and oxidative stress resistance as described in USSN 12/922,143
  misc_feature (1)..(452): Public GI ID no.1245816
  misc_feature (1)..(452): Bit score of 1086.2 for HMM based on sequences of FIGURE 9 of USSN 12/922,143.
  misc_feature (192)..(319): Pfam Name: Cyclin_N Pfam Description: Cyclin, N-terminal domain
  misc_feature (321)..(449): Pfam Name: Cyclin_C Pfam Description: Cyclin, C-terminal domain
  misc_feature (1)..(452): Functional Homolog Of Ceres SEEDLINE ID no. ME08564
MKEVAPGTQDQKQPLRANSKRALSDVTYLPHKKRAILQDVTNNCGENTKRSCLNPTEIQAKKRKVAKPAQPNVSNEVPSAAELPPFIADSKPVSSMEMRLRSSEDFRCLDDLEDNAPFRMSSNQCGTNNNLLQSQTSRISARPSSSQKKASQIVAAKKANISELLDVSKHPDVADIDADFEDPQLCSHYAADIYDHLRVAELSRRPYPNFMETVQQDITPSMRAILVDWLVEVSEGYKLQANTLYLAVYLIDWFLSKNCIEKERLQLLGITCMLIASKYEEINAPRIEDFCFITDNTYTKEEVVKLESLVLKSSSYQLFAPTTKTFLRRFLRAAQASYKRPSIELEYLTNYLAELTLLNYGFLNFLPSMIAASAVFLARWTLDQSSHPWNPTLEHYASYKASDLKATVLALQDLQLNSNDDCPLTAIRKKYTQDKLNCVAALSSPKLLETLF

SEQ ID NO: 4235 - protein, 484 aa, Medicago sativa subsp. x varia
  misc_feature (1)..(484): useful for making plants with increased salt and oxidative stress resistance as described in USSN 12/922,143
  misc_feature (1)..(484): Public GI ID no.5305100
  misc_feature (1)..(484): Bit score of 1072.2 for HMM based on sequences of FIGURE 9 of USSN 12/922,143.
  misc_feature (224)..(351): Pfam Name: Cyclin_N Pfam Description: Cyclin, N-terminal domain
  misc_feature (353)..(481): Pfam Name: Cyclin_C Pfam Description: Cyclin, C-terminal domain
  misc_feature (1)..(484): Functional Homolog Of Ceres SEEDLINE ID no. ME08564
MRKSVTLKAGEVPSRLTRARAVALSTSGQLPPMKEVAPGTQNQKQPLRANSKRAVSDVTYLPHEMRAILQDVTNNCGENTNRSCLNPTEIQAKKRKVAKPAQPDVSNEVPSAAERPPFIADSKPVSSMEMRLRSSEDFRCLDDLEDNAPFRMSSNQSGTNNNLLQNQTSRISARLLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLFLTVYLIDWFLSKNCIERERLQLLGITCMLIATKYEEINAPRIEDFCFITDNTYVKEEVVKLESLVLKSSSYQLFAPTTKTFLRRFLRAAQASYKRPSIELEYLANYLAELTLMNYGFLNFLPSMVAASSVFLARWTLDQSSHPWNPTLEQYASYKASDLKATVLALQDLQLNSNDDCPLTAIRKKYTQDKLNCVAALSSPKLLETLF

SEQ ID NO: 4236 - DNA, 1874 bp, Zea mays
  misc_feature (1)..(1874): useful for making plants with increased salt and oxidative stress resistance as described in USSN 12/922,143
  misc_feature (1)..(1874): Ceres CLONE ID no.375085
ctctaaaaccccaaccgtcgacgttcactcctcaccccctgcggccctgctcttttgagcctcactcctcagtcttcacgccgccggggcagtgctaagatccaggacacgcgctgtcccgctagcaccacgcctccccttgtcatcgtcctcctcccacgtgctgctgtgggggtgcagacgggagacacatccggacctgattgatttcttcgttttgttctgctggtttacatggctgcaagaaagaaaaagcctttgcttattgcttgccaagcaaccagtgccagaataacaagatctcaggctgctgcaaatagtacaagatctgggctggctccttctgtaccagtacctctgaaaacggagcataaccatgcagcgaaaaaaaagatgaaaagggaagcttcagatgaaaatgcttctgctgatgctggagcttcagctcctctgcctaaaaggcgtacagttctcaagaatgtaactaacataagctgtgctaaaatttccaaaaggtgcactgctgtgactgggctgaagttgggtccctcccagaaggctgggcagagcataaacaagcaatgcacaaacaagatctccatgcttctccctctggctgttggagggagttcacttgtggatgattctaataatgctgaagaaacacaaatggtagaccttttggcacagaaagagaagcagattgttttgcttaaggaggctcagccattacagaatactgaacaaaacaaaggcggtgcttgtgatgaggcatctgttgaggaaagaaatgccatgaatgtacacgaaactgctgccttaaaggctggggtctctaatggtttaaacattgtagatattgacaaaaataatggtgatcctcaaatgtgtgttacctacgttgcagagatatacagaaatctaatggcctcagagcttataagaagacctaggtcaaattacatggagactttgcaacaggacatcacagctagcatgcgaggtgttctaattgattggcttgttgaggtttcggacgaatataagcttgtggcagatacactttaccttacagtatatcttattgaccaatttctttctcagaactgtatccaaacgcacaagctgcaacttcttgggataactagtatgctgattgcctcgaaatatgaagagtattctgctcctagtgctgaagaattttgtaacataacggctggtacatatgcaaaggctgaggttctggaaatggagcaacaagtgcttaatgatctgggctttcatttatctgttccaacaacaaacacatttctcaggagattccttagagcagcacaggcttctcgtacagctcatctgaccactttgaattatctggcgagttatcttgccgagttgactttaatcagttacgatttcatgaaatttcttccctcagaggtggcagcatcttcgattttccttgcaaaatggacacttgaccaatctgaccatccttggaaccctactcttgagcactacacgtcttacaaaagcttcgatattagaacttgcgtgcgggctctacaggaactgcagcacaacaccagtaattgccccctcaacgccatccgtgagaagtatgggcagcagaagttcgagtgcgttgccaacctcaggtcaccggagctgctgcggtcgctcttcagttgatgtgctcccctgcactctgctgattcactcgccatttgctgcaacgatcctgacactgtataaaatatttcttcagtttctgttccatttccaaactttcttcagtttgaacatgcattctgtgacttgggtcaccgacaaaagaggcgcgacacactaatatatcaatttgtaactcaact

SEQ ID NO: 4237 - protein, 485 aa, Zea mays
  misc_feature (1)..(485): useful for making plants with increased salt and oxidative stress resistance as described in USSN 12/922,143
  misc_feature (1)..(485): Ceres CLONE ID no.375085
  misc_feature (1)..(485): Bit score of 1177.4 for HMM based on sequences of FIGURE 9 of USSN 12/922,143.
  misc_feature (225)..(352): Pfam Name: Cyclin_N Pfam Description: Cyclin, N-terminal domain
  misc_feature (354)..(481): Pfam Name: Cyclin_C Pfam Description: Cyclin, C-terminal domain
  misc_feature (1)..(485): Functional Homolog Of Ceres SEEDLINE ID no. ME08564
MAARKKKPLLIACQATSARITRSQAAANSTRSGLAPSVPVPLKTEHNHAAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNLMASELIRRPRSNYMETLQQDITASMRGVLIDWLVEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTAHLTTLNYLASYLAELTLISYDFMKFLPSEVAASSIFLAKWTLDQSDHPWNPTLEHYTSYKSFDIRTCVRALQELQHNTSNCPLNAIREKYGQQKFECVANLRSPELLRSLFS

SEQ ID NO: 4238 - protein, 452 aa, Medicago sativa subsp. x varia
  misc_feature (1)..(452): useful for making plants with increased salt and oxidative stress resistance as described in USSN 12/922,143
  misc_feature (1)..(452): Public GI ID no.1050559
  misc_feature (1)..(452): Bit score of 1040.8 for HMM based on sequences of FIGURE 9 of USSN 12/922,143.
  misc_feature (192)..(319): Pfam Name: Cyclin_N Pfam Description: Cyclin, N-terminal domain
  misc_feature (321)..(449): Pfam Name: Cyclin_C Pfam Description: Cyclin, C-terminal domain
  misc_feature (1)..(452): Functional Homolog Of Ceres SEEDLINE ID no. ME08564
MKEVAPGTQDQKQPLRANSKRALSDVTYLPHKKRAILQDVTNNCGVNTKRSCLNPTEIQAKKRKVAKPAQPHVSNEVPSAAELPPFIADSKPVSSMEMRLRSSEDFRCLDDLEDNAPFRMSSNQCGTNNNLLQSQTSRISARPLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLSLTVYLIDWFLSKNCIERERLQLLGITCMLIATKYEEINAPRIKDFCFIQDNTYTKEEVVKLESLVLKSSSYQLFAPTTKTFLRRFLRAAQASYKRPSIELEYLANYLAELTLMNYGFLNFLPSMVAASSVFLARWTLDQSSHPWNPTLEHYASYKASDLKATVLALQDLQLNSNDDCPLTTIRKKYTQDKLNCVAALSSPKLLETLF

SEQ ID NO: 4239 - protein, 532 aa, Adiantum capillus-veneris
  misc_feature (1)..(532): useful for making plants with increased salt and oxidative stress resistance as described in USSN 12/922,143
  misc_feature (1)..(532): Public GI ID no.1665741
  misc_feature (1)..(532): Bit score of 622.6 for HMM based on sequences of FIGURE 9 of USSN 12/922,143.
  misc_feature (268)..(395): Pfam Name: Cyclin_N Pfam Description: Cyclin, N-terminal domain
  misc_feature (397)..(524): Pfam Name: Cyclin_C Pfam Description: Cyclin, C-terminal domain
  misc_feature (1)..(532): Functional Homolog Of Ceres SEEDLINE ID no. ME08564
MSEQGCYTDCWGAIWWIWESGIKAMAGLEGEIQTRRLRGREIPVLPPVTRSAAASAANVGYNENTRKTKVSTKRAAADDTSSRVASNVPVQHAKKRAALANLTNQSNSAITRNSSLPSKSHASAVNGKTRAAAGQVKEVQQVAQQVVEPLQEVGREPNTGRSSLANSSITFDNDENACPERATSSVGMKSRTLDVLQLVGNENKTVASLERKTQHSLYISKDTKPRARQGGLFEDCKDDNEEGGWSSKNYMDIDNHKDPQMCSAYAAEIYHHLRMAELKRRPSLNFMDTVQQDINASMRGILVDWLVEVAEEYKLVPDTLYLTISYIDRFLSGNLVTRQRLQLLGVASMLIASKYEEICAPQVDEFCYITDNTYNREEVLEMERSVLNHLHFELTGPTTKSFLRRFVRAAQAGQKSPTLQLEFLGNYLAELTLLEYGFLHFLPSMIAGAAVLVARVTLNPTWRPWNSTLQHYSGYKASELKECAKAILELQKNTKNCTLPAIREKYRQHKFKCVATLHPPASIPAEYFDDIE

SEQ ID NO: 4240 - protein, 450 aa, Arabidopsis thaliana
  misc_feature (1)..(450): useful for making plants with increased salt and oxidative stress resistance as described in USSN 12/922,143
  misc_feature (1)..(450): Public GI ID no.15218225
  misc_feature (1)..(450): Bit score of 909.7 for HMM based on sequences of FIGURE 9 of USSN 12/922,143.
  misc_feature (191)..(318): Pfam Name: Cyclin_N Pfam Description: Cyclin, N-terminal domain
  misc_feature (320)..(447): Pfam Name: Cyclin_C Pfam Description: Cyclin, C-terminal domain
  misc_feature (1)..(450): Functional Homolog Of Ceres SEEDLINE ID no. ME08564
MGKENAVSRPFTRSLASALRASEVTSTTQNQQRVNTKRPALEDTRATGPNKRKKRAVLGEITNVNSNTAILEAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKYKSVAVLTSPKLLDTLF

SEQ ID NO: 4241 - protein, 480 aa, Medicago sativa
  misc_feature (1)..(480): useful for making plants with increased salt and oxidative stress resistance as described in USSN 12/922,143
  misc_feature (1)..(480): Public GI ID no.15419009
  misc_feature (1)..(480): Bit score of 1050.0 for HMM based on sequences of FIGURE 9 of USSN 12/922,143.
  misc_feature (224)..(347): Pfam Name: Cyclin_N Pfam Description: Cyclin, N-terminal domain
  misc_feature (349)..(477): Pfam Name: Cyclin_C Pfam Description: Cyclin, C-terminal domain
  misc_feature (1)..(480): Functional Homolog Of Ceres SEEDLINE ID no. ME08564
MRKSVTLKAGEVPSRLTRARAVALSTSGQLPPMKEVAPGTQNQKQPLRANSKRAVSDVTYLPHEMRAILQDVTNNCGENTNRSCLNPTEIQAKKRKVAKPAQPDVSNEVPSAAERPPFIADSKRVSSMEMRLRSSEDFRCLDDLEDNAPFRMSSNQSGTNNNLLQNQTSRISARLLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLFLTVYLIDWFLSKNCIERERLQLLGITCMLIATKYEEINAPRIEDFCFITDNTYVVKLESLVLKSSSYQLFAPTTKTFLRRFLRAAQASYKRPSIELEYLANYLAELTLMNYGFLNFLPSMVAASSVFLARWTLDQSSHPWNPTLEQYASYKASDLKATVLALQDLQLNSNDDCPLTAIRKKYTQDKLNCVAALSSPKLLETLF

SEQ ID NO: 4242 - DNA, 1422 bp, Sorghum bicolor
  misc_feature (1)..(1422): useful for making plants with increased salt and oxidative stress resistance as described in USSN 12/922,143
  misc_feature (1)..(1422): Ceres ANNOT ID no.6054472
atggggaagaagggcaagtggttcggcgccgtcaagaaggtcttcagccctgaatccaaggagaagaaagaggagagactaaggaggaaatcagcagctagcaacccagcaccgctagatctgaccccatctacctccttggaagtcaatgtttcggtgccaccccctccagctccggcacctcctccagttctccaccaggccgaggaggtcagggtccctgaacccgagcaggagcagagcaagcatgtcaccgtggaggagccccctgctgttccagcacagccgtcggtgctgccacctggtgtgccaaccgaagagcttgctgcggtcaagatccagaccgccttccgaggttacctggcaaggagggcactaagagcactgcgaggtcttgttcgattgaagtcattggttgagggtaattcagtcaagcgtcaatctgcaagcactctgcgctgtatgcaaactctatcgcgggtgcagtcacaaatacgttctaggagagcaaagatgtccgaggagaaccaggccctccaacgccagctcctacttaaacaggaattggagaatttcagaatgggtgagaactgggatgacagcactcaatccaaggagcaaatcgaggcaagcctgataagcaggcaagaagcagcgataagaagagaaagagcgcttgcatatgcattttcacatcagtggaagagtacttcaagatctgtcaacccaatgtttgtagacccaaacaacttgcagtggggctggagctggttggagcgctggatggcagcaaaaccttgggagggccgtaatggggctgacaaggagagcaactttgaccgcggatcagttaagagtatgagcttgaaccttggagagggtgaaatcacaaaagctttcaaccgccgggactcaaagccagaaaagccatcaccaccaactccaaaaccaacccgtccagcctggcaatccccttcgacgccatctgctaaagtggcaccaatacctgccaggaggaaatccgccacgccaaagaatgggctttcacaggtggacgatgacgctaggagtgtgctcagcgtgcagtctgagcgaccaaggaggcacagtatagccacctcgactgtgcgggatgatgaaagcctcgcaagctccccatcactccccagctacatggttcccacggaatctgcaagagccaaatctcgtctccagggctcatcaatgaccaatggtgcagagacaccagagaaaggaggctctactggaccagtcaagaagaggttgtccttccaaggtggaactgcagctgcctcaccaatgcggcggcattctggtcctcccaaggtggagagtgcagtgaaggacattgttgcaccaccacagccagaggccttggtagtcaatggtggaagcaagtga

SEQ ID NO: 4243 - protein, 543 aa, Oryza sativa subsp. japonica; identical to SEQ ID NO: 3339
  misc_feature (1)..(543): useful for making plants with increased salt and oxidative stress resistance as described in USSN 12/922,143
  misc_feature (1)..(543): Public GI ID no.115474509
  misc_feature (1)..(543): Bit score of 70.3 for HMM based on sequences of FIGURE 16 of USSN 12/922,143.
  misc_feature (125)..(145): Pfam Name: IQ Pfam Description: IQ calmodulin-binding motif
  misc_feature (1)..(543): Functional Homolog Of Ceres SEEDLINE ID no. ME24091

SEQ ID NO: 4244 - protein, 452 aa, Arabidopsis thaliana
  misc_feature (1)..(452): useful for making plants with increased salt and oxidative stress resistance as described in USSN 12/922,143
  misc_feature (1)..(452): Public GI ID no.8072394
  misc_feature (1)..(452): Bit score of 851.7 for HMM based on sequences of FIGURE 9 of USSN 12/922,143.
  misc_feature (191)..(318): Pfam Name: Cyclin_N Pfam Description: Cyclin, N-terminal domain
  misc_feature (320)..(433): Pfam Name: Cyclin_C Pfam Description: Cyclin, C-terminal domain
  misc_feature (1)..(452): Functional Homolog Of Ceres SEEDLINE ID no. ME08564
MGKENAVSRPFTRSLASALRASEVTSTTQNQQRVNTKRPALEDTRATGPNKRKKRAVLGEITNVNSNTAILEAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKTYYGFAVQICGGSHVSKAT

SEQ ID NO: 4245 - protein, 304 aa, Oryza sativa subsp. japonica
  misc_feature (1)..(304): useful for making plants with increased salt and oxidative stress resistance as described in USSN 12/922,143
  misc_feature (1)..(304): Public GI ID no.115461823
  misc_feature (1)..(304): Bit score of 551.0 for HMM based on sequences of FIGURE 16 of USSN 12/922,143.
  misc_feature (107)..(127): Pfam Name: IQ Pfam Description: IQ calmodulin-binding motif
  misc_feature (1)..(304): Functional Homolog Of Ceres SEEDLINE ID no. ME24091
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNSLR

SEQ ID NO: 4246 - protein, 500 aa, Oryza sativa subsp. japonica; identical to SEQ ID NO: 3391
  misc_feature (1)..(500): useful for making plants with increased salt and oxidative stress resistance as described in USSN 12/922,143
  misc_feature (1)..(500): Public GI ID no.115440873
  misc_feature (1)..(500): Bit score of 602.5 for HMM based on sequences of FIGURE 16 of USSN 12/922,143.
  misc_feature (142)..(162): Pfam Name: IQ Pfam Description: IQ calmodulin-binding motif
  misc_feature (1)..(500): Functional Homolog Of Ceres SEEDLINE ID no. ME24091

SEQ ID NO: 4247 - protein, 490 aa, Solanum lycopersicum
  misc_feature (1)..(490): useful for making plants with increased salt and oxidative stress resistance as described in USSN 12/922,143
  misc_feature (1)..(490): Public GI ID no.5420274
  misc_feature (1)..(490): Bit score of 468.4 for HMM based on sequences of FIGURE 9 of USSN 12/922,143.
  misc_feature (225)..(352): Pfam Name: Cyclin_N Pfam Description: Cyclin, N-terminal domain
  misc_feature (354)..(481): Pfam Name: Cyclin_C Pfam Description: Cyclin, C-terminal domain
  misc_feature (1)..(490): Functional Homolog Of Ceres SEEDLINE ID no. ME08564
MMTTQNRRSSAVAKRQAMAANSSGLEHNQTGKLNAKKRPALSNISNNTTVSARNSVSHSSKLAPCTSKIVNIKKNTSACNSNAVSSGTAVLPASSSVRPSSKPVSIQRSDAVVPKITVIPVPATCSMDISPSHSDGSLVSMDESMSNSDTVRSPEVEYIDDHELAAVDSIEKKACSTLYISEHVKAAAADICKRDVLVDLESGDKIMNIDNNLVDPQLCATMACDIYKHLRASEAKKRPSTDFMAKVQKDINPSMRAILIDWLVEVAEEYRLVPDTLHLTINYIDRYLSGNLMDRQRLQLLGVACMMIASKYEEICAPQVEEFCYITDNTYFKEEVLQMESAVLNYLKFEMTAPTAKCFLRRFVRAAQGLNEVLSLQLEHLASYIAELSLLEYNMLCYAPSLIAASAIFLAKYILLPSVKPWNSTLRHYTLYQPSDLRDCVLALHSLCCNNNNSSLPAVREKYSQHKYKFVAKKYCPPTVPVEFFQNISS

SEQ ID NO: 4248 - protein, 508 aa, Oryza sativa subsp. japonica
  misc_feature (1)..(508): useful for making plants with increased salt and oxidative stress resistance as described in USSN 12/922,143
  misc_feature (1)..(508): Public GI ID no.115435508
  misc_feature (1)..(508): Bit score of 469.8 for HMM based on sequences of FIGURE 9 of USSN 12/922,143.
  misc_feature (243)..(370): Pfam Name: Cyclin_N Pfam Description: Cyclin, N-terminal domain
  misc_feature (372)..(499): Pfam Name: Cyclin_C Pfam Description: Cyclin, C-terminal domain
  misc_feature (1)..(508): Functional Homolog Of Ceres SEEDLINE ID no. ME08564
MSSNLAASRRSSSSSSVAAAAAAKRPAVGEGGGGGGGKAAAGAAAAKKRVALSNISNVAAGGGAPGKAGNAKLNLAASAAPVKKGSLASGRNVGTNRASAVKSASAKPAPAISRHESATQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKYKFVAKKPCPPSIPTEFFRDATC

SEQ ID NO: 4249 - protein, 460 aa, Arabidopsis thaliana
  misc_feature (1)..(460): useful for making plants with increased salt and oxidative stress resistance as described in USSN 12/922,143
  misc_feature (1)..(460): Public GI ID no.15219350
  misc_feature (1)..(460): Bit score of 473.3 for HMM based on sequences of FIGURE 9 of USSN 12/922,143.
  misc_feature (197)..(324): Pfam Name: Cyclin_N Pfam Description: Cyclin, N-terminal domain
  misc_feature (326)..(453): Pfam Name: Cyclin_C Pfam Description: Cyclin, C-terminal domain
  misc_feature (1)..(460): Functional Homolog Of Ceres SEEDLINE ID no. ME08564
MSNILQNRRSSFSSSTKSSLAKRQAPSSSENSVKLMPAMTKKRAPLSNITNQKIASRLQNSDSVHCSNKSAKLKIAPSVCVNASFSSNLQQSIVPHKVASSPSKSDDGSVSMDETRSSSDSYKSPQVEYIENDDVSAVVSIERKALSNLFITPNSETIDNYCSRDVLSDMKKMDKNQIVNIDSNNGDPQLCATFACDIYKHLRASEAKKRPDVDYMERVQKDVNSSMRGILVDWLIEVSEEYRLVPETLYLTVNYIDRYLSGNVISRQKLQLLGVACMMIAAKYEEICAPQVEEFCYITDNTYLKDEVLDMESDVLNYLKFEMTAPTTKCFLRRFVRAAHGVHEAPLMQLECMANYIAELSLLEYTMLSHSPSLVAASAIFLAKYILDPTRRPWNSTLQHYTQYKAMELRGCVKDLQRLCSTAHGSTLPAVREKYSQHKYKFVAKKFCPSVIPQEFFNNS

SEQ ID NO: 4250 - DNA, 1723 bp, Gossypium hirsutum
  misc_feature (1)..(1723): useful for making plants with increased salt and oxidative stress resistance as described in USSN 12/922,143
  misc_feature (1)..(1723): Ceres CLONE ID no.1926089
tctctctttcggataaaagaaagctgagtaaaatgtcggcgcaaaagggtaatcggcgatcatccttttcttcatcgacgacgtcgtctttagccaaacgacatgcatcgtcatcggagaatgtgggaagagtcatagcttctttggctaaaaagagagtccctcttactaacattactaaccaaaagcagagctcaagctcaaaaagctcggctttggcctcctctttggtacaaagttcaaacaaaatccaaaaggcaaggaagacacagtctgttacaaatgtaggtctttcaggacatgttctgcctcctacaaatgaaagacgcagttcagttttgcctcccaaggttgttccatctctgccaacaggaaatgaagtgttgttgcctcctccaccagtacagtttagcatggagttttctcctagtaaatcagatggactgtcatcattttccttggatgagacaatgtccacttgtgattctttcaaaagccctgaagttgaatatatcgacaaccatgatgtttcagctatcagttccattgagcgaaaaacattcagcaatctctgtatttcggaccatgatgtagtagcaacaggaagtatttgcaatcgagatgctgtggcagagaaggaagccgatgatatggtaattgatgttgatgacaatttcatggatccccagctttgtgcaacatttgcttgtgatatttacaagcacctacgggcatccgaggtgaagaaaaggccttcgaccaacttcatggagacgattcagaatgacataaattccagcatgcgtgcaatactaattgattggcttgtagaagtggctgaagagtataggcttgtgcaggatacactatacttgacggtgagctacatagaccggtacctctcggggaatacgatgaacaggcagcggctacagttgcttggtgttgcctgcatgatgattgcttccaaatatgaggagatttgtgcccctcagatggaggaattctgctacataactgataatacatatttcaaggatgaggttctagaaatggaatcatctgttctgaattacttgaagtttgaaatgactgccccaacagctaaatgtttcttaagacggtttgttcgtgctgctcaagggatcaatgaggttccatcaatgcaattagagtgcatggccaactacattgctgaactgtctctccttgagtacagtatgctttgctaccctccatcactcattgctgcatccgcaattttccttgctaaatttatacttcttccatcaaagaaaccttggaattctaccttgcagcattacacactgtataagccctccgatctatttgagtgtgttaaggaccttcatagactatgctgtaacaacaacaattctactttgcctgcaatcagggagaaatacagtcagcataagtataaatgtgttgcaaagaagtattgccctccttcaataccttcagatttcttccacaactgaagaaggcattggacaccatcagcaacagcacaactgttccaattctttgttggataaacttttaatgggggtcgagaccaccaaatataaatttctacgttctaacttaattaaatagtactataaagtagtaggtcgatcccaaaggaattaggatttcaaattttcctgtttttgtaatcaaaattttgaaaaataaataaaaaggaggggttttagtt

SEQ ID NO: 4251 - protein, 489 aa, Gossypium hirsutum
  misc_feature (1)..(489): useful for making plants with increased salt and oxidative stress resistance as described in USSN 12/922,143
  misc_feature (1)..(489): Ceres CLONE ID no.1926089
  misc_feature (1)..(489): Bit score of 484.5 for HMM based on sequences of FIGURE 9 of USSN 12/922,143.
  misc_feature (227)..(354): Pfam Name: Cyclin_N Pfam Description: Cyclin, N-terminal domain
  misc_feature (356)..(483): Pfam Name: Cyclin_C Pfam Description: Cyclin, C-terminal domain
  misc_feature (1)..(489): Functional Homolog Of Ceres SEEDLINE ID no. ME08564
MSAQKGNRRSSFSSSTTSSLAKRHASSSENVGRVIASLAKKRVPLTNITNQKQSSSSKSSALASSLVQSSNKIQKARKTQSVTNVGLSGHVLPPTNERRSSVLPPKVVPSLPTGNEVLLPPPPVQFSMEFSPSKSDGLSSFSLDETMSTCDSFKSPEVEYIDNHDVSAISSIERKTFSNLCISDHDVVATGSICNRDAVAEKEADDMVIDVDDNFMDPQLCATFACDIYKHLRASEVKKRPSTNFMETIQNDINSSMRAILIDWLVEVAEEYRLVQDTLYLTVSYIDRYLSGNTMNRQRLQLLGVACMMIASKYEEICAPQMEEFCYITDNTYFKDEVLEMESSVLNYLKFEMTAPTAKCFLRRFVRAAQGINEVPSMQLECMANYIAELSLLEYSMLCYPPSLIAASAIFLAKFILLPSKKPWNSTLQHYTLYKPSDLFECVKDLHRLCCNNNNSTLPAIREKYSQHKYKCVAKKYCPPSIPSDFFHN

SEQ ID NO: 4252 - DNA, 1512 bp, Populus balsamifera subsp. trichocarpa
  misc_feature (1)..(1512): useful for making plants with increased salt and oxidative stress resistance as described in USSN 12/922,143
  misc_feature (1)..(1512): Ceres ANNOT ID no.1491834
atgaagaaggaaaacacacttccttctaattttaggcaacttaatggtccagtaacacgagcagctgccttgcgtgcttctgggaagatgccacctttaaaggcatcctcaaaacaagaccagaaaaggattttgcgagcaaatccaaaaagagcagccttagatgagaacaacactagtggacctgctaatgcaggtaatcaacgtaagaggagagcagtgcttcaggatgtcacaaatgtttgctgtgagaattcgtatacgagttgcttcagcgcaactaaaattcaggctaagatagctaaaaagggtcagctcaaagtatcaaaaattgccccttcagttgccttagaacaccgacatcttagagctaattcaaagaaaaaaattatttgtcaagaagtaaaaagagtaccttactctgaaattgtatgctcaagtactcaagaaaaagatgtatcttctcaacccagtggcataaggggggttggcatagatgatcctcagcttcctaatcagtgttcgagagtgccttcacatccccataattctccaaagaaaggtcagattctattcaaactcttcgctttaaacatggcaatcttgatggataccttcatttttaacttggtgataaaaagggaaaacaaaggggtgcatcttggttggagagctcataggaccaagcaggaagcagagttgtataaaaatggaacaagtgaaattcgttatagtagtgaaaagtggtcaaagagctgttacgtgcgggtaatgatatttttctctcaaatggtcatggcagagaaatgtaatgtttcggagaatcagaagatatcacgtgatcaagaatttatagacattgatagcaatcacaaggatcctcaactttgcagcctctacgctgctgatatctatagcaatttacgtgttgctgagcttgtccgaaggtctcttcctaattttatggaaacagtgcaacgagacatcactcaaagtatgagagggattttaattgattggcttgttgagtttgacgttaaatgtattactctgtgtcctgaagcaaatatgaagagatttgttcgccgcgagtggaagaattttgcttcatcactgacaacacatacacgagccatgaggagatttttacgtgcagcacaggcatcatacaagagccctagctatgaactagagtacctggctgattacctagcagaactgacattagttgactacagtttcttgaattttcttccttctgtcattgccgcatcatctgtatttcttgccaggtggactctggatcagacaagccatccatggagtccaaccctagaaaaatatacttcttacaaggcgtcagatcttaaaactacagttcttgcaatgcaagatttacaactgaacaccagtgggtgtcctctgaatgccatacgcatgaagtataggcaaccgaagttcaaatctgtgtctgctttgtcttctccgaaactgcttgaaacactattctga

SEQ ID NO: 4253 - protein, 503 aa, Populus balsamifera subsp. trichocarpa
  misc_feature (1)..(503): useful for making plants with increased salt and oxidative stress resistance as described in USSN 12/922,143
  misc_feature (1)..(503): Ceres ANNOT ID no.1491834
  misc_feature (1)..(503): Bit score of 508.6 for HMM based on sequences of FIGURE 9 of USSN 12/922,143.
  misc_feature (303)..(343): Pfam Name: Cyclin_N Pfam Description: Cyclin, N-terminal domain
  misc_feature (379)..(500): Pfam Name: Cyclin_C Pfam Description: Cyclin, C-terminal domain
  misc_feature (1)..(503): Functional Homolog Of Ceres SEEDLINE ID no. ME08564
MKKENTLPSNFRQLNGPVTRAAALRASGKMPPLKASSKQDQKRILRANPKRAALDENNTSGPANAGNQRKRRAVLQDVTNVCCENSYTSCFSATKIQAKIAKKGQLKVSKIAPSVALEHRHLRANSKKKIICQEVKRVPYSEIVCSSTQEKDVSSQPSGIRGVGIDDPQLPNQCSRVPSHPHNSPKKGQILFKLFALNMAILMDTFIFNLVIKRENKGVHLGWRAHRTKQEAELYKNGTSEIRYSSEKWSKSCYVRVMIFFSQMVMAEKCNVSENQKISRDQEFIDIDSNHKDPQLCSLYAADIYSNLRVAELVRRSLPNFMETVQRDITQSMRGILIDWLVEFDVKCITLCPEANMKRFVRREWKNFASSLTTHTRAMRRFLRAAQASYKSPSYELEYLADYLAELTLVDYSFLNFLPSVIAASSVFLARWTLDQTSHPWSPTLEKYTSYKASDLKTTVLAMQDLQLNTSGCPLNAIRMKYRQPKFKSVSALSSPKLLETLF

SEQ ID NO: 4254 - DNA, 1395 bp, Sorghum bicolor
  misc_feature (1)..(1395): useful for making plants with increased salt and oxidative stress resistance as described in USSN 12/922,143
  misc_feature (1)..(1395): Ceres ANNOT ID no.6020456
atggctgcacggaaagaaaaccctgagcttattgcttgtcaagcacccaatggtcgaatcacgcgagctcaagccgctgcaaatcgtcgaagctttggtgttctcccttctgttccactgcctgcaaaaactgatcgaaaacagactacacaagggaagatgaaaaggggatcttcatatgacaacactagtgcaagtactgcaatttctggcccccagcctaagaggcgcacagttctcagggatgtgaccaatttgcgtaatgctaactctaacaaaacttttgctgctgcaccgaaggttcagacaaggccctccctaaggactggaagaaccgtgaccagaggcaagcagtgcacaaaaaggattcctaaaataccccaaccagctggtaatggtggttcattcgccaatgattcgagcattgccgaagaaacacaagagaaacttttggcacagaaagaagaacctattcttttgcttgagaacaggggctcactgtcattgcagaatgttgaaaggaacagggacagtgcttgtcatgaggcattctttaaggaaagaaatgtcagggatatatgtgaaccttctgtgtcaaagaatggggactcttctgtgttagacattgtagatatcgacaaagataatggcaatcctcaaatgtgtgcttcctacgttgtagagatatactcaaaccttatggtttcagagcttatgagaagacccagtccgaattacatggagggtttgcaacgggacatcactaagggcatgagaggaatactcattgattggcttgtggaggtttctgaagaatacaagcttgttccagacacgctgtacctaactgtatatgttattgaccgaaagtatgaagagatatgtgctcctcgagttgaagaattctgtttcataaccgacaatacatacacaaaggcagaggtgctgaaaatggagtgccaagtgctgaacgacctgggatttcatctttctgttccaactacaaaaacatttctcaggagattccttagagcggcacaagcatctcgtaaaattccttctatgactttgggatttctggccaattatcttgcggagttgactttgaccgattatgagttcttgaaatttcttccatcattggtggcagcatcggctgtgtttcttgctagatggacacttgaccaatccgacgaaccatggaaccaaactctagagcactacacctcttacaaatgctctgacattcaattatgtgtctgtgctctacgagaactccagcataacaccagtaactgtcctcttaacgccatccgtgagaagtacaaacatcaaaagtttgattgcgtagcaaacctaacctcaccggagctccctcggtcgctcttcagctga

SEQ ID NO: 4255 - protein, 464 aa, Sorghum bicolor
  misc_feature (1)..(464): useful for making plants with increased salt and oxidative stress resistance as described in USSN 12/922,143
  misc_feature (1)..(464): Ceres ANNOT ID no.6020456
  misc_feature (1)..(464): Bit score of 931.3 for HMM based on sequences of FIGURE 9 of USSN 12/922,143.
  misc_feature (228)..(331): Pfam Name: Cyclin_N Pfam Description: Cyclin, N-terminal domain
  misc_feature (333)..(460): Pfam Name: Cyclin_C Pfam Description: Cyclin, C-terminal domain
  misc_feature (1)..(464): Functional Homolog Of Ceres SEEDLINE ID no. ME08564
MAARKENPELIACQAPNGRITRAQAAANRRSFGVLPSVPLPAKTDRKQTTQGKMKRGSSYDNTSASTAISGPQPKRRTVLRDVTNLRNANSNKTFAAAPKVQTRPSLRTGRTVTRGKQCTKRIPKIPQPAGNGGSFANDSSIAEETQEKLLAQKEEPILLLENRGSLSLQNVERNRDSACHEAFFKERNVRDICEPSVSKNGDSSVLDIVDIDKDNGNPQMCASYVVEIYSNLMVSELMRRPSPNYMEGLQRDITKGMRGILIDWLVEVSEEYKLVPDTLYLTVYVIDRKYEEICAPRVEEFCFITDNTYTKAEVLKMECQVLNDLGFHLSVPTTKTFLRRFLRAAQASRKIPSMTLGFLANYLAELTLTDYEFLKFLPSLVAASAVFLARWTLDQSDEPWNQTLEHYTSYKCSDIQLCVCALRELQHNTSNCPLNAIREKYKHQKFDCVANLTSPELPRSLFS

SEQ ID NO: 4256 - DNA, 1518 bp, Sorghum bicolor
  misc_feature (1)..(1518): useful for making plants with increased salt and oxidative stress resistance as described in USSN 12/922,143
  misc_feature (1)..(1518): Ceres ANNOT ID no.6028874
atgtcgaccatcgccgcctcccgccgctcgtcctcgtcctcgtccgcggccgccaagcgccccgcgatttcggagggcgccgggggacccaaggtggccgccgcgcaggccaagaagcgcgtggcgctcggcaacatcaccaacgttgccgcgcgaggagggagggccgtcgttggcggcggccttgggaatgccgcgccacccaccaccagcgcgaaattgaatccagcggtacccttgaagaagccatctttggcaagtgctcggagtgtgagctccattcggggtcaagctgtcaagtcggcttccatcaagccagctccaccagtgtcacgccatggcagtgcaattcaaaaacataatgttcctcctcctaaagtgcctaccattgccgatgtgccaagtcacgctcctgccttggtaccctgcaccggcttggtgtctcctggacgctcaggagattttgtttcgattgatgatacgatgtcgacttgcgactccatgaagagcccggactttgagtacatagacaatcaggattcctcgatgctggcttcattgcagcgacggacaaatgaacatctgcgaataacagaggatagagatgttgaagaaaataagtggaagaaaaatgccattgccccaatggaaattgaccgcatttgtgatgttgacaacgaatatgaggacccacagttgtgtgctactctggcttctgacatttacatgcacctgcgggaggctgagacgaagaaaagaccatcaactgatttcatggaaacaattcaaaaagacatcaacccaagcatgagggcaattttgatcgactggcttgtggaagtttctgaagaatatcgtcttgttcctgatactttgtacctgacagttaactacattgaccgttatctttctggtaacgaaattaaccgccaacggttgcaattacttggtgttgcttgcatgcttatagctgcaaaatatgaggagatatgtgcaccccaagtagaagaattctgctacataacagacaatacatacttcagagatgaggttctagatatggaaacttctgtactgaaatacttgaagtttgaaatgacagcacctacagcaaagtgctttttgaggaggtttgctcgtgctgcacaagcgtgtgacgaggatcctgctttgcatctcgagttccttgccaattacatcgctgagctatcactactggagtacaatctactctcttaccctccatcactaatagctgcatcggctattttcttggcgaggtttatactacagccaacaaagtatccttggaattccacacttgctcattatacacagtacaagccgtccgagttgagtgactgtgtaaaggcattgcatcgcctgtgcagtgttggttctgggaccaaccttccagcaatcagagaaaagtacagtcaacataagtacaaatttgttgcaaagaagcagtgtccaccacagatacctactgaattctttcgggatgccacatgctag

SEQ ID NO: 4257 - protein, 505 aa, Sorghum bicolor
  misc_feature (1)..(505): useful for making plants with increased salt and oxidative stress resistance as described in USSN 12/922,143
  misc_feature (1)..(505): Ceres ANNOT ID no.6028874
  misc_feature (1)..(505): Bit score of 470.5 for HMM based on sequences of FIGURE 9 of USSN 12/922,143.
  misc_feature (240)..(367): Pfam Name: Cyclin_N Pfam Description: Cyclin, N-terminal domain
  misc_feature (369)..(496): Pfam Name: Cyclin_C Pfam Description: Cyclin, C-terminal domain
  misc_feature (1)..(505): Functional Homolog Of Ceres SEEDLINE ID no. ME08564
MSTIAASRRSSSSSSAAAKRPAISEGAGGPKVAAAQAKKRVALGNITNVAARGGRAVVGGGLGNAAPPTTSAKLNPAVPLKKPSLASARSVSSIRGQAVKSASIKPAPPVSRHGSAIQKHNVPPPKVPTIADVPSHAPALVPCTGLVSPGRSGDFVSIDDTMSTCDSMKSPDFEYIDNQDSSMLASLQRRTNEHLRITEDRDVEENKWKKNAIAPMEIDRICDVDNEYEDPQLCATLASDIYMHLREAETKKRPSTDFMETIQKDINPSMRAILIDWLVEVSEEYRLVPDTLYLTVNYIDRYLSGNEINRQRLQLLGVACMLIAAKYEEICAPQVEEFCYITDNTYFRDEVLDMETSVLKYLKFEMTAPTAKCFLRRFARAAQACDEDPALHLEFLANYIAELSLLEYNLLSYPPSLIAASAIFLARFILQPTKYPWNSTLAHYTQYKPSELSDCVKALHRLCSVGSGTNLPAIREKYSQHKYKFVAKKQCPPQIPTEFFRDATC

SEQ ID NO: 4258 - DNA, 1509 bp, Sorghum bicolor
  misc_feature (1)..(1509): useful for making plants with increased salt and oxidative stress resistance as described in USSN 12/922,143
  misc_feature (1)..(1509): Ceres ANNOT ID no.6099828
atgtcgacccgcgccgcctcccgccgctcctcctcgtcgtccgcggccgccaagcgccccgcgatggcggagggcgccaaggcggcgggaaccgccgccgcgcaggccaagaagcgcgccgcgctcggcaacatcaccaacgtcgtcgccgctccggcgggaagggccgccgcccttgggaaggtcgcgccaccggtcaccggcgcgaagttgaattcagctacctcagctgtacccttaaagaagccatctttggcaaatgctcgcaatgcgagctccattcggggttctgctgtgaagtcggcttccatcaagccagctccaccagtaccacgcctcgacagcagcacaaggccgaagcataatgttcctgtgcctgccactgtccatgtgccaagtcgtgctcctgccttggtaccctgcagcagtttcgtgtcgcctgcacgttcaggagattcagtttctatcgatgagacgatgtcgacttgcgactccatgaaaagcccggactttgagtacatagacaatggggattcctcgatgctggcctcgttgcagcgacgggcagatgaacatctgcgtatatcagaggatacagatgttgaagaaaataaatggaagaaaaatgcccctgccccaatggaaatcgaccgcgtctgtgatgttgacaacgacttggaggatccacagttgtgcgctactctggcttctgacatctacatgcatctgcgagaagctgagacaaagaaacgaccatcaactgatttcatggaaacgattcaaaaagatgtcaacccaagcatgagggcaattttgatagactggctcgtagaagttgctgaagagtatcgtcttgttcctgatactttgtacctgacagttaactacattgaccgttatctttctggcaacgaaatcaaccgccaaaggctgcaattacttggtgttgcttgcatgcttatagctgcaaaatacgaggagatatgtgcaccccaagtagaagaattctgctacataacggacaatacatacttcagagatgaggtcctagaaatggaagcttctgtgctgaattatttgaagtttgaaatgacagcacctacagcaaagtgttttttgaggagatttgctcgttctgcacaagcgtgtgatgaggatcctgctttgcatctcgagttcctcgccagttacatcgctgagctatcccttctggagtacaatctactatcctaccctccatcactaatagctgcttcggctattttcttggcgaggtttatactccagccaacaaagtatccttggaactccacactttctcattacacacagtacaagccgtccgaattgagcgactgtgtaaaggcattgcaccgccttttcagcgttggtcctgggagcaaccttccagcaatcagagaaaagtacagtcaacataagtacaaatttgttgcgaagaagcagtgtccaccacaaatccctaccgaattcttcagggatacgacatga

SEQ ID NO: 4259 - protein, 502 aa, Sorghum bicolor
  misc_feature (1)..(502): useful for making plants with increased salt and oxidative stress resistance as described in USSN 12/922,143
  misc_feature (1)..(502): Ceres ANNOT ID no.6099828
  misc_feature (1)..(502): Bit score of 457.2 for HMM based on sequences of FIGURE 9 of USSN 12/922,143.
  misc_feature (238)..(365): Pfam Name: Cyclin_N Pfam Description: Cyclin, N-terminal domain
  misc_feature (367)..(494): Pfam Name: Cyclin_C Pfam Description: Cyclin, C-terminal domain
  misc_feature (1)..(502): Functional Homolog Of Ceres SEEDLINE ID no. ME08564
MSTRAASRRSSSSSAAAKRPAMAEGAKAAGTAAAQAKKRAALGNITNVVAAPAGRAAALGKVAPPVTGAKLNSATSAVPLKKPSLANARNASSIRGSAVKSASIKPAPPVPRLDSSTRPKHNVPVPATVHVPSRAPALVPCSSFVSPARSGDSVSIDETMSTCDSMKSPDFEYIDNGDSSMLASLQRRADEHLRISEDTDVEENKWKKNAPAPMEIDRVCDVDNDLEDPQLCATLASDIYMHLREAETKKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLASYIAELSLLEYNLLSYPPSLIAASAIFLARFILQPTKYPWNSTLSHYTQYKPSELSDCVKALHRLFSVGPGSNLPAIREKYSQHKYKFVAKKQCPPQIPTEFFRDTT

SEQ ID NO: 4260 - DNA, 1518 bp, Sorghum bicolor
  misc_feature (1)..(1518): useful for making plants with increased salt and oxidative stress resistance as described in USSN 12/922,143
  misc_feature (1)..(1518): Ceres ANNOT ID no.6099803
atgtcgaccttcgccgcctcccgccgctcctcctcgtccgcagcctccaagcgccccgcgatggacgagaacgccgccggtggaccgcgatggacgagaccgcaggccacgaagcgcgtcgcgctcggaaacatcaccaacgtcgccgctcccgctccagggaggagggccgccgtggggaaggtcgcgccacccgccaccacccgcgcgaagttgaatccggcaacctcagcagcacccttgaagaaaccatatccagcaaatgcacgcaatgtgagctccattcggggttctgctgtgaagtcggcttccatcaagccaggtccaccagtatcatgcctttgcagcagcacaatgcagcagaagcataatgttcctccacctaaagtgcctaccactgtcaatgtgccaagtcgtgctccagccttggtaccctgcagcagcttcatgtctcctggacgttcaggagattcagtttctatggatgagacgatgtcgatttgtgactccatgaaaagcccggactttgagttcatagacaatggggattcctcggtgctggcttcgttgcagcggcaggcaaatgaacatttgcgcatatcagaggaaaataagtggaagaaaaatgcccctgccccatttgaaatcgaccacatctgtgatgttgacaatgactacgaggatccacagttgtgcgctactctggcttccgacatttacatgcatctgcgagaggctgagatgaagaaaagcaaaagaccatcaactgacttcatggaaactattcacaaaagtgtcaacccaagcatgagggctattttgatcgactggcttgtggaagttgctgaagaatatcgtcttgttcctgatactctctacctgacagttaactacattgaccgttatctttctggcaatgaaatcgaccgccaaaggctgcaattacttggtgttacttgcatgcttatagccgcaaaatacgaggagatatgtgcaccccaagtagaagagttctgctacataactgatagtacatacttcagagatgatgttttagagatggaagcttctgtactgaattacttgaagtttgaaatggcagcacctacaccaaagtgctttctgaggagatttgcccgtgctgcacaagcgtgtgatgaggatcctgctttgcatctcgagttcctcgccaattacatcgctgagctatcactgctggagtacaatctactctcttacccgccatcactaatagctgcctcagctgttttcttggcaagatatgtactgcagccaacaaagtatccttggaattccacacttgctcattacacacagtataagccgtcggaactgagtgactgtgtaaaggcattgcaccgccttttcagcgttggtcctgggagtaaccttccagcaatcagagaaaaatacagtcaacataagtacaaatttgttgcaaggaagcagtgcccaccgtcaatccctacagaattctttcgtgatgtaacatggtaa

SEQ ID NO: 4261 - protein, 505 aa, Sorghum bicolor
  misc_feature (1)..(505): useful for making plants with increased salt and oxidative stress resistance as described in USSN 12/922,143
  misc_feature (1)..(505): Ceres ANNOT ID no.6099803
  misc_feature (1)..(505): Bit score of 446.0 for HMM based on sequences of FIGURE 9 of USSN 12/922,143.
  misc_feature (238)..(367): Pfam Name: Cyclin_N Pfam Description: Cyclin, N-terminal domain
  misc_feature (369)..(496): Pfam Name: Cyclin_C Pfam Description: Cyclin, C-terminal domain
  misc_feature (1)..(505): Functional Homolog Of Ceres SEEDLINE ID no. ME08564
MSTFAASRRSSSSAASKRPAMDENAAGGPRWTRPQATKRVALGNITNVAAPAPGRRAAVGKVAPPATTRAKLNPATSAAPLKKPYPANARNVSSIRGSAVKSASIKPGPPVSCLCSSTMQQKHNVPPPKVPTTVNVPSRAPALVPCSSFMSPGRSGDSVSMDETMSICDSMKSPDFEFIDNGDSSVLASLQRQANEHLRISEENKWKKNAPAPFEIDHICDVDNDYEDPQLCATLASDIYMHLREAEMKKSKRPSTDFMETIHKSVNPSMRAILIDWLVEVAEEYRLVPDTLYLTVNYIDRYLSGNEIDRQRLQLLGVTCMLIAAKYEEICAPQVEEFCYITDSTYFRDDVLEMEASVLNYLKFEMAAPTPKCFLRRFARAAQACDEDPALHLEFLANYIAELSLLEYNLLSYPPSLIAASAVFLARYVLQPTKYPWNSTLAHYTQYKPSELSDCVKALHRLFSVGPGSNLPAIREKYSQHKYKFVARKQCPPSIPTEFFRDVTW

SEQ ID NO: 4262 - DNA, 1137 bp, Sorghum bicolor
  misc_feature (1)..(1137): useful for making plants with increased salt and oxidative stress resistance as described in USSN 12/922,143
  misc_feature (1)..(1137): Ceres ANNOT ID no.6094932
atggccgacaaggagaactccgccgccgccgctgttgccgccgccccgccgcgcctcacccgcgccgcagccaagcgcgccgccgccgtcacggccgtggccgtcgccgccaagcgcaagcgcgtcgcgcttacccagctgcccacgcaccccaacgccgtgcacgacgactactacgatgacggcgacgacgacgacaagcccgtcaggaagcagcagcacctcctcgtccccgccgccaagcccaagcccaaggcagcgcccgcgcctgccgccgcctctgacgaggaggcggaggatccgcagctctgcaagccctacgcctccgacatctactcctacctccgctccatggagtcgcagcccaagcgccgccccgccgcggactacatcgccgcggtgcaggtcgacgtcacgcctaacatgcgcgccatcctcgtcgactggctcgtcgaggtcgccgaggagtacaagctcgtctccgacacgctctacctcaccgtctcctacgtcgaccgcttcctctccgccaacgccctcaacaggcagaggctgcagctcctcggcgtctgcgccatgctcgtcgcatccaagtatgaggagatcagcccgcccaatgtggaggatttctgctacatcaccgataacacctacaccaagcaggaggtagttaagatggagagtgatatactgaatgtcctcaagtttgaggtgggcaatcctacccccaagacgttcctgaggatgttcatcagatctgcccaagaagacaacaataagtgtcctagcctccagctggagttcctgggtaactacctgtgtgagctgagcttgctggactacagcttgcttcgcttcttgccatcacttgttgcagcctcagtggtgtttgttgcaaggctgacccttgatccacacaccaatccctggagcaagaagatgcagacactaactggctacaagccatctgagttgaaggactgtgttgctgccatacatcatatgcagctcaaccggaaatattcatccatgatggcgatccgggagaaatacaagcaacacaagttcaagggtgtatcagctttgctacctcctgttgagatcccagcatcatacttcaagaaactgaaggagtag

SEQ ID NO: 4263 - protein, 378 aa, Sorghum bicolor
  misc_feature (1)..(378): useful for making plants with increased salt and oxidative stress resistance as described in USSN 12/922,143
  misc_feature (1)..(378): Ceres ANNOT ID no.6094932
  misc_feature (1)..(378): Bit score of 351.0 for HMM based on sequences of FIGURE 9 of USSN 12/922,143.
  misc_feature (110)..(239): Pfam Name: Cyclin_N Pfam Description: Cyclin, N-terminal domain
  misc_feature (241)..(369): Pfam Name: Cyclin_C Pfam Description: Cyclin, C-terminal domain
  misc_feature (1)..(378): Functional Homolog Of Ceres SEEDLINE ID no. ME08564
MADKENSAAAAVAAAPPRLTRAAAKRAAAVTAVAVAAKRKRVALTQLPTHPNAVHDDYYDDGDDDDKPVRKQQHLLVPAAKPKPKAAPAPAAASDEEAEDPQLCKPYASDIYSYLRSMESQPKRRPAADYIAAVQVDVTPNMRAILVDWLVEVAEEYKLVSDTLYLTVSYVDRFLSANALNRQRLQLLGVCAMLVASKYEEISPPNVEDFCYITDNTYTKQEVVKMESDILNVLKFEVGNPTPKTFLRMFIRSAQEDNNKCPSLQLEFLGNYLCELSLLDYSLLRFLPSLVAASVVFVARLTLDPHTNPWSKKMQTLTGYKPSELKDCVAAIHHMQLNRKYSSMMAIREKYKQHKFKGVSALLPPVEIPASYFKKLKE

SEQ ID NO: 4264 - DNA, 1287 bp, Sorghum bicolor
  misc_feature (1)..(1287): useful for making plants with increased salt and oxidative stress resistance as described in USSN 12/922,143
  misc_feature (1)..(1287): Ceres ANNOT ID no.6074428
atggcggacaaggagaacgcaggtcccgcggcggggcctcggctcacgcgggccgcggcgaagcgcgctgcggcggcggcggtggcggtggcggcggagggtcccggtgacgccaagcggaggcgggtggcgctcggggagctaccggccctcgccaacaacgccgccgctggcctccgcgcgccgtctcgccccgccaagccctcgaagcccgcgtccaggtccgggaggcacgcgaggcccggcgcgtcggaggcccgcgggcccgccgttgccgccgccgccgccgaggccgagctctgcgcgtcctcctccccgccgcgcgccgccgaggccgacgccgagtccaactccgcctcctactccgcgccgcgtgccaccgccgacaccgactcctccttttcctcctcgccgccgcgcgccgccgcggcggcggcggcggcgcccgccgacctccagttctgcgggtcttacgcctccgacatctacacctacctccgctccctggaggtggagccgcagcggcggtccagatccgactacatcgaggcggtccaggcggacgttacggcccacatgcggagcatcctcgttgactggctcgtcgaggtcgccgaggagtataagctcgttgcggacacgctctacctcgccatctcctatgtcgatcgcttcctctctgtcaatgcgcttggccgagacaagctgcagctccttggcgttgcgtccatgctcattgctgcgaagtacgaggagatcagcccgcctcatcctgaggacttctgctacatcacagacaacacctacaccaaagaggagctcctcaagatggagagcgacatactcaagctcctcaagttcgagttgggcaatcctaccatcaagaccttcctgaggcggttcacaagatatgctcatgaagacaagaagcgctccatcttgttaatggaattcttggggagctacctcgctgagttgagtctactagattatggctgtctccggttcttgccgtcggtagttgctgcttcagttatgtttgttgctaggctgaccattgatccaaatgtcaatccttggaacacgaagctgcagaagatgactggctacaaagtttctgacctcaaggattgcattgtagccatacatgacttgcagctcaacaggaaatgtccatcattaatggcaattcgagacaagtacaagcaacacaagttcaaatgtgtgtcaacgcttcttccccctgttgtgatccctgcttcatactttgaagacttagatgagtag

SEQ ID NO: 4265 - protein, 428 aa, Sorghum bicolor
  misc_feature (1)..(428): useful for making plants with increased salt and oxidative stress resistance as described in USSN 12/922,143
  misc_feature (1)..(428): Ceres ANNOT ID no.6074428
  misc_feature (1)..(428): Bit score of 374.9 for HMM based on sequences of FIGURE 9 of USSN 12/922,143.
  misc_feature (161)..(290): Pfam Name: Cyclin_N Pfam Description: Cyclin, N-terminal domain
  misc_feature (292)..(419): Pfam Name: Cyclin_C Pfam Description: Cyclin, C-terminal domain
  misc_feature (1)..(428): Functional Homolog Of Ceres SEEDLINE ID no. ME08564
MADKENAGPAAGPRLTRAAAKRAAAAAVAVAAEGPGDAKRRRVALGELPALANNAAAGLRAPSRPAKPSKPASRSGRHARPGASEARGPAVAAAAAEAELCASSSPPRAAEADAESNSASYSAPRATADTDSSFSSSPPRAAAAAAAAPADLQFCGSYASDIYTYLRSLEVEPQRRSRSDYIEAVQADVTAHMRSILVDWLVEVAEEYKLVADTLYLAISYVDRFLSVNALGRDKLQLLGVASMLIAAKYEEISPPHPEDFCYITDNTYTKEELLKMESDILKLLKFELGNPTIKTFLRRFTRYAHEDKKRSILLMEFLGSYLAELSLLDYGCLRFLPSVVAASVMFVARLTIDPNVNPWNTKLQKMTGYKVSDLKDCIVAIHDLQLNRKCPSLMAIRDKYKQHKFKCVSTLLPPVVIPASYFEDLDE

SEQ ID NO: 4266 - DNA, 1440 bp, Sorghum bicolor
  misc_feature (1)..(1440): useful for making plants with increased salt and oxidative stress resistance as described in USSN 12/922,143
  misc_feature (1)..(1440): Ceres ANNOT ID no.6072122
atgtcgtgctgggcagcagggcgccgctcctcggcgtcggccatggcagagaacgccggcgcgcggggcgccaaggaggcggtggcgcggtccggcaagcgcgtcgccctcgggaacctcaccaacgtcttccgcggcagctggaagtccggcgcggcgaattcagcgtccgatgcgaaattgagttctaccaaaccagttgatgtcaagaagggatccttcgcttgcctgcacaatgtgaacacggaacggggttctagcagaaggctggcctctgaccaatttgatcaggcagtatcagttcttcagaagaacacatctcttccttctgtgccagacgttgtatcaacaggttgcagctcacctggcctgtctcaagattgttcagtctccatggatgatgctatatcaatatgcaactcaacagaaagctctgatcttcagtgcctcaatgatgatgacccctcaatggtagcttctttgcattggtgggccagtgatagacttcatttctctgatagtatggatgttgcagaactcaactggaggaaacatagtactattcctctgaaagctgataatataattgatcttgactgcaactataaggatccacggctttctacaactcttgcctgtgaaatttacgagagcttgcgagaggctgagactaggaaaatgccttcaacaaactttttggaaaccactcagacagatatgagcaaaaccatgagggcaatgttaatagactggcttgtagaagtcacagaagaatatcgtcttgttcctgaaaccttatacctcactgtcaattacattgaccgctatctttctgtcaaagagatcagtcggcacagactgcaattagttggtgttgcctgcttgcttatagctgcgaagtatgaagaaatatgcccacttcaggttgaagagctctgttatgttactgactattcatacactaaggaagaggttttgcaaatggaagcttctgttctgaatgacttgaagtttgagatgacagtacctacagcaaaatgtttcttaaggagatttgtgcatgctgctcaagttcttgacaagggctcatctctgcatcttgagttcttagccaactacatttgtgagctgtcacttctggactacagcttactttgctatttaccttcattggtagctgcctctgctgttttcttggcaaagtatatccttatgccaataaagaacccatggaattccacactatcttactacacgcgatatacaccatctgagttgcgtggttgtgtaaggttactgcaccggctcttccgtctgggccctggaagcaatcttcctgcaattagagaaaagtacagtcagcataagtacaaatttgtagcaaagaagtactgcccaccgtcaatccctactaagttcttccaggatctgacaagttag

SEQ ID NO: 4267 - protein, 479 aa, Sorghum bicolor
  misc_feature (1)..(479): useful for making plants with increased salt and oxidative stress resistance as described in USSN 12/922,143
  misc_feature (1)..(479): Ceres ANNOT ID no.6072122
  misc_feature (1)..(479): Bit score of 322.6 for HMM based on sequences of FIGURE 9 of USSN 12/922,143.
  misc_feature (214)..(341): Pfam Name: Cyclin_N Pfam Description: Cyclin, N-terminal domain
  misc_feature (343)..(470): Pfam Name: Cyclin_C Pfam Description: Cyclin, C-terminal domain
  misc_feature (1)..(479): Functional Homolog Of Ceres SEEDLINE ID no. ME08564
MSCWAAGRRSSASAMAENAGARGAKEAVARSGKRVALGNLTNVFRGSWKSGAANSASDAKLSSTKPVDVKKGSFACLHNVNTERGSSRRLASDQFDQAVSVLQKNTSLPSVPDVVSTGCSSPGLSQDCSVSMDDAISICNSTESSDLQCLNDDDPSMVASLHWWASDRLHFSDSMDVAELNWRKHSTIPLKADNIIDLDCNYKDPRLSTTLACEIYESLREAETRKMPSTNFLETTQTDMSKTMRAMLIDWLVEVTEEYRLVPETLYLTVNYIDRYLSVKEISRHRLQLVGVACLLIAAKYEEICPLQVEELCYVTDYSYTKEEVLQMEASVLNDLKFEMTVPTAKCFLRRFVHAAQVLDKGSSLHLEFLANYICELSLLDYSLLCYLPSLVAASAVFLAKYILMPIKNPWNSTLSYYTRYTPSELRGCVRLLHRLFRLGPGSNLPAIREKYSQHKYKFVAKKYCPPSIPTKFFQDLTS

SEQ ID NO: 4268 - DNA, 1532 bp, Arabidopsis thaliana
  misc_feature (1)..(1532): useful for making plants with increased salt and oxidative stress resistance as described in USSN 12/922,143
  misc_feature (1)..(1532): Ceres SEEDLINE ID no.ME11932
  misc_feature (1)..(1532): Inplanta Sequence
gcctgcagggccatcaccactgcagtggatgacgtcgtcctctccaacacagcgtactcacgtctcaattcctcctgaaccaggtccctttattcttcttcaatccctcaatttcctgattcttaactcagactttgataattcgttacttatcgctgttttcattttaccctaagcgatttgctctatcccttcaaattcccccgaagaattttgtgttattacgcctttgaatcaatcaattaaattattaagcaattaaatgcttaatttaacttcatttctgatccaaatgtctgtttagttatcaaatatttgttattaatgcatcatatttcttcagattagtgatttgaaatgtcttatggaactgtagaatgcatgagttttgattagatcatttgcagtatctctcttttgcaatttggattgtgtactaaactatcaattgttagttagtttacatttgtgttatgcaagtactgtagtagatattgtcatgaatctattgtctcatgtcttgagttgaattcttcaggaggaaagtcactaacacaagaagctaatgagccaccagttccgatatcagtttcctcgccgtgcgggaaacgaaccagagatcccgaagacgaggtctatctcgataaccttcgctctcagaaacgttatcttagcgaggtttgtttttactactcttaatatttccctaattctgctcgtttttcggtgtttaaatgtcctgagatcacgccatcatcttctgcgtagataatggcttgtagtttaaacggactaacagtaggagactcacttcctgtcaacatgttagagtctccagcacggtctgagagctttctttatcacaggtttgttgttgcatatggttgtgaagcatttgttgttgcatatggttgtcaagtttcaaaatgactatctgatgagctttattcatgtgtcgtacttaacacagggatgatttatcattacaatactctcccatgtcagaagactcggacgaagcgagattctgtgaggacccaacagcaacagcaagcactagctcatcgcaacccgagagccgcccaactagtccagtttcaccataccgataccaaagacctcttacttcaacaaactcaccacaaccgtcaccaacaatcttacaccattcacatacatgtcctgcctccatgatctccaatgcagcaactactactacaccacagtctcgccaaagaggatcagacacagaaggaaggtttccatcatcgcccagtgatatctgccattcgggtgacttgaggagaaccgctctactcaggtcggttcaaatgagaacacaaccatgtggttatagttcaagttcgggaccaagcaatattgacggtgaagagaggatgtgttctaagtctatggaagaagatagaggctataacaaaggggaagatatcccttacgctgaagtctctagtaagagcaagtcttgtaaagcattggacatgagactttgtgaaaagtgaccagagctctgg

SEQ ID NO: 4269 - protein, 280 aa, Arabidopsis thaliana
  misc_feature (1)..(280): useful for making plants with increased salt and oxidative stress resistance as described in USSN 12/922,143
  misc_feature (1)..(280): Ceres SEEDLINE ID no.ME11932
  misc_feature (1)..(280): Bit score of 583.0 for HMM based on sequences of FIGURE 15 of USSN 12/922,143.
MTSSSPTQRTHVSIPPEPGGKSLTQEANEPPVPISVSSPCGKRTRDPEDEVYLDNLRSQKRYLSEIMACSLNGLTVGDSLPVNMLESPARSESFLYHRDDLSLQYSPMSEDSDEARFCEDPTATASTSSSQPESRPTSPVSPYRYQRPLTSTNSPQPSPTILHHSHTCPASMISNAATTTTPQSRQRGSDTEGRFPSSPSDICHSGDLRRTALLRSVQMRTQPCGYSSSSGPSNIDGEERMCSKSMEEDRGYNKGEDIPYAEVSSKSKSCKALDMRLCEK

SEQ ID NO: 4270 - DNA, 798 bp, Populus balsamifera subsp. trichocarpa
  misc_feature (1)..(798): useful for making plants with increased salt and oxidative stress resistance as described in USSN 12/922,143
  misc_feature (1)..(798): Ceres ANNOT ID no.1471603
atgaggttggattcgaacccagcttcatcatcagcatcgacatcaacgtcaacaccaaacgggaagcgaagtagagatcctgaagatgaggtctaccttgacaatctcaattctcataagcgatacctcagtgagataatggcatctagtttgaatggattaacagttggagacccactccaggacaatcttatggaatctcctgccaggtctgacaccatgatttttgccagggatgaaatgtccttgcaatattcaccaatgtcagaagactttgatgactctagattttgcgagacccctataaatgcttgctcacctcaatctgaaagtctacccggcagtccagtttctccatataggtaccaaagaccacttggtggattctcttctgctccttatagcagctctttctcttcacatggctgcagtgtcaccgccacttattcacagcctcgtcaacgaggttcagattctgagggccggttcccgtcatcacctagtgatatatgccactcagctgacctgaggaggactgcactcctgcgttctgtgcagatgagaacacaaccacttggttcatcatcttttgaattgccatttgattcaggacacgagcctggatctaacatagaggctgaagagcggccatgctcatatatgaagtccttggttgaagagagggagtatgcacttgaagagtgttcttcaatgagcatctcagaacctggatttaatgaagagaaggcatgccgggttttgaatatgaatataaaaggggatggttctggagtttaa

SEQ ID NO: 4271 - protein, 265 aa, Populus balsamifera subsp. trichocarpa
  misc_feature (1)..(265): useful for making plants with increased salt and oxidative stress resistance as described in USSN 12/922,143
  misc_feature (1)..(265): Ceres ANNOT ID no.1471603
  misc_feature (1)..(265): Bit score of 631.7 for HMM based on sequences of FIGURE 15 of USSN 12/922,143.
  misc_feature (1)..(265): Functional Homolog Of Ceres SEEDLINE ID no. ME11932
MRLDSNPASSSASTSTSTPNGKRSRDPEDEVYLDNLNSHKRYLSEIMASSLNGLTVGDPLQDNLMESPARSDTMIFARDEMSLQYSPMSEDFDDSRFCETPINACSPQSESLPGSPVSPYRYQRPLGGFSSAPYSSSFSSHGCSVTATYSQPRQRGSDSEGRFPSSPSDICHSADLRRTALLRSVQMRTQPLGSSSFELPFDSGHEPGSNIEAEERPCSYMKSLVEEREYALEECSSMSISEPGFNEEKACRVLNMNIKGDGSGV

SEQ ID NO: 4272 - DNA, 816 bp, Populus balsamifera subsp. trichocarpa
  misc_feature (1)..(816): useful for making plants with increased salt and oxidative stress resistance as described in USSN 12/922,143
  misc_feature (1)..(816): Ceres ANNOT ID no.1497745
atgggttcggattcgaacgcagtcccatcagcatcagcttcagcatcgacatcgacatcgacatcaacaccatcgacaccaaatgggaagcgaagtagagaccctgaagatgaggtctaccttgacaatctccattctcacaagcgttacctcagtgaaataatggcatctagtttgaatggattaacggtcggagacccactccaggacaatcttatggaatctcctgccaggtctgacaccatgttttttgccagggatgaaatgtccttgcaatattcaccaatgtcagaagactttgatgactctagattttgcgagacccctataaatgcttgctcgcctcaatctgaaagtctacccggcagtccagtttctccatataggtaccaaagaccactttgtggattctcttctgctccttatagcagctctttctcttcacatggatgcagtgtcacttcttcacagcctcgtcaacgaggctcagattctgagggtcggtttccgtcatcacctagtgatatatgccactcagctgacctgaggagggctgcactcctgcgttctgtgcagatgagaacacaacctactggttcatcatcctttgaattgccatttggttcaggacaggagcctggatcaaacatggaagctgaagagcggccatgctcatatatgaaatccttggttgaagagagggagtatccactcgaggagtgttcttcaatgagcatctcagaacctgaatttaatgaagagaaggcgtgtcgggttttaaatatgaatataaaaggggatgactctggaggttaa

SEQ ID NO: 4273 - protein, 271 aa, Populus balsamifera subsp. trichocarpa
  misc_feature (1)..(271): useful for making plants with increased salt and oxidative stress resistance as described in USSN 12/922,143
  misc_feature (1)..(271): Ceres ANNOT ID no.1497745
  misc_feature (1)..(271): Bit score of 606.2 for HMM based on sequences of FIGURE 15 of USSN 12/922,143.
  misc_feature (1)..(271): Functional Homolog Of Ceres SEEDLINE ID no. ME11932
MGSDSNAVPSASASASTSTSTSTPSTPNGKRSRDPEDEVYLDNLHSHKRYLSEIMASSLNGLTVGDPLQDNLMESPARSDTMFFARDEMSLQYSPMSEDFDDSRFCETPINACSPQSESLPGSPVSPYRYQRPLCGFSSAPYSSSFSSHGCSVTSSQPRQRGSDSEGRFPSSPSDICHSADLRRAALLRSVQMRTQPTGSSSFELPFGSGQEPGSNMEAEERPCSYMKSLVEEREYPLEECSSMSISEPEFNEEKACRVLNMNIKGDDSGG

SEQ ID NO: 4274 - DNA, 891 bp, Populus balsamifera subsp. trichocarpa
  misc_feature (1)..(891): useful for making plants with increased salt and oxidative stress resistance as described in USSN 12/922,143
  misc_feature (1)..(891): Ceres ANNOT ID no.1444766
atgggttcggattcgaacgcagtcccatcagcatcagcttcagcatcgacatcgacatcgacatcaacaccatcgacaccaaatgggaagcgaagtagagaccctgaagatgaggtctaccttgacaatctccattctcacaagcgttacctcagtgaaataatggcatctagtttgaatggattaacggtcggagacccactccaggacaatcttatggaatctcctgccaggtctgacaccatgttttttgccagtttgcctagggatttggctgcatattatctactatttgcttatgcaaaatcaaatcccggggatcaggtgctgggggatgaaatgtccttgcaatattcaccaatgtcagaagactttgatgactctagattttgcgagacccctataaatgcttgctcgcctcaatctgaaagtctacccggcagtccagtttctccatataggtaccaaagaccactttgtggattctcttctgctccttatagcagctctttctcttcacatggatgcagtgtcacttcttcacagcctcgtcaacgaggctcagattctgagggtcggtttccgtcatcacctagtgatatatgccactcagctgacctgaggagggctgcactcctgcgttctgtgcagatgagaacacaacctactggttcatcatcctttgaattgccatttggttcaggacaggagcctggatcaaacatggaagctgaagagcggccatgctcatatatgaaatccttggttgaagagagggagtatccactcgaggagtgttcttcaatgagcatctcagaacctgaatttaatgaagagaaggcgtgtcgggttttaaatatgaatataaaaggggatgactctggaggttaa

SEQ ID NO: 4275 - protein, 296 aa, Populus balsamifera subsp. trichocarpa
  misc_feature (1)..(296): useful for making plants with increased salt and oxidative stress resistance as described in USSN 12/922,143
  misc_feature (1)..(296): Ceres ANNOT ID no.1444766
  misc_feature (1)..(296): Bit score of 586.5 for HMM based on sequences of FIGURE 15 of USSN 12/922,143.
  misc_feature (1)..(296): Functional Homolog Of Ceres SEEDLINE ID no. ME11932
MGSDSNAVPSASASASTSTSTSTPSTPNGKRSRDPEDEVYLDNLHSHKRYLSEIMASSLNGLTVGDPLQDNLMESPARSDTMFFASLPRDLAAYYLLFAYAKSNPGDQVLGDEMSLQYSPMSEDFDDSRFCETPINACSPQSESLPGSPVSPYRYQRPLCGFSSAPYSSSFSSHGCSVTSSQPRQRGSDSEGRFPSSPSDICHSADLRRAALLRSVQMRTQPTGSSSFELPFGSGQEPGSNMEAEERPCSYMKSLVEEREYPLEECSSMSISEPEFNEEKACRVLNMNIKGDDSGG

SEQ ID NO: 4276 - protein, 498 aa, Sorghum bicolor
  misc_feature (1)..(498): useful for making plants with increased salt and oxidative stress resistance as described in USSN 12/922,143
  misc_feature (1)..(498): Ceres ANNOT ID no.6016012
  misc_feature (1)..(498): Bit score of 572.5 for HMM based on sequences of FIGURE 16 of USSN 12/922,143.
  misc_feature (137)..(157): Pfam Name: IQ Pfam Description: IQ calmodulin-binding motif
  misc_feature (1)..(498): Functional Homolog Of Ceres SEEDLINE ID no. ME24091
MGKKGKWFSAVKKVFSSSGTDGKEAKAEKADKSKSKRRWPFGKTKKHSEPSISTVAGTAPVAPLPSPPPTQPHSLEIKDVNPLETDSEQNKHAYSVALASAVAAEAAAVAAQAAAEVVRLTAVTTAAPKMPVSSMEELAATKIQTAFRGYLARRALRALRGLVRLKSLVDGNAVKRQTAHTLQCTQTMTRVQTQIYSRRVKLEEEKQALQRQLQLKHQRELEKMKIDEDWDHSHQSKEQIEANLMMKQEAAMRRERALAYAFSHQWRTSGRTITPTFTEPGNPNWGWSWMERWMTARPWESRLVASDKDPKERALTKNPSTITVQAASVPRAISIQRPATPNKSSRPPSRQSPSTPPSKAPSTSGKTRPASPRGNWLYKEDDLRSITSIRSERPRRQSTGGGGSVRDDASLTSTPPLPSYMQSTESARAKSRYRSLLTEKLEVPERAPLVHSVVKKRLSFPVVDKPSVVPTDKPKERVRRHSDPPKVDPATLKDVPAA

SEQ ID NO: 4277 - DNA, 1124 bp, Arabidopsis thaliana
  misc_feature (1)..(1124): useful for making plants with increased salt and oxidative stress resistance as described in USSN 12/922,143
  misc_feature (1)..(1124): Ceres CLONE ID no.1343264
gatcaaaaaagaaaaaaaaactcaggaagaatctagttgcggttatcttcagcccaaagagtaaagacccatccatccgttgctgaatctgctgctttgatcgaaaatgacgtcgtcctctccaacacagcgtactcacgtctcagttcctcctgaaccaggaggaaagtcactaacacaagaagctaatgagccaccagttccgatatcagtttcctcgccgtgcgggaaacgaaccagagatcccgaagacgaggtctatctcgataaccttcgctctcagaaacgttatcttagtgagataatggcttgtagtttaaacggactaacagtaggagactcacttcctgtcaacatgttagagtctccagcacggtctgagagctttctttatcacagggatgatttatcattacaatactctcccatgtcagaagactcggacgaagcgagattctgtgaggacccaacagcaacagcaagcactagctcatcgcaacccgagagccgcccaactagtccagtttcaccataccgataccaaagacctcttacttcaacaaactcaccacaaccgtcaccaacaatcttacaccattcacatacatgtcctgcctccatgatctccaatgcagcaactactactacaccacagtctcgccaaagaggatcagacacagaaggaaggtttccatcatcgcccagtgatatctgccattcgggtgacttgaggagaaccgctctactcaggtcggttcaaatgagaacacaaccatgtggttatagttcaagttcgggaccaagcaatattgacggtgaagagaggatgtgttctaagtctatggaagaagatagaggctataacaaaggggaagatatcccttacgctgaagtctctagtaagagcaagtcttgtaaagcattggacatgagactttgtgaaaagtgatgaaagaggctctatgaagctgacatggcaatcctccttttaacagtgttaaaaaataaaaatccaaatatattaatatccgtttttattttctttagttataatttttttttttaaagttgtgaggtatgttaaaattttttttttaattaaagaacataaagttatttggatt

SEQ ID NO: 4278 - protein, 280 aa, Arabidopsis thaliana
  misc_feature (1)..(280): useful for making plants with increased salt and oxidative stress resistance as described in USSN 12/922,143
  misc_feature (1)..(280): Ceres CLONE ID no.1343264
  misc_feature (1)..(280): Bit score of 582.9 for HMM based on sequences of FIGURE 15 of USSN 12/922,143.
  misc_feature (1)..(280): Functional Homolog Of Ceres SEEDLINE ID no. ME11932
MTSSSPTQRTHVSVPPEPGGKSLTQEANEPPVPISVSSPCGKRTRDPEDEVYLDNLRSQKRYLSEIMACSLNGLTVGDSLPVNMLESPARSESFLYHRDDLSLQYSPMSEDSDEARFCEDPTATASTSSSQPESRPTSPVSPYRYQRPLTSTNSPQPSPTILHHSHTCPASMISNAATTTTPQSRQRGSDTEGRFPSSPSDICHSGDLRRTALLRSVQMRTQPCGYSSSSGPSNIDGEERMCSKSMEEDRGYNKGEDIPYAEVSSKSKSCKALDMRLCEK

SEQ ID NO: 4279 - DNA, 869 bp, Brassica napus
  misc_feature (1)..(869): useful for making plants with increased salt and oxidative stress resistance as described in USSN 12/922,143
  misc_feature (1)..(869): Ceres CLONE ID no.949027
  misc_feature (679)..(679): y is t/u or c
aaccgctttatagagattcgttgatacactgtaaaatttgttagggtttgaaaatggggccggaatcgcgatcgacgccgatatcagcatcgtcgccggcgtcgtcttcttcgccgagcgggaaacgaacaagagatccggaagacgacgaggtctatctcgacaacctccgctcccagaaacgttatctcagcgagataatggcttgcagtttaaacggactaaccgtcggagactcgcttcctgtcaacatgttagactctccttctcgctctgacacccttctttctcccaacaatcacattcacagggatgacttgtcattacagtactctcccatgtctgaagactccgacgaagctaggttctgcgaggacccaataacaagcacgagctcatcgcagcaacccgagagccgccctactagtcctgtttcaccttaccgataccatagacctcttacttcaacaacctcacaccatttgtcaaattcacattcatgccctgcctccatgagcaccaatgctactactccacagtctcgtccaagaggatcagacacggaaggaaggtttccatcgtcgcctagcgacatctgccattccagtgacttgagaaggaccgctctactcaggtctgttcaaatgagaacacagccttgtggtattgcttcaacttytgggacaagcaatgttgacggtggtgaagagaagttgtgctttaagtctatggaagaagataatagaggggaagatgtctcttatactcaagtctccggcggtaagagcaagtcttgtaaagcattggacatgagactatgtgaacgatgatttaaagacactattctctatcttaaaatacggtttctt

SEQ ID NO: 4280 - protein, 258 aa, Brassica napus
  misc_feature (1)..(258): useful for making plants with increased salt and oxidative stress resistance as described in USSN 12/922,143
  misc_feature (1)..(258): Ceres CLONE ID no.949027
  misc_feature (1)..(258): Bit score of 543.1 for HMM based on sequences of FIGURE 15 of USSN 12/922,143.
  misc_feature (1)..(258): Functional Homolog Of Ceres SEEDLINE ID no. ME11932
  misc_feature (209)..(209): Xaa is any aa, unknown or other
MGPESRSTPISASSPASSSSPSGKRTRDPEDDEVYLDNLRSQKRYLSEIMACSLNGLTVGDSLPVNMLDSPSRSDTLLSPNNHIHRDDLSLQYSPMSEDSDEARFCEDPITSTSSSQQPESRPTSPVSPYRYHRPLTSTTSHHLSNSHSCPASMSTNATTPQSRPRGSDTEGRFPSSPSDICHSSDLRRTALLRSVQMRTQPCGIASTXGTSNVDGGEEKLCFKSMEEDNRGEDVSYTQVSGGKSKSCKALDMRLCER

SEQ ID NO: 4281 - DNA, 1173 bp, Glycine max
  misc_feature (1)..(1173): useful for making plants with increased salt and oxidative stress resistance as described in USSN 12/922,143
  misc_feature (1)..(1173): Ceres CLONE ID no.527044
  misc_feature (142)..(142): m is a or c
  misc_feature (673)..(673): s is g or c
gactgctgtgtttcactgccaatgacggaagacggaaagggaagccgaagccatctctgcacaacaaattagggtttcaacattgagcagtccctttttcttcaccaaagagaaagccttggtttagatgagttggtctcamcaatgggttctgattccaatttgggagggtcgccctcagcatcttcgcccagtgccaagcgcaccagagatcccgaagaggaagtttatctcgacaatcttcgctctcacaagcgttacctaagcgagataatggcatccagtctcaacggattgacagttggagactcacttcctgataatctcatggaatctccagcaaggtctgaaagcatgttctctttcagagatgatatgtctttacaatattcaccgatgtcagaagattcagatgacctaaggttttgcgagacccctgtgcacagttgctcatcccaaccggacagtcttcccagtagtccagtttctccacacaggtaccaaagaccacagaatgcattgccttcagcaccttcttcaagttcaaatgcctcttatggctccaccattgcttgcccccagcctcgtcagcgagggtcggattctgaaggccgcttcccatcatccccaagtgatatatgccactcagctgacttgagaagagctgcacttstaagatctgtgcagatgagaacacagcctcctggccctgcatctttggacctgccttttgtttctaaccaagagtctgctcctaacatagatcctgaggaaagatcttgctcatatatgaaatctctggttgacgagagagagtattgagagttcatcaatgggtattccgtaaccccgatttcaaccttggtcatggtattacgccgtgcaggtcttaatgtgtttggaaggttaacttgctatattggagaattgtctcagtatcactatccagcgtctcctagtacgagatggttgcttgtgttagtcttggtcttgtttatgggattttgttcctccagctgctctctagtaaattatgcgtacagtcctgtgcctccggaattttactttattataattttcattcgagatagttgattattgcgttcatttcttataatttataggcttaaacaacttttaagtccatataatataatataatttttatttttg

SEQ ID NO: 4282 - protein, 225 aa, Glycine max
  misc_feature (1)..(225): useful for making plants with increased salt and oxidative stress resistance as described in USSN 12/922,143
  misc_feature (1)..(225): Ceres CLONE ID no.527044
  misc_feature (1)..(225): Bit score of 460.3 for HMM based on sequences of FIGURE 15 of USSN 12/922,143.
  misc_feature (1)..(225): Functional Homolog Of Ceres SEEDLINE ID no. ME11932
  misc_feature (177)..(177): Xaa is any aa, unknown or other
MGSDSNLGGSPSASSPSAKRTRDPEEEVYLDNLRSHKRYLSEIMASSLNGLTVGDSLPDNLMESPARSESMFSFRDDMSLQYSPMSEDSDDLRFCETPVHSCSSQPDSLPSSPVSPHRYQRPQNALPSAPSSSSNASYGSTIACPQPRQRGSDSEGRFPSSPSDICHSADLRRAALXRSVQMRTQPPGPASLDLPFVSNQESAPNIDPEERSCSYMKSLVDEREY

SEQ ID NO: 4283 - protein, 264 aa, Medicago truncatula
  misc_feature (1)..(264): useful for making plants with increased salt and oxidative stress resistance as described in USSN 12/922,143
  misc_feature (1)..(264): Public GI ID no.92877259
  misc_feature (1)..(264): Bit score of 647.0 for HMM based on sequences of FIGURE 15 of USSN 12/922,143.
  misc_feature (1)..(264): Functional Homolog Of Ceres SEEDLINE ID no. ME11932
MGFDSNLGGSPSSSSPSSKRTRDPEEEVYVDNLRSHKRYLSEIMASSLNGLTVGDSLPDNLMESPARSESAFSLRDDMSLQYSPMSEDSDDSRFCETGLHSCSSHPDSRPGSPVSPCRYQRSQNTFSSAPSTSLNGSHGFSVSAVTCSQPRQRSSDSDGRFPSSPSDICHSADLRRAALLRSVQMRTHPPGSASLELPFGSGQEPPPNIDPEERPCSYLKSMVDERDYQIEECSPIGIPEPEFNHDNKPCRVLNMNPKEADSGG

SEQ ID NO: 4284 - protein, 265 aa, Pisum sativum
  misc_feature (1)..(265): useful for making plants with increased salt and oxidative stress resistance as described in USSN 12/922,143
  misc_feature (1)..(265): Public GI ID no.61611694
  misc_feature (1)..(265): Bit score of 639.9 for HMM based on sequences of FIGURE 15 of USSN 12/922,143.
  misc_feature (1)..(265): Functional Homolog Of Ceres SEEDLINE ID no. ME11932
MGFDSNLGGSPSSSSPTAKRTRDPEEEVYVDNLRSHKRYLSEIMASSLNGLTVGDSLPDNLLESPARSESAFSLRDDISLQYSPMSEDSDDSRFCETPVHSCLTNLDSRPSSPVSPCRYQRQQNSFSSAPSTSLNTSHGFPVSAVTCSQPRQRSSDSDGRFPSSPSDICHSADLRRAALLRSVQMRTHPPGSASLELPFGSGQEPAPNIDSEDRPCSYMKSLVDERDYQIEECSSIGAPETEFNHDNNKPCRVLNMNPKAADSGG

SEQ ID NO: 4285 - DNA, 1217 bp, Triticum aestivum
  misc_feature (1)..(1217): useful for making plants with increased salt and oxidative stress resistance as described in USSN 12/922,143
  misc_feature (1)..(1217): Ceres CLONE ID no.779610
ctcacttttccccttcgactcttctctagctcccaccctcacctccaagaagcagccaatccagcaacccgtgccgccgcgccgcgccgcgcggatggcgggtggcagcggcgagggcgccgcaatgtcgccgccttcctcctccggcgttggcggcggcggcggtggcggaaagcgcgggagggatccggaggaggacgtgtacgtggacaacctccactcccacaagcggtacctcagcgagataatggcgtccagcctgaatgggctctctgttggagattcgcttgccgacaacatcatggagtcccctgcgaggtcggagagttcctcttgtatcagggacgaaataatctcccaatactcaccaatgtcagaagactcagatgactaccggtacttcgacacacaactaaaccccaacgggagtcaaggtgatgcaatggtcagcccatcaactagtccaatgtcatctcctcaccggttccagaaaccacaagctagtttcctaccatcaagcccatatcctctccccagctgctccctctcatccgtggcttgctctcaccctcggcgtggctctgagaatgaaggccggttcccgtcttcacccaatgacatgtgccatggcgcggacctgaggcgaacggcactactgaggtcggtgcaaatgagggtgcatggtccccatgcgtacgacccatcattcggcagccggcaggagcaagaacatgtccatgagcatgatgatgaacatggtcatgagcatctggaagatttgggagggccagaaagaccatcttgcaggaaatcaattgataatgaagctagtggctaccagggggctgaaaacagctatgggcggcaggagcatgatatcgattacatcgacggctgcacagctgatgatgtcttgagtggccccaagttcaagcaagaagatgataaccaaggtaattctgacgccagcatggataaaactagataggtactatcagagtgcaatcacaccatgcaattgttgtagtattaattatggcaatgggagatcaggttttttgctgttgtaattttctatgcagttggatttgttgcaatctggctgctttccgcaattttgaaattgtggcatttgagtacctgtctgctgtttgaacgaaaaagtcttgcggagagtgatttatagtatatccgtgcatgcaatgttttttctgatt

SEQ ID NO: 4286 - protein, 297 aa, Triticum aestivum
  misc_feature (1)..(297): useful for making plants with increased salt and oxidative stress resistance as described in USSN 12/922,143
  misc_feature (1)..(297): Ceres CLONE ID no.779610
  misc_feature (1)..(297): Bit score of 713.8 for HMM based on sequences of FIGURE 15 of USSN 12/922,143.
  misc_feature (1)..(297): Functional Homolog Of Ceres SEEDLINE ID no. ME11932
MAGGSGEGAAMSPPSSSGVGGGGGGGKRGRDPEEDVYVDNLHSHKRYLSEIMASSLNGLSVGDSLADNIMESPARSESSSCIRDEIISQYSPMSEDSDDYRYFDTQLNPNGSQGDAMVSPSTSPMSSPHRFQKPQASFLPSSPYPLPSCSLSSVACSHPRRGSENEGRFPSSPNDMCHGADLRRTALLRSVQMRVHGPHAYDPSFGSRQEQEHVHEHDDEHGHEHLEDLGGPERPSCRKSIDNEASGYQGAENSYGRQEHDIDYIDGCTADDVLSGPKFKQEDDNQGNSDASMDKTR

SEQ ID NO: 4287 - DNA, 1081 bp, Zea mays
  misc_feature (1)..(1081): useful for making plants with increased salt and oxidative stress resistance as described in USSN 12/922,143
  misc_feature (1)..(1081): Ceres CLONE ID no.226231
  misc_feature (661)..(661): w is a or t/u
tttccctaatccccatctccccttctctcgctgctggtggcctgcgaatggcgggcggaagcggcgaggcggctatgtctccgccgtcctctagtgccagcgggaagcgcgggcgggacccggaggaggacgtgtacgtggacaatctccattcccacaaacggtatctcagcgagataatggcatccagtctgaatggactgtctgttggggattcactgcctgacaacatcatggagtcccctgcaaggtcagagactgcttcctgctacagggatgagatattatcccaatactcaccgatgtcagaagactcggatgattaccggtgctatgacactcaattaaaccccagtgggaatcatcctgatgcgatgatcagcccttcaactagcccaatgtcatctcctcatcgacaccagagaccacaatcttctttgttaccttcaaacccataccctctcccaagctgctccctttcgtcagtagtctgctctcatgctcggcgtggctccgataatgaaggccggttcccgtcctcgccaaatgacatgtgccatgtagcagatttgaggcgaacagcactactgaggtcagtgcaaatgagggtgcagggaccccattcgtatgacctatcattcggcatcagacaaggacaagwtcatgcacatgagcatgaaggggaacatgaccatgagcatgaacatctagaggacttggaagggacagaaggatcatcttgcaataagtcaatcgttaacgaagtcacgtacaaccagagacgtgaccatgattttggtcggtcagagcacgagatagattacatcaacaacagcacatcagatgattgtgtaagtgatctaaaatttaagcaagaagataagagccatagtaaatttgatatccctatgcacaaaaattcatagcacatggaacatatgtgttagttttttggattataactctacttaacttcattgtattcttgacggatgccttatctattgtccgtggttttagcatcagcgttctgaatagcgacattgtaatatttgagtgaaattaacctttggattgttgc

SEQ ID NO: 4288 - protein, 292 aa, Zea mays
  misc_feature (1)..(292): useful for making plants with increased salt and oxidative stress resistance as described in USSN 12/922,143
  misc_feature (1)..(292): Ceres CLONE ID no.226231
  misc_feature (1)..(292): Bit score of 718.4 for HMM based on sequences of FIGURE 15 of USSN 12/922,143.
  misc_feature (1)..(292): Functional Homolog Of Ceres SEEDLINE ID no. ME11932
  misc_feature (205)..(205): Xaa is any aa, unknown or other
MAGGSGEAAMSPPSSSASGKRGRDPEEDVYVDNLHSHKRYLSEIMASSLNGLSVGDSLPDNIMESPARSETASCYRDEILSQYSPMSEDSDDYRCYDTQLNPSGNHPDAMISPSTSPMSSPHRHQRPQSSLLPSNPYPLPSCSLSSVVCSHARRGSDNEGRFPSSPNDMCHVADLRRTALLRSVQMRVQGPHSYDLSFGIRQGQXHAHEHEGEHDHEHEHLEDLEGTEGSSCNKSIVNEVTYNQRRDHDFGRSEHEIDYINNSTSDDCVSDLKFKQEDKSHSKFDIPMHKNS

SEQ ID NO: 4289 - DNA, 1212 bp, Zea mays
  misc_feature (1)..(1212): useful for making plants with increased salt and oxidative stress resistance as described in USSN 12/922,143
  misc_feature (1)..(1212): Ceres CLONE ID no.336655
ctagtaacgggaagcggctttgttgcattgcatcacaagttcacagctcgcccggacccagagggagcttgtacttccaaagttccacagttccactgcacagatcgtcggcggcggcgcaggcaaggccacaatgtctccggcgcccagcagcggcaagcgcgggagggttcccgacccggaggaggacgtctacgtcgacaacctccactcccacaagcgctacctcaccgagataatggcatccagcatgaatggcttgtccgttggagattcagttcctgacaatatcatggggtccccaatgagagtggagaatgcttcttgcattagggatgagatgagtatgcagtactcacctatgtcagaagagtcagatgattataggtactatgacactcaagtaaacaccaatgggaatcaaacagatgtactgggtaatccctcaactagtctaatctcatctgcacaccgttttcagaggccacacacttggttctcttctgcaagtccataccctctcccaagctgctccctcccagcagtgatctgctcccctgctcgccgtggttgtggcactgaacaggaaggctggatcccatcctcacctaatgacatgtgctatggtggagatctgagacgaaccgcacttctgaggtcagttcaaatgaaggtgcagagcccccatccatgtgatgtgcatgaacgagaacaagggcgttctaatgtacatgctgacgagcttcaacaggatcagaaagaagctgtgggtgtacagctggaccaaaggcctctctcttgtccaaagtcaacccaggatgctaagtgccagagctctatacactgatgacgcggattttgttgaggatcagattacggtgtgaccagtcaaagtttgtcgaggatcatcacatatctggtaattttttgcgtagatttggatgaccataaataatactccctgtttcccaatatattgttcgtcctggcggatctattgacaccctaaaacgaatactattttgggttggagggagggagcatgttgcatggcccgttcgtaatttagtaaccattaacagtattctagtggtggcctgccccgttcgatgaacttatgtgacactaggttgtaagaagatgggacactaattaatcttgatcttagaaatgcaatgtgatgtagatgatatcagtgcttttattatgatt

SEQ ID NO: 4290 - protein, 237 aa, Zea mays
  misc_feature (1)..(237): useful for making plants with increased salt and oxidative stress resistance as described in USSN 12/922,143
  misc_feature (1)..(237): Ceres CLONE ID no.336655
  misc_feature (1)..(237): Bit score of 313.6 for HMM based on sequences of FIGURE 15 of USSN 12/922,143.
  misc_feature (1)..(237): Functional Homolog Of Ceres SEEDLINE ID no. ME11932
MSPAPSSGKRGRVPDPEEDVYVDNLHSHKRYLTEIMASSMNGLSVGDSVPDNIMGSPMRVENASCIRDEMSMQYSPMSEESDDYRYYDTQVNTNGNQTDVLGNPSTSLISSAHRFQRPHTWFSSASPYPLPSCSLPAVICSPARRGCGTEQEGWIPSSPNDMCYGGDLRRTALLRSVQMKVQSPHPCDVHEREQGRSNVHADELQQDQKEAVGVQLDQRPLSCPKSTQDAKCQSSIH

SEQ ID NO: 4291 - protein, 315 aa, Oryza sativa subsp. indica
  misc_feature (1)..(315): useful for making plants with increased salt and oxidative stress resistance as described in USSN 12/922,143
  misc_feature (1)..(315): Public GI ID no.125550908
  misc_feature (1)..(315): Bit score of 658.0 for HMM based on sequences of FIGURE 15 of USSN 12/922,143.
  misc_feature (1)..(315): Functional Homolog Of Ceres SEEDLINE ID no. ME11932
MSPPSGGGKRGRDPEEDVYVDNLHSHKRYLSEIMASSLNGLSVGDSLVDNIMESPARSENTSYFRPCGRSTLFDDRTLAQVTFFNMPMNTHLDTHADDTSTLQDEIISQYSPMSEDSDDYRCYDTQLPNGSQTDAMVSPSTSPMSSPHRFQKPQSGLLSANPYPLPSCSLSSVVCSNPRRGSENEGRFPSSPNDMCHGGDLRKTALLRSVQMRVQGPHAYELSFCGRQEQEHAHDHEDEHQHEHLEGLEGAERSSSHRETISDGVGYQMPENSYGRPEHDIDYIEDCTPHGCLSDLKFKQEDKDCSKLTSMDKNR

SEQ ID NO: 4292 - protein, 288 aa, Oryza sativa subsp. japonica
  misc_feature (1)..(288): useful for making plants with increased salt and oxidative stress resistance as described in USSN 12/922,143
  misc_feature (1)..(288): Public GI ID no.115462191
  misc_feature (1)..(288): Bit score of 702.0 for HMM based on sequences of FIGURE 15 of USSN 12/922,143.
  misc_feature (1)..(288): Functional Homolog Of Ceres SEEDLINE ID no. ME11932
MVGGGGGGEAAMSPPSGGGKRGRDPEEDVYVDNLHSHKRYLSEIMASSLNGLSVGDSLVDNIMESPARSENTSYFRDEIISQYSPMSEDSDDYRCYDTQLPNGSQTDAMVSPSTSPMSSPHRFQKPQSGLLSANPYPLPSCSLSSVVCSNPRRGSENEGRFPSSPNDMCHGGDLRKTALLRSVQMRVQGPHAYELSFCGRQEQEHAHDHEDEHQHEHLEGLEGAERSSSHRETISDGVSYQMPENSYGRPEHDIDYIEDCTPHGCLSDLKFKQEDKDCSKLTSMDKNR

SEQ ID NO: 4293 - protein, 277 aa, Oryza sativa subsp. japonica
  misc_feature (1)..(277): useful for making plants with increased salt and oxidative stress resistance as described in USSN 12/922,143
  misc_feature (1)..(277): Public GI ID no.125592880
  misc_feature (1)..(277): Bit score of 684.6 for HMM based on sequences of FIGURE 15 of USSN 12/922,143.
  misc_feature (1)..(277): Functional Homolog Of Ceres SEEDLINE ID no. ME11932
MSPPSGGGKRGRDPEEDVYVDNLHSHKRYLSEIMASSLNGLSVGDSLVDNIMESPARSENTSYFRDEIISQYSPMSEDSDDYRCYDTQLPNGSQTDAMVSPSTSPMSSPHRFQKPQSGLLSANPYPLPSCSLSSVVCSNPRRGSENEGRFPSSPNDMCHGGDLRKTALLRSVQMRVQGPHAYELSFCGRQEQEHAHDHEDEHQHEHLEGLEGAERSSSHRETISDGVSYQMPENSYGRPEHDIDYIEDCTPHGCLSDLKFKQEDKDCSKLTSMDKNR

SEQ ID NO: 4294 - DNA, 885 bp, Sorghum bicolor
  misc_feature (1)..(885): useful for making plants with increased salt and oxidative stress resistance as described in USSN 12/922,143
  misc_feature (1)..(885): Ceres ANNOT ID no.6054932
atgggggccggaagcggagaggcggcgatgtctccgccgtcctccggcggcagcggaagcggcggcgggaagcgcgggcgggacccggaggaggacgtgtacgtggacaatctccactcccacaagcggtacctcagcgagataatggcgtccagtctgaatggactgtctgttggggattcactgcctgacaacatcatggagtcccctgcaaggtcagagactgcttcttgcttcagggatgagatattatcccaatactcgccaatgtcagaagactcagatgattaccggtgctatgacactcaattaaaccccagtgggaatcatcctgatgcgatgatcagcccttcaactagtccaatgtcatctccccaccgacaccagagaccacaatctcctctgttaccttcaaacccataccctctcccaagctgctccctttcatcggtagtctgctctcatgctcggcgtggctccgataatgaaggtcggttcccatcctcaccaaatgacatgtgccacggggcagatctgaggcgaacagcactgctgaggtcagtgcaaatgagggtgcagggaccccattcgtacgacctatcattcggcatgagacaaggacaagaacatgtacatgagcatgaagatgaacatgagcatgaacatctagaggatttggaaaggacagaaaggtcatcatcttgcaataagtcaatcgttgacgaaatcgcgtaccagagacctgaccatgattttggtcaaccagagcacgagatagattacatcaacaactgcacatcagatgattgtccaagtgacctaaaatttaagcatgaagataagagccatagtaaatttgatacccgtatggacaagaatacatag

SEQ ID NO: 4295 - protein, 294 aa, Sorghum bicolor
  misc_feature (1)..(294): useful for making plants with increased salt and oxidative stress resistance as described in USSN 12/922,143
  misc_feature (1)..(294): Ceres ANNOT ID no.6054932
  misc_feature (1)..(294): Bit score of 693.7 for HMM based on sequences of FIGURE 15 of USSN 12/922,143.
  misc_feature (1)..(294): Functional Homolog Of Ceres SEEDLINE ID no. ME11932
MGAGSGEAAMSPPSSGGSGSGGGKRGRDPEEDVYVDNLHSHKRYLSEIMASSLNGLSVGDSLPDNIMESPARSETASCFRDEILSQYSPMSEDSDDYRCYDTQLNPSGNHPDAMISPSTSPMSSPHRHQRPQSPLLPSNPYPLPSCSLSSVVCSHARRGSDNEGRFPSSPNDMCHGADLRRTALLRSVQMRVQGPHSYDLSFGMRQGQEHVHEHEDEHEHEHLEDLERTERSSSCNKSIVDEIAYQRPDHDFGQPEHEIDYINNCTSDDCPSDLKFKHEDKSHSKFDTRMDKNT

SEQ ID NO: 4296 - DNA, 783 bp, Sorghum bicolor
  misc_feature (1)..(783): useful for making plants with increased salt and oxidative stress resistance as described in USSN 12/922,143
  misc_feature (1)..(783): Ceres ANNOT ID no.6096924
atgtctccggcgcccagcggcggcaagcgcgggagggtccccgacccggaggaggacgtctacgtcgacaacctccactcccacaagcgctacctcaccgagataatggcatccagcatgaatggcttgtccgttggagattcagttgctgacagtgtcatggggtccccaatgagactggagaatgtttcttgcattagggatgagataagcatgcagtactcacgtgtgtcagaagagtcagatgattacagatactatgagactcaagtaaacaccaatgggaatcaaacagatgtactgggtaattcgtcaactagtccagcttcatctccacgccgtgtccagaagctacacaactggttctcttctgcatgttcatacactctcccaagctgctccctcccagcagtggtctgctcgcctgctccccgtggttgtggcactgaacaggaaggccggatcccatcctcacctaatgacatgtgccatggtggagatctgaggcgagctgcacttttgagatcggtgcaaatgagggctcagagcccccatccatgtgatgtgctacccagcggtggacatgaacaagaacaagggctttctgatgtacatgctgacgagcttgaacaggatcagaaagaagctgtgggtgtacagttggatcaaaggcctctctcttgtccaaagtcaacccaggatgctgagtaccagagccctataaaccgagaccaacatcctcaccatgacgttgattttgtcaaggatcagattacggtgtga

SEQ ID NO: 4297 - protein, 260 aa, Sorghum bicolor
  misc_feature (1)..(260): useful for making plants with increased salt and oxidative stress resistance as described in USSN 12/922,143
  misc_feature (1)..(260): Ceres ANNOT ID no.6096924
  misc_feature (1)..(260): Bit score of 303.6 for HMM based on sequences of FIGURE 15 of USSN 12/922,143.
  misc_feature (1)..(260): Functional Homolog Of Ceres SEEDLINE ID no. ME11932
MSPAPSGGKRGRVPDPEEDVYVDNLHSHKRYLTEIMASSMNGLSVGDSVADSVMGSPMRLENVSCIRDEISMQYSRVSEESDDYRYYETQVNTNGNQTDVLGNSSTSPASSPRRVQKLHNWFSSACSYTLPSCSLPAVVCSPAPRGCGTEQEGRIPSSPNDMCHGGDLRRAALLRSVQMRAQSPHPCDVLPSGGHEQEQGLSDVHADELEQDQKEAVGVQLDQRPLSCPKSTQDAEYQSPINRDQHPHHDVDFVKDQITV

SEQ ID NO: 4298 - DNA, 1939 bp, Arabidopsis thaliana
  misc_feature (1)..(1939): useful for making plants with increased salt and oxidative stress resistance as described in USSN 12/922,143
  misc_feature (1)..(1939): Ceres SEEDLINE ID no.ME24091
  misc_feature (1)..(1939): Inplanta Sequence
acaaatactcttcttcacacagctttgaatccatctgtcttctcctctctctctcttctccatttgcaattacgataatgtgaaagcaataagaagaggaaaagttatcttcgcacctcagcaaagatccaatcgattcgattcttaagctttttcgtcttctccgataaggtcactacttagaagccgcgttgtggtttagttgactcctccaggttttatcttcaagctttttcgtctatcagatctggtgtcactgtcttctcataggattacatagagatggggaaaaaagctaaatggttttcaagtgttaagaaagcattcagcccagattcaaagaagtcgaagcaaaaattggctgagggacaaaatggtgttatctctaatcctcctgttgtggataatgttagacaatcttcttcttctcctcctcctgctcttgctcctcgtgaagtgagagtagctgaagtgattgttgaacggaacagggatctttcacctccttctacagcagatgctgtgaatgttacagctactgatgttcctgtagttccatcttcatctgctcctggtgttgttcgtcgcgctacacctactcgatttgctggaaagtcaaacgaagaagccgctgctatcttgatccagactatatttagaggttatttggcaaggagagcgttgcgggcaatgaggggtttggtcagacttaagttattgatggaaggatctgttgttaagcggcaagctgcaaatactctaaaatgtatgcagactctctctcgtgtacagtcgcagatccgagctaggagaatcaggatgtcagaagagaatcaggctcgccagaaacaactccttcagaaacatgctaaagagctagctggcttgaagaacggggataactggaatgatagcattcaatcaaaggagaaagttgaagcgaatttgctaagcaagtacgaggcaacaatgagaagggaaagggcattggcttattcatactctcatcagcaaaactggaagaacaactctaaatctggaaacccgatgttcatggatccaagcaacccgacatggggttggagctggttggagagatggatggctggtaggccactagagagttccgagaaagaacaaagcaacagcaacaatgacaatgctgcctcggtcaagggctctattaaccgcaacgaagctgcaaaatctctaacccgcaatggctcaactcaaccaaacacaccatcatccgcaagagggaccccaagaaacaaaaacagtttcttctcacctccaactccctcaaggctaaaccaatcctcgaggaaatccaatgacgacgactccaaaagcacaatctcggtcctgtccgagaggaaccgcagacacagcattgctggttcatcagtcagagacgatgagagcctcgctggctcaccagctctcccgagctacatggttccaactaaatcagctcgagccaggctcaagccccaaagcccattaggtggtaccacacaggaaaacgaagggttcacagacaaggcatcagctaagaaacggctctcgtatccaacttcgcctgcattgcctaaaccacggcggttctcagctccccctaaggtggagagtggcggcgttaccgtgaccaacggagcaggcagctgaggtattttatttaatataattattttcccacttatgaatgtgtccgagattgttgtctcttatgtgttcccttcatttcgtaattcatttgtgcagtgtaagcgccagtcatttatttttttactataataaattttataaccttttaaaattcatgttcttttgtttctttgaatatttaagttatttttattaatgttggatgaattggaatatgatgatgttatttgtattgtaatgcagatcctttaaagcaaaaaaaaaaaaaaaa

SEQ ID NO: 4299 - protein, 461 aa, Arabidopsis thaliana; identical to SEQ ID NO: 3413
  misc_feature (1)..(461): useful for making plants with increased salt and oxidative stress resistance as described in USSN 12/922,143
  misc_feature (1)..(461): Ceres SEEDLINE ID no.ME24091
  misc_feature (1)..(461): Bit score of 1104.1 for HMM based on sequences of FIGURE 16 of USSN 12/922,143.
  misc_feature (115)..(135): Pfam Name: IQ Pfam Description: IQ calmodulin-binding motif

SEQ ID NO: 4300 - DNA, 1726 bp, Gossypium hirsutum
  misc_feature (1)..(1726): useful for making plants with increased salt and oxidative stress resistance as described in USSN 12/922,143
  misc_feature (1)..(1726): Ceres CLONE ID no.1942871
gtttcttcttcaatttgtctgaaaaacataacctttccttcttctcaagatctgtttttgttctttctctgtaactgtttaccgacacacacacaaaaaaaaagttcgttcttccgaatttcttgagatctgggcattattgtttcaggatcatatcgaggaaagaaaagatggggaagaaagtaaaatggctatcttctttaaagaaagccttcaatccagagtcaaaggaaaagaaaaatcagattttggataagcaagtgcatttgggtcctagtagttctaatgcggctgcacccacattagaaactgttaatttgtcccctccacctcagccggaagatgagaaaataatcaaacccgagacggttgctgaagctaccgatgatgatgttgttgttgctccagctgttccgaccccggctgctgttacggtcgttcaacgccgacttaatatagactctcggtttgctggaaaatctatggaggaagttgcagcgatcaaaattcagacagcttttcgagtttacatggcgaaaagagcattgtgtgctttacgaggacttgtgaggctgaaatcgttaatggaaggacctgcggtgaaacggcaagtgacgagtacccttcgttgtatgcaaacactttctcgtgtgcagtgtcagattcggatgaggagaatccgtatgaccgaagaaaatcaagctcttcagagacaaatcttgcagaaacatgcgaaagagcttgtgaatttgcagatgggggaagattgggacgatagcttgcaatcgaaggaacaaatcgaagcgagcttattgagcaaacacgaggctgcaatgagacgagaaagggcaatggcttattcatttactcatcagcaaacttggaagaacggttcgaaatctatgaatccgttattcatggatatgaacaacctgacgtggggttggagttggttagaacgatggatggcagctcgaccatgggaaggacgtggcgtgacgggaaaggaaccgaacaacgaccagtcatcggtaaagagtgcacatttcgaaggagaaatcagcaaagcttacgctcgttaccaactcaatttggataataaacaatccccgaaatcgagccaaaagcctaaccgaacatcaagtcacctatccccttctccgaaaccaccttccacaccatccccaaagctgaagtccgcaagccctagcggcagtatcattgcccaggacgacgacacaagaagcatagtcagcgcgcaatccgaacggaaccgaagacacagcattgccggctcattggtgcgtgacgacgagagcttagcaagctcgccgtcacttccgagttatatggtaccaactaaatcggcaagagccaaaaccaggttgcaaagtcccttgggactagaagcaaatggtacacccgacaaaggaccgatcatgtcgaccaaaaaacgactcttgtatccaccttcaccggccaaaccgaggcggcactctggtccaccgagagtcgataccagcattattactaatacaaaaattggtgcggtgaatggtggtgtcatttaatttctctatatttttaattcatacaggttttatttgtgagatttgagaacaaactacgcataatttttagttcattgacaatttgttcattataattcttgtgctggtgttgtattgatttgtataataaattatatacattacttgtttatttt

SEQ ID NO: 4301 - protein, 466 aa, Gossypium hirsutum
  misc_feature (1)..(466): useful for making plants with increased salt and oxidative stress resistance as described in USSN 12/922,143
  misc_feature (1)..(466): Ceres CLONE ID no.1942871
  misc_feature (1)..(466): Bit score of 1177.5 for HMM based on sequences of FIGURE 16 of USSN 12/922,143.
  misc_feature (107)..(127): Pfam Name: IQ Pfam Description: IQ calmodulin-binding motif
  misc_feature (1)..(466): Functional Homolog Of Ceres SEEDLINE ID no. ME24091
MGKKVKWLSSLKKAFNPESKEKKNQILDKQVHLGPSSSNAAAPTLETVNLSPPPQPEDEKIIKPETVAEATDDDVVVAPAVPTPAAVTVVQRRLNIDSRFAGKSMEEVAAIKIQTAFRVYMAKRALCALRGLVRLKSLMEGPAVKRQVTSTLRCMQTLSRVQCQIRMRRIRMTEENQALQRQILQKHAKELVNLQMGEDWDDSLQSKEQIEASLLSKHEAAMRRERAMAYSFTHQQTWKNGSKSMNPLFMDMNNLTWGWSWLERWMAARPWEGRGVTGKEPNNDQSSVKSAHFEGEISKAYARYQLNLDNKQSPKSSQKPNRTSSHLSPSPKPPSTPSPKLKSASPSGSIIAQDDDTRSIVSAQSERNRRHSIAGSLVRDDESLASSPSLPSYMVPTKSARAKTRLQSPLGLEANGTPDKGPIMSTKKRLLYPPSPAKPRRHSGPPRVDTSIITNTKIGAVNGGVI

SEQ ID NO: 4302 - DNA, 2163 bp, Gossypium hirsutum
  misc_feature (1)..(2163): useful for making plants with increased salt and oxidative stress resistance as described in USSN 12/922,143
  misc_feature (1)..(2163): Ceres CLONE ID no.1886384
aaacttttattccttccgtaaaggttcttctttgtttaaaactcaatttttattcctaatatctactgttcccccatgattttgcctcttaagatgggaaagaaagggaaatggttgtcctctctaaagaaagccttcttctcagagtccaagggaaagaaaaaccagaaatcaaaagaacaatttttggagaaggtgcatttggatcccactggttctgatgcagccaagttatccccacttcctcagcctgaagaggtgaaattaattgaacctgaagttgagcaaagcaagcagacttaccctgtggcagttgccaattctcctgccgttccagctcaggttgctctacaggccattcgacatcaacttaatacagatgctaggtttgccggaaaatctaaggaggaagtggcggcaatcaaaattcaagcagctttccgagcttaccttgcaaaaagggcattgcgtgctttaagaggactggctaggttgaaatcactgatggaagggcctgccgccagacggcaagcagccggttcccttcggtgcttgcagactctttctcgtatgcagtgtcagattcatgctcggagaaccaggatgatggaagaaaaccaggctcttcagaggcaactcttgcagaaacatgcgaaagagattgtgaacttgcaaatgggtgaagattgggatgacactgtgcggtcaaaggaacaaattgaggcaagcttgttgagcaaacatgaggctgccatgagaagagaaagggccatggcgtactcatttactcatcagcaaacctggaagaatgcttcgagatctatgaatccattgttcatggatccaagcaatccctcatggggatggagctggatggaacggtggatgacagcccggccatgggaggttcgtggtggcatgagagataaagaacatctcgatgaccagtcatccctaaagagtgcacgaagcaacttcggtggagaaatcagcaaagcttatgctcgttatcaactcaatttggataagcaatccacgaaggccaaccaaaagccaagccgaacttcgagcctcctatccccttctactcctaagtcagcatccataccagcccgaaagctgaagtcagcaagcccgaggagtggtgtggctggtttagatgatgaaacaagaagcatagtcagtatgaagtctgacagaaaccggagacacagcatcgcaggctcctcagtgcgtgataatgagagccttgccaactctccatcacttccaagttacatggtaccaactaagtctgcaagagttaagaccagtttgcagagccccttgggaccagaagcaaatggaacacctgagaaggatccaattggatctgctaagaaacggctttcttatccgccttcaccggccaggctaaggcgccactcctgtctgccaaaagtggacggtagcattagcaatacaaaagttgcagtggtgaatggaggggacggttttttcaaataaaaaagagatgaagtcctgatgcacgctaatccagaagaatcggaaaagaagagagaaactttgtatgtttcaaaagttagttaactaacgggattgtcgttgcacccaaaacaccccgttttcattaaagtgttgcatcgttttattaactttgagccctagtattttaaaaaaaatagtagagatctcttcttgctctctctcccttttcttgcggctagggttttgaaacccctcatcgccgttgttgccacggtgccaccacaagcggtggtaagggcggtgcgagctggcctaccctgaggtgtccccgaaggccaagccttcttaacccaaaagttgcgaaagaaaggtcttcccctccttattcggtccgatcccggtgacggaggagagccctccgcgaagaaatcacgagcgattccagtgttgcgcgacgaatggaagaggtggcgtgtggtgcgatgaaacggcgcgcgttggtggccatgctggtggggagcggcggctgaaggcttggtggctagggtttgctgaaaattttgtttgtgttgtgggcttggactattagggtttgtgaattaggtttgggtattgtcttatttgggccattttaatatataaagggactgttaataaacatttggattttcaccc

SEQ ID NO: 4303 - protein, 470 aa, Gossypium hirsutum
  misc_feature (1)..(470): useful for making plants with increased salt and oxidative stress resistance as described in USSN 12/922,143
  misc_feature (1)..(470): Ceres CLONE ID no.1886384
  misc_feature (1)..(470): Bit score of 953.8 for HMM based on sequences of FIGURE 16 of USSN 12/922,143.
  misc_feature (106)..(126): Pfam Name: IQ Pfam Description: IQ calmodulin-binding motif
  misc_feature (1)..(470): Functional Homolog Of Ceres SEEDLINE ID no. ME24091
MGKKGKWLSSLKKAFFSESKGKKNQKSKEQFLEKVHLDPTGSDAAKLSPLPQPEEVKLIEPEVEQSKQTYPVAVANSPAVPAQVALQAIRHQLNTDARFAGKSKEEVAAIKIQAAFRAYLAKRALRALRGLARLKSLMEGPAARRQAAGSLRCLQTLSRMQCQIHARRTRMMEENQALQRQLLQKHAKEIVNLQMGEDWDDTVRSKEQIEASLLSKHEAAMRRERAMAYSFTHQQTWKNASRSMNPLFMDPSNPSWGWSWMERWMTARPWEVRGGMRDKEHLDDQSSLKSARSNFGGEISKAYARYQLNLDKQSTKANQKPSRTSSLLSPSTPKSASIPARKLKSASPRSGVAGLDDETRSIVSMKSDRNRRHSIAGSSVRDNESLANSPSLPSYMVPTKSARVKTSLQSPLGPEANGTPEKDPIGSAKKRLSYPPSPARLRRHSCLPKVDGSISNTKVAVVNGGDGFFK

SEQ ID NO: 4304 - DNA, 1880 bp, Gossypium hirsutum
  misc_feature (1)..(1880): useful for making plants with increased salt and oxidative stress resistance as described in USSN 12/922,143
  misc_feature (1)..(1880): Ceres CLONE ID no.1919901
aacttttcttagttatcctctgcaaatgccaacctgttcttttattattattttccgccatttttgctctctttcaagcattttttttttgcctagatccacttctctctctttgatttttaattactgcatttttgttttaatacacaataagaacaactaagagatagaatgtgacttatcaatcttttaactgagatctgtgagaatttttctatgtaccaaggaattatttacagatgggaaaaaaaggtggctggctttctattgtgaagaaagctttgagccctgaatccaagaaatctcagcaccaaactccaaagccaaagaaaaaatggttcggaaaaagcaaaaatttgagccctgtgtctgtgcctgaagaaactgaagtgataactgaagatgcaaagctaaaagaagctgaaaacgaacaaagcaaacatgcctactctgtggctcttgccaccgctgtggcggccgaggcagcggtggcagctgctcaggcggctgctgaagttgtccgtctcacttctcagccgcgccatctggggaagtcaaaggaggaaatagctgctatcaggattcaaacagcatttcgtggatatttggctaggagggcactgcgagctttgagagggttggtaaggttgaaatcgttgatcagagggcaatccgtcaaacgccaagcaactacaacgttaagatgcatgcagactctagctcgtctgcagtctgagatttctgcaaggaggattagaatgtcagaagagaaccaggctcttcagcgccagcttcaacagaaatgccagaaagagctcgagaagttgagagctcccatgagagaagactggaacgatagtacacagtcgaaggagcagatcgaagcaagacaacaaaataagcaaggagctactatgaaaagggaaagagcattggcttatgcatactgtcaccagcgatcgtggaagaactgttctagatcagtgaatcaaacatttatggatccgagtaattcacactggggttggagttggttagagcgatggatggcagcccgaccatgggaagtccaaagcacaactgataacaatgaccgtggctcagtcaagagtatgggtgcttgttcgatatctataagtgaaatcagcagagcttattctcgaagagatcttaacaatgataacaaaccatctccaacacctcagaagtcaagtcgagttcctagccgccagtctccatcgactccaccttcaaaggcaccttcgatttcatcggtttctggtaaaacaagactgccaagtccgagaggaagtcaatggggagggtatgaagactcaaggagcatactcagtacccggtctgatcgttataggagacatagcattgcagggtcctcaatgagagacgatgagagccttacaagctcacctgcagttccaagttatatggcaccaacacagtccacaaaggccaggtcccacataccaagccccttaggaagtggcacaccagataggagagtggcagggtctgcaaagaaacggcttttgttcccagcatccccagccagtagtaggagacattcagagcctcctaaagtggacataagtgaggctagaaagaatcagcatgcaccaagcaatggaaggcaagtggcttggtgaagagtgcaacaaaagttagattgaataaacatggaagggttatttcaacttgaagttcttgtagtgtggttgtgattatctttttcttcctaggttttatgattattaattataaaagggttacttttttctgggtgagatttagtttattgtttgtggttgacaaacattcttaaaaatcttcaagtttagtttcaattcatgaaatttgtaatt

SEQ ID NO: 4305 - protein, 474 aa, Gossypium hirsutum; identical to SEQ ID NO: 3397
  misc_feature (1)..(474): useful for making plants with increased salt and oxidative stress resistance as described in USSN 12/922,143
  misc_feature (1)..(474): Ceres CLONE ID no.1919901
  misc_feature (1)..(474): Bit score of 762.7 for HMM based on sequences of FIGURE 16 of USSN 12/922,143.
  misc_feature (109)..(129): Pfam Name: IQ Pfam Description: IQ calmodulin-binding motif
  misc_feature (1)..(474): Functional Homolog Of Ceres SEEDLINE ID no. ME24091

SEQ ID NO: 4306 - DNA, 1475 bp, Gossypium hirsutum
  misc_feature (1)..(1475): useful for making plants with increased salt and oxidative stress resistance as described in USSN 12/922,143
  misc_feature (1)..(1475): Ceres CLONE ID no.1829581
attattttcaatgcaatttaagagttttatttattttatgttataaattttttaacctctaaatatgatttgaaatgttaattccattggttgtttttggttttgaaggagaatttattgaggaatgggcaaaaaaggaagctggtttactgctgtgaagaaagttctaagccttgaacccaacaaagaagagaagattcaaaaatccaagaaaaatggggttaaattacctgagaagatcaaaggaagcaaacgtgacaactggttcgctccggccaccaccatggtgaccggcgcgttggttcgccttactttgtcgccacactacttgggaaaatcaatggaggaaatagctactgttaagattcaaactgtgtttcgaggatacctggcgaggaaggcattgcgagatttgagagggttagagaggttgaaatcattgatacaagggcaatccatgaaacgacaagccactattacgttacgatgcatgcggacacttgctcgagtgcagtcccaaactcgaacaaggcaactcagagtgtctgaacaaaaccgagcacttcaaaagcatcttcaaactaaatacgaaaaacagttgcaaaattccaaatcttacatgggagaagattggaatgtaagtactaagtctaaagagcaaatgcaagcaaaacaacaatatagacaagtagcagccatgcgaagggagagagctttagcttactcatttactcatcagcgatcctggaaggtcacttgtagatcgatgaatcacacatctatggatccatttaatcctaaatggagctggagttggttagagcgatggatgtcaactcgaccatgggagattcaaaatgcaccggataacaatgatcatggcccaagtaagagtgttggtgctgagataaccaaagctaagtctcaaagtgatgttaacaatgatcacaataaacaatcttcaacaccggcaaaaccgattcgacctccgaaccgtaggtcctcttcgactccaccgtctaaaacgcattctatttctagcaagaagggattggaaagccccagtccgacacgaattcagttgcctgattgttacaagaggcatagcatcggaggcttatcattggagagagacgatgaggtctttgcaaactcaccacctaataataaaataccggcacgttcgtcatcaaaggaccggtctcgaccaccgagcattaatagaaatccagttaatactaggagacattctggtcctccgaaagttgatattttttccaactaaggaagaaatgccaaacaatgacaaaggcaggtagtttatgaagcatagacactttagtcgcgagtgccggccacatgtttaatattgaaatggctccgacacaatcaaatgtgtgttggttatatgacgatatattttttcaaaaaatcaaatactatcagaaaaaaatataaagaaagattaattggat

SEQ ID NO: 4307 - protein, 386 aa, Gossypium hirsutum; identical to SEQ ID NO: 3406
  misc_feature (1)..(386): useful for making plants with increased salt and oxidative stress resistance as described in USSN 12/922,143
  misc_feature (1)..(386): Ceres CLONE ID no.1829581
  misc_feature (1)..(386): Bit score of 300.2 for HMM based on sequences of FIGURE 16 of USSN 12/922,143.
  misc_feature (75)..(95): Pfam Name: IQ Pfam Description: IQ calmodulin-binding motif
  misc_feature (1)..(386): Functional Homolog Of Ceres SEEDLINE ID no. ME24091

SEQ ID NO: 4308 - DNA, 1993 bp, Gossypium hirsutum
  misc_feature (1)..(1993): useful for making plants with increased salt and oxidative stress resistance as described in USSN 12/922,143
  misc_feature (1)..(1993): Ceres CLONE ID no.1924993
gagagagaaaaaaattgaaaaaaaattgaaaaaaaattgaaaaaaaatctagagagagagtataagaggtcttaagtagagtgaagaactgaggtcttaaggtcgactgaggtttgactttgctgattgatttttgattgattgttgatagatcataatcaatcaatcggttggaaaaggaatgtgagaatgagaagcttgctggagaattcatgggtgcttaactcttcattaacaaagtgactcttataaagtatcctagttccttgatttcgaagccaagattgaaaggtccgcccatattaagttgatttgtcattgttggtgccatgggtgtctcaggaaaatggatcaaagcactagtgggcttgaagaaatcagaaaagtctcaatcttcagagaaagtagaaaatagagcaactggtagcaaatttcgtcaccgaagaaagcattcggttgagtttgatacaaatgaacttcaagaagagttggatgagaatgctgcttcactagctgaaaatgctacttgtgcaactatagatgctgctggctgtccttctgatgcacttgaagtgcatgatgcacctcttaatgaacatgcaagggaagaatgggctgccacgaggatacaaactgctttccgaggatttctggccagaagagcactgcgagcattaaaaggattggtaagactgcaggcccttgtcaggggtcatgctgtaagaaaacaagctgctataactcttcgctgcatgcaagctttggttagagttcaggctcgtgtaagagcaaggcgtgttcggctggcattagaaaatcaaactgcacaacagaaacttcagcaacaacttgcaaatgaggcacacgttaaagaaatagaggaagggtggtgtgatagtataggatccgttgaagaaattcaagcaaagttactgaaaaggcaggaagctgcagctaaacgtgagagagccatggcatatgctctggctcatcagtggcaagcaggatcaagacagcagtcagtgcctgctggatttgaaccagataaaagcagctggggttggaactggttggagagatggatggctgtacgtccatgggagaatcgtttccttgacattaatcttcgagatggagtaaagatacgcgaggatagtcctgctgagggaaagaatgatgccagttctcagataaaacctgctatcgggaaaccagctgcatcaagtcttcatgctaacctttcaaataaaaaaacaggtccatcccactttgatgggagcgattccccacctggtaagtctgcatgtgtgcttgaagcagtgaatgcgccatcttccaagccaaaatccaaaccaaatcgtgaagattctgttgaagaagctggctcaggacctgttattagttcaagatctcatagcaatcctaaagagaggcggacacagtctgataaactggccaagaggcgattgtctatgccaaacactggtggggttattgtgtcccaaacaactaagctgagcaaaactgctgcaaaaccgaaccctggcccccacaaacctataagggataggtccaagttaaacggacgagactcaaatcccacaaaacctgtagcaaaggctgttgatctgtaaggaagtatttgtgaagacaagcctgttcgggctgccatccatcctgttgctttagtatgtatatatcaaattacagttggttcgacatgttataaaggcattgtttgttctcctgtcatataatcaaggattggctttgccgtggtgggagtagttactccgtggcatattcaaggagactggttcggtggcttgttacgagaaaaacattggtgagatttaatcagcttgtgtttaatgtttgtcaattatgtgatcacattgtatttattttcaagtgtatgatttccatagaagatgccctttgaattgctcttttttgagtttttttattaaacctcttggctcggttgctgctg

SEQ ID NO: 4309 - protein, 367 aa, Gossypium hirsutum
  misc_feature (1)..(367): useful for making plants with increased salt and oxidative stress resistance as described in USSN 12/922,143
  misc_feature (1)..(367): Ceres CLONE ID no.1924993
  misc_feature (1)..(367): Bit score of 63.4 for HMM based on sequences of FIGURE 16 of USSN 12/922,143.
  misc_feature (94)..(114): Pfam Name: IQ Pfam Description: IQ calmodulin-binding motif
  misc_feature (1)..(367): Functional Homolog Of Ceres SEEDLINE ID no. ME24091
MGVSGKWIKALVGLKKSEKSQSSEKVENRATGSKFRHRRKHSVEFDTNELQEELDENAASLAENATCATIDAAGCPSDALEVHDAPLNEHAREEWAATRIQTAFRGFLARRALRALKGLVRLQALVRGHAVRKQAAITLRCMQALVRVQARVRARRVRLALENQTAQQKLQQQLANEAHVKEIEEGWCDSIGSVEEIQAKLLKRQEAAAKRERAMAYALAHQWQAGSRQQSVPAGFEPDKSSWGWNWLERWMAVRPWENRFLDINLRDGVKIREDSPAEGKNDASSQIKPAIGKPAASSLHANLSNKKTGPSHFDGSDSPPGKSACVLEAVNAPSSKPKSKPNREDSVEEAGSGPVISSRSHSNPKE

SEQ ID NO: 4310 - DNA, 2002 bp, Gossypium hirsutum
  misc_feature (1)..(2002): useful for making plants with increased salt and oxidative stress resistance as described in USSN 12/922,143
  misc_feature (1)..(2002): Ceres CLONE ID no.1883742
gctgacatctctcttttttcgggttcgggtcgttcttacctgcatttccatcatgtttcatggttgagaacttgaattctttgtcttaaaaggtttatgattgtgtgttgtgtgtatacatatcgacggtatcgatatatttcgggtgcattgaatttggccctgcagagttttcgttcttcggtttcagtaatgctggcagtatgggaaagaaaggaagttggttttctgcaatcaaaagagttttcgtatcgaattcgaaggggaagctagatattgaatcggacaaaaagggcggtaaagaaaggaagaagaaaggtcaagcaaattacaagcatggagaagctaattccttcattcccctgtttagggaaccgagtagtatcgagaaaattctcggggaggctgaaagagatcggaaactatcgttccggccttcaacaccaccggatcaacttagaacaccacctttcatgcttcctagggctgcgtctcctcgtgttcgttctcaaaggattgcctcaccaagggctgcttctccgaagactgcttcttctccacgagccaattcacctagagctgcttctccgtttctgcctccacctccaagagctgcttctccgagagcaggacctcctaggcttgttcgtcctagactggaaccaacgttaaggaaccatcatgcttcagctacaaagattcaagcagcctatcggggttacatggcaaggagaagttttagagctttgaaaggcctcgtaaggcttcaaggagttgtgagaggtcacaatgtgaaacgtcaaactattacggccatgaaatatatgcagcttttggttcgagttcagtctcagattcagtcacgccggatccaaatgttagaaaatcaagcacgacgtcaagctcagtttaagaacgacaaggaggccgacatcggcaaattgacctttggccagtccgagacagggaatgaaaactgggatgatagcttgctgacaaaggaagaaatcgaggcaagaatgcagagaaaggtggaggcagtcatcaaaagagaaagggccatggcgtatgcatattctcaccagctatggaaagatgcaatgaaatcacctcacacaggtgtacccaacattcggtctggtgtattcccatggtggtggaactggttagaacgtcgattaccaccaaccgatttacccgaaaaccaagccacaaagaccttccaatttacaccaaggccaaactccgaattaaagcctagtccgaggccacaatccagtcagttcacattcgacaacatcattgacatccctacaccgaaatcgacaaggtccaccattctccccaccacaaggccaatgcaaacaccaacacctccaagtaaacttgtgccgcaagcaacaaactcagggttattaaactcaaagcattcacgaccccgacctaccataatcgattcaccatcaaacttaccactcaaagacgacgacagcctcacgagttgcccaccgttttcggtcccaaactacatgacaccaacagtttcagctaaagccaaagcgagagccaatggcaacatgaaagagaggttcatggggacacctgggaacgaatcgaagaggcgactttcattcccgttaacgcaagggatagtcggatcgttcaaatggagtaaagggtcgtcgttgttttcgggcaaggattcaaggtcacaaagggggttagataagcatcaaacattgcaatcgttggggaatttgagtgtggattctactgtttctatgcctgctacgatgggaagaaagccatttaatagatttgtgtgatttgttgttcaatttgggtatttttttaaaattgagtgaatgatgatatgttgaattcataaaattttctcatgtaaaataaaaaagaacagaaactaaaggaaaatggtgctttgaatgttgaagactttaggggtatggagagatattatagtaaattttctttattttttatt

SEQ ID NO: 4311 - protein, 540 aa, Gossypium hirsutum
  misc_feature (1)..(540): useful for making plants with increased salt and oxidative stress resistance as described in USSN 12/922,143
  misc_feature (1)..(540): Ceres CLONE ID no.1883742
  misc_feature (1)..(540): Bit score of 62.1 for HMM based on sequences of FIGURE 16 of USSN 12/922,143.
  misc_feature (160)..(180): Pfam Name: IQ Pfam Description: IQ calmodulin-binding motif
  misc_feature (1)..(540): Functional Homolog Of Ceres SEEDLINE ID no. ME24091
MGKKGSWFSAIKRVFVSNSKGKLDIESDKKGGKERKKKGQANYKHGEANSFIPLFREPSSIEKILGEAERDRKLSFRPSTPPDQLRTPPFMLPRAASPRVRSQRIASPRAASPKTASSPRANSPRAASPFLPPPPRAASPRAGPPRLVRPRLEPTLRNHHASATKIQAAYRGYMARRSFRALKGLVRLQGVVRGHNVKRQTITAMKYMQLLVRVQSQIQSRRIQMLENQARRQAQFKNDKEADIGKLTFGQSETGNENWDDSLLTKEEIEARMQRKVEAVIKRERAMAYAYSHQLWKDAMKSPHTGVPNIRSGVFPWWWNWLERRLPPTDLPENQATKTFQFTPRPNSELKPSPRPQSSQFTFDNIIDIPTPKSTRSTILPTTRPMQTPTPPSKLVPQATNSGLLNSKHSRPRPTIIDSPSNLPLKDDDSLTSCPPFSVPNYMTPTVSAKAKARANGNMKERFMGTPGNESKRRLSFPLTQGIVGSFKWSKGSSLFSGKDSRSQRGLDKHQTLQSLGNLSVDSTVSMPATMGRKPFNRFV

SEQ ID NO: 4312 - DNA, 1837 bp, Gossypium hirsutum
  misc_feature (1)..(1837): useful for making plants with increased salt and oxidative stress resistance as described in USSN 12/922,143
  misc_feature (1)..(1837): Ceres CLONE ID no.1884797
aagaaaggtgagggaggctagaaaagaagagcgacttctttttgtaagatcgacggtatcgatatatttcgggtgcattcgattaggccctgcagagttttcgttcttcggtttcagtaatgctggcagtatgggaaagaaaggaagttggttttctgcaatcaaaagagttttcgtatcgaattcgaaggagaaactaaatattgaatcggataaaaagggcggtaaagaaaggaagaagaaaggtcaagcaaattacaagcatggagaagctaattccttcattcccctgtttagggaaccgagtagtatcgagaaaattcttggggaggctgaaagagatcggaaactatcgttccggccttcaacaccaccggatcaacttagaacaccacctttcatgcttcctagagctgcgtctcctcgtgttcgttctcaaaggattgcctctccaagggctgcttctccgaagactgcttcttctccacgagccaattcacctagagctgcttctccgtttctgcctccacctccaagagctgcttctccgagagcaggacctcctaggcttgttcgtcctagactggaaccaacgttaagaaaccatcatgcttcagctacaaagattcaagcagcctatcggggttacatggcaaggagaagttttagagctttgaaaggcctcgtaaggcttcaaggagttgtgagaggtcacaatgtgaaacgtcaaactattacggccatgaaatatatgcagcttttggtccgagttcagtctcagattcagtcacgccggatccaaatgttagaaaatcaagcacgacgtcaagctcagtttaagaaagacaaggaggccgagagcggcttcggcaaatggacctttggccagtccgagacagggaatgaaaactgggatgatagcttgctgacaaaggaagaaatggaggcaagaatgcagagaaaggtggaggcagtcatcaaaagagaaagggccatggcgtatgcatattctcaccagctatggaaagatgcaatgaaatcacctcacacaggtgtacccaacattcggtccggtgtattcccatggtggtggaactggttagaacgtcgattaccaccaaccgatttacccgaaaaccaagccacaaagaccttccaatttacaccaacaatgccaaactccgaattaaagcctagtccgaggccacaatccagtcagttcacattcgacaacatcattgacatccctacaccgaaatcgacaaggtccaccattctccccaccacaaggccaatgcaaacaccaacaccaccgagtaaacttgtgccgcaagcaaccaactcagggttattaaactcaaagcattcacgaccccgacctaccataatcgattcaccatcgaacttaccactcaaagatgacgacagcctcacaagttgcccaccgttttcggtcccgaactacatgacaccaacagtttcagctaaagccaaagcgagagccaatggcaacatgaaagagaggttcatggggacacctgggaacgaatcgaagaggcgactttcattcccattaacgcaagggatagtcggatcgttaaaatggagtaaagggtcgtcgttgttttcgggcaaggattcaaggtcacaaagggggttagataagcatcaaacattgcaatcgttggggaatttgagtgtggattctactgtttctatgcctgctacgatgggaagaaagccatttaatagatttgtgtgatttgttgttcaatttggttatttttttaaaattgagtgaatgatgatatgttgaatttataaaattttctcatgt

SEQ ID NO: 4313 - protein, 543 aa, Gossypium hirsutum
  misc_feature (1)..(543): useful for making plants with increased salt and oxidative stress resistance as described in USSN 12/922,143
  misc_feature (1)..(543): Ceres CLONE ID no.1884797
  misc_feature (1)..(543): Bit score of 61.0 for HMM based on sequences of FIGURE 16 of USSN 12/922,143.
  misc_feature (160)..(180): Pfam Name: IQ Pfam Description: IQ calmodulin-binding motif
  misc_feature (1)..(543): Functional Homolog Of Ceres SEEDLINE ID no. ME24091
MGKKGSWFSAIKRVFVSNSKEKLNIESDKKGGKERKKKGQANYKHGEANSFIPLFREPSSIEKILGEAERDRKLSFRPSTPPDQLRTPPFMLPRAASPRVRSQRIASPRAASPKTASSPRANSPRAASPFLPPPPRAASPRAGPPRLVRPRLEPTLRNHHASATKIQAAYRGYMARRSFRALKGLVRLQGVVRGHNVKRQTITAMKYMQLLVRVQSQIQSRRIQMLENQARRQAQFKKDKEAESGFGKWTFGQSETGNENWDDSLLTKEEMEARMQRKVEAVIKRERAMAYAYSHQLWKDAMKSPHTGVPNIRSGVFPWWWNWLERRLPPTDLPENQATKTFQFTPTMPNSELKPSPRPQSSQFTFDNIIDIPTPKSTRSTILPTTRPMQTPTPPSKLVPQATNSGLLNSKHSRPRPTIIDSPSNLPLKDDDSLTSCPPFSVPNYMTPTVSAKAKARANGNMKERFMGTPGNESKRRLSFPLTQGIVGSLKWSKGSSLFSGKDSRSQRGLDKHQTLQSLGNLSVDSTVSMPATMGRKPFNRFV

SEQ ID NO: 4314 - DNA, 2213 bp, Gossypium hirsutum
  misc_feature (1)..(2213): useful for making plants with increased salt and oxidative stress resistance as described in USSN 12/922,143
  misc_feature (1)..(2213): Ceres CLONE ID no.1884543
atgttggttagtactaccgttacaaatttggaatcgagaggagacacacgtcccgtgattacctctcgtcgttgacacgtctgacaacgactaaaccaagagcaacgaaacggcaccgttcctttaccgtttaagtgtttttaacccactcccactcccactcccactcccacacgaccctccctcggcgtgcttcagccgattccggtcctcacaaattctagagaattttttttttaaaaccccacctgagagtcccatttcttctttatgttgatcccttttgtgaaatttgactttttttgtagggaagaaaaaataagaattttgactgaggattgacttatttgactgattgatcgattggtagatcatcataaatcgaaaggtttaaaaagggggtgcttgaagtgagaaggttgatgggaaatttatggttgctttacttagaattaaccaattgatagtcttttaaagtaaccgaggtccttcttcttcaacccaagattgaaacttgaaaggtctgctttatctaattcagttgtcattgttggtaccatgggtgtctcaggaaaatggatcaaagcattggttggcttgaaaagaacagacaagtcacaatcctcggagaagaaagaaaatagggcagctactagcaaatttcgtcaccgaaggaagcattccattgagttttacacagataaacttcaagaagagttggatcagaatgctgcttcaccagccagagatgctaatactcatgcaattgcagatgctgctggcttcccctctggttcacttgaagtgcgtgatgtagctcttaatgaacttgtaatggaagaatgggctgccacaaggatacaaacagctttccgtgggtttctggctagaagagcactccgagccttaaaaggattggtcagactgcaggccctggtgaggggtcatgctgtaagaaaacaagctgcaatgacccttcgctgcatgcaagctttggtgagagttcaggctcgcgtaagagcaaggcgtgttcgactgacattagaaagtgaaactgcccaacagaaacttcagcaacaacttgcagatgaggctcgcgttaaagaaatagaggaagggtggtgcgatagtataggatctgttgaagaaatccaagccaagttactaaagaggcaggaggctgcagctaaacgtgagagagccatggcttatgctctggctcatcagtggcaagcaggatcaagacaacagtctgtgcctgctggatttgaaccagataaaagcagctggggttggaactggctggagagatggatggctgtacgtccatgggagaatcgttttctcgacattaatcttcggaatggagcagtggcctgtgaggatggttctgcagaggggaagaatggtgccaattctcagataaaacctgctaccaagaagccagctgcatcaaatcttcatgctaacctgtcaaatctaaaagtaggtccatcatattcagaagggagtgattctccacctggtaagtcagcaaatgtggtagatgcggtcaatgcattatcttccaagccaaaatccaaaccaatcattgaagatttgggtgaagaagctggctcaaaacctgtttttacttcaagatctcgcagcaatcctaaggagaggtccataaaatcagataaactggtgaaaaagagattgtctctacctaacagtggtgaaggaaccggatctcaaaccagcaagccaggcaaaactgctgcaaaagtgacaccgggctctaacaaggcaataaaggacaggtccaagtccaacggatgtggggactcaaatcctacaaaaaatatggcacaggccgttgatctgtaaggaagtatttgtgatgacaaacctgttggggctgccatccacccgggtcttgttatagtgtgtatatactatattatatatatattgaattacagcacgagatgttatggctttattttcttgtcataaaattgctccatctccgtggtagagttgagattggtttggcttggcttgatttgtcatgggaataagccaataaggtcagtagatttcatgtgttaatgttgtaatcagttgtgattaaatgttacggaatgtttaagccatccttcttagaggttcacaagtaaaaagtttagtgattttttattttctaaaatattaataaaagtgactgatct

SEQ ID NO: 4315 - protein, 436 aa, Gossypium hirsutum
  misc_feature (1)..(436): useful for making plants with increased salt and oxidative stress resistance as described in USSN 12/922,143
  misc_feature (1)..(436): Ceres CLONE ID no.1884543
  misc_feature (1)..(436): Bit score of 90.9 for HMM based on sequences of FIGURE 16 of USSN 12/922,143.
  misc_feature (95)..(115): Pfam Name: IQ Pfam Description: IQ calmodulin-binding motif
  misc_feature (1)..(436): Functional Homolog Of Ceres SEEDLINE ID no. ME24091
MGVSGKWIKALVGLKRTDKSQSSEKKENRAATSKFRHRRKHSIEFYTDKLQEELDQNAASPARDANTHAIADAAGFPSGSLEVRDVALNELVMEEWAATRIQTAFRGFLARRALRALKGLVRLQALVRGHAVRKQAAMTLRCMQALVRVQARVRARRVRLTLESETAQQKLQQQLADEARVKEIEEGWCDSIGSVEEIQAKLLKRQEAAAKRERAMAYALAHQWQAGSRQQSVPAGFEPDKSSWGWNWLERWMAVRPWENRFLDINLRNGAVACEDGSAEGKNGANSQIKPATKKPAASNLHANLSNLKVGPSYSEGSDSPPGKSANVVDAVNALSSKPKSKPIIEDLGEEAGSKPVFTSRSRSNPKERSIKSDKLVKKRLSLPNSGEGTGSQTSKPGKTAAKVTPGSNKAIKDRSKSNGCGDSNPTKNMAQAVDL

SEQ ID NO: 4316 - DNA, 1957 bp, Gossypium hirsutum
  misc_feature (1)..(1957): useful for making plants with increased salt and oxidative stress resistance as described in USSN 12/922,143
  misc_feature (1)..(1957): Ceres CLONE ID no.1834034
aaggcttgagactcggtcaagcggaggtatccatggttgcgaatctcagacagaaactcaaaaaatattcgtgtttctccttgaaggtcaaacctatcagaccagacagatagttcacactcgaagcatgtctgggttcttgcagaatttggaagtttgaagctctctcttaaagataggaccgtcgttttggcccttgcacgagtggatttttgctggctttttttggttattctgtttcttcacatgcttagaccaacaaagtaatgctggcagtatgggaaagaaaggaagttggttttctgcaattaaaagggttttcataccacactccaaggaaaagctaagtaatgaatcggataaacgaagtggtaaagaaaagaagaagaaaggcctaggaaaattaaggcatggagaaaccaattcctttattcccctctttagagagcccagcagtattgagaaaattcttggggaggctgaaagagagcataaactagtattcaggcctccaacacctccagagcagccagcgacaccaccttttgtgcctcataaagatgcttctcctagagttccttcacagaggattgcctctcctaggattgcttccccgagggctgcttctccaagaaccgtttcccctccacgagctgcttctccaagagctgctccacctaaggtcgtccgtcctcgaccagaaccaactttaaggaatcatcatgcttctgctacaaaaattcaagcagcctataggggttatatggcgaggagaagttttcgagcttggaaaggccttgtgaggcttcaaggagttgttagaggtcaaaacgtgaaacgtcaaacttcaaccgcaatgaaacgtatgcagcttttggtgcgaatacagtcccagattcagtcacgcaggatccagatgttagaaaaccaagcacgacaagaggttcattttaagaatgataaagaagtggagagtaccttgggtaaattggccttcagtcaggcatctgagacaggcaatgaagactgggatgatagtgtgctaccaaaagaagaaatcgaggcaagaatgcagaggaaggtagaggcagtcatcaaaagagaaagagccatggcctatgcatattcccaccagctatggaaaactactccaaaaacagttcacgcagacattcgcactcgtggatttccttggtggtggaactggttagaacgtcagctatcttctagcaacactcctgaaagccaaggcattaagaatttccagcttacaccaccaaggtcaaattccgaattgaagcctagtccagaaccgccattgagcagcaagcaacatcaatttatgtttgacaatatggacactccgacaccgaaatctacaagatcaacaacgcgacctatgcaaactccacctagtagaatcctacaaggaagcagttcaggattgtccaaatattcaagaccgagagctagtggagcggattcgccattcgacttgcccttgaaggatgatgacagccttactagctgcccaccattttcagttccaaattacatgacaccaacagtttcagcgaaagccaaagcaagagccaacagcaacctgaaggagatgttcatggggactccaggaagcgagtcatcaaagaggcggctttcattccctttgacacaagggataggatcattcaagtggagcaaagggtctttgtttgcaggcaaggattcaagctctcaaaagggtttagataagaaccaatcgcttcaatctataggtaatttgagtgtggattcagccgtttcaatgcctgctacggttggaagaaagccatttaaccgatttgtgtgatcttctattgttccttattttttaacctttgatttcttcattttggtgtttatctgagtgtatggtgctatgttgagttgcacaatttactggttgtaagataaaaat

SEQ ID NO: 4317 - protein, 523 aa, Gossypium hirsutum
  misc_feature (1)..(523): useful for making plants with increased salt and oxidative stress resistance as described in USSN 12/922,143
  misc_feature (1)..(523): Ceres CLONE ID no.1834034
  misc_feature (1)..(523): Bit score of 95.8 for HMM based on sequences of FIGURE 16 of USSN 12/922,143.
  misc_feature (149)..(169): Pfam Name: IQ Pfam Description: IQ calmodulin-binding motif
  misc_feature (1)..(523): Functional Homolog Of Ceres SEEDLINE ID no. ME24091
MGKKGSWFSAIKRVFIPHSKEKLSNESDKRSGKEKKKKGLGKLRHGETNSFIPLFREPSSIEKILGEAEREHKLVFRPPTPPEQPATPPFVPHKDASPRVPSQRIASPRIASPRAASPRTVSPPRAASPRAAPPKVVRPRPEPTLRNHHASATKIQAAYRGYMARRSFRAWKGLVRLQGVVRGQNVKRQTSTAMKRMQLLVRIQSQIQSRRIQMLENQARQEVHFKNDKEVESTLGKLAFSQASETGNEDWDDSVLPKEEIEARMQRKVEAVIKRERAMAYAYSHQLWKTTPKTVHADIRTRGFPWWWNWLERQLSSSNTPESQGIKNFQLTPPRSNSELKPSPEPPLSSKQHQFMFDNMDTPTPKSTRSTTRPMQTPPSRILQGSSSGLSKYSRPRASGADSPFDLPLKDDDSLTSCPPFSVPNYMTPTVSAKAKARANSNLKEMFMGTPGSESSKRRLSFPLTQGIGSFKWSKGSLFAGKDSSSQKGLDKNQSLQSIGNLSVDSAVSMPATVGRKPFNRFV

SEQ ID NO: 4318 - DNA, 1872 bp, Gossypium hirsutum
  misc_feature (1)..(1872): useful for making plants with increased salt and oxidative stress resistance as described in USSN 12/922,143
  misc_feature (1)..(1872): Ceres CLONE ID no.1919321
aaaagcaatcggccgatcgcttcgcacgggttttcttctgttacttcctttttttctctctcaaatttactaccactctcttagctctcctctgtttcagtctcttttttatttccataataacatcaccaattttttctcttttcttttttcttttcacttcattttttctcagctttaactaataaagaaaaaaattcaagtaatttataccttatggaatatgatacagagaaaacatgaagagaattcaagccaatcggtaacatttcatcacctacctgttcttctccgtttcagaaactcctgttttttgaccggcgatgggaaagaaagggagtggatggttctcgacggtgaagaaagtgttcaaatcatctcacaaagacttgcctgacaaaaaaagagagaataatgtggagaaatggccaaatgaggccccggatgcagtgtcgtttgaacattttccagcggagagttcaccggacatcacgaataatgagagtgcaatgtcgactcctctgaatgaagataggaaccatgccattgctgtcgccatggcaactgctgctgctgcagaagcagctgttgcggcagctcaagctgccgctaaagtcgtccggttggcgggttatggacgacagtctaaggaagaaagagctgcaacgcttatacagtcgtattatagaggctatctggctcggagagctttgcgtgctttgaagggactggtgaggttgcaggcactagtgagaggttataacgtgcgcaaacaagcgcaaatgacaatgcggtgcatgcaagcattagtccgggtgcaggcaagagttcaagctcgtaggctgcagctaactgatcatgataagatccccaagagatcagacgaggactatgaagaaaaaaaaggaacgggagaagtagaacgaaagccaaggagcctgttgaagagatatgacagttgggatggtggacagcaaagctcggagaaggttaaggaaagtgtttcgaagaaacatgatgctgcgatgagacgagaacgagcccttgcttatgcctatagctatcagcaacagccacagcaacaactcatgcaaccgcaccccaatggcaaagatgttggagtccaccttaatgatcgcgagaaggcacaatggggttggaactggctcgagcattggatgtcatcgcaaccgtacgacgctcgtcaactaggccatcaagaaggttcttacatgacactgctgaccaccaccgcaaccactaccgttaccgataacatgtctgagaaaactgttgaaatggatgttgtgacagcaatggattcaggctcatactcaaccctgcagcaggctcaatcagggtcaagtaatgtacctagctacatggccccaacccaatctgccaaagccaaggttcgaagccaaggacctatgattatgaagcagcaacgtgtaccacatgcaccccaatggaacccatcaacaaaaaaatccccaggttgtgattcatcaagttcaggtggaggaacaacagtctaccaggcaccaaggagccctggccaaaagagtaacggtgctcgcataccgtctaggcgtctaggtggatgtagcccggataccgctggtggccacggtggagaagattggaggttgcctattggcagtcatggctggtgaaaatgattttggtttttatatgttgtgtttcagaaaatgccactatgaagtgtgaaatgaaggtttgtttcttcatatgttgctctctgtatttatttgctctcgcattcatgttagtgatgtaataatataaaaactgcaaactctccagtatttgaagctttatctatcacatgataattgtttgttcagttct

SEQ ID NO: 4319 - protein, 450 aa, Gossypium hirsutum
  misc_feature (1)..(450): useful for making plants with increased salt and oxidative stress resistance as described in USSN 12/922,143
  misc_feature (1)..(450): Ceres CLONE ID no.1919321
  misc_feature (1)..(450): Bit score of 53.9 for HMM based on sequences of FIGURE 16 of USSN 12/922,143.
  misc_feature (111)..(131): Pfam Name: IQ Pfam Description: IQ calmodulin-binding motif
  misc_feature (1)..(450): Functional Homolog Of Ceres SEEDLINE ID no. ME24091
MGKKGSGWFSTVKKVFKSSHKDLPDKKRENNVEKWPNEAPDAVSFEHFPAESSPDITNNESAMSTPLNEDRNHAIAVAMATAAAAEAAVAAAQAAAKVVRLAGYGRQSKEERAATLIQSYYRGYLARRALRALKGLVRLQALVRGYNVRKQAQMTMRCMQALVRVQARVQARRLQLTDHDKIPKRSDEDYEEKKGTGEVERKPRSLLKRYDSWDGGQQSSEKVKESVSKKHDAAMRRERALAYAYSYQQQPQQQLMQPHPNGKDVGVHLNDREKAQWGWNWLEHWMSSQPYDARQLGHQEGSYMTLLTTTATTTVTDNMSEKTVEMDVVTAMDSGSYSTLQQAQSGSSNVPSYMAPTQSAKAKVRSQGPMIMKQQRVPHAPQWNPSTKKSPGCDSSSSGGGTTVYQAPRSPGQKSNGARIPSRRLGGCSPDTAGGHGGEDWRLPIGSHGW

SEQ ID NO: 4320 - DNA, 1437 bp, Populus balsamifera subsp. trichocarpa
  misc_feature (1)..(1437): useful for making plants with increased salt and oxidative stress resistance as described in USSN 12/922,143
  misc_feature (1)..(1437): Ceres ANNOT ID no.1528800
atggggaggaaaggaaaatggttttctagtgtaaagaaagctcttagccctgatcccaaggagaagacagaccagaaatcaaataaatcaaagaagaaatggtttggaaagcaacaactggattcggattccacttctttagaaaatgtcacaatgctgtctcctcctccccaaccagaagaagtgaaattaattgagacaacagatgaagtgaaccagcatactttccctgttccagttgccactgctgcagtacctgagcctgctccgactactgtccaaaccaatattgaggttgttcaactgaccaaggtaaacaaatatgctggcaaatcaaaggaagaagaggcggcaattaagattcaaacaacattcagaggatacatggccagaagagcattgcgggctctgagagggttggcgaggctcaaatttctgatggaagggcctagaataaaaaggcaagcaacacataccctccgctgcatgcagactctagctcgggtgcagtcacagattcacacaaggaggatcagaatgtcagaagagaaccaggccctacagagacaactcctacagaagcatgccaaagagcttgaaaacttgcggattggagaggaatgggatgacagtctacagtcgaaggaacagattgaagctagcctgctaaacaagtttgaggccgctacgagaagggaaagagcactggcttatgctttctctcatcagcaaactttgaagaattcttcacgatctgcaaaccccatgttcatgaatgggaatccttcctggggttggagctggttggaacgatggatggcagcccatccatgggagagccggagcttgatggagaaagaacacaataacgaccactcatctgtaaagagtgccagccgcagcattactggaggagaaataagcaaatcttatgctcgctaccagctcaattctgataaattaactccaagagaaagtgaaaggccaaccaaaaccacgaacctacagtccccatcaactcctaaaaagccagctgcttctacagttgctagaaaattgaagtcagcaagcccaaggagtaacattgggggcattgaagatgactctagaagcatggtcagtgttcaatcagatcgtagtagaaggcatagcattgctggttcatttgtgcgagatgatgagagcctcggaagctctccagcgcttccaagttacatggtacctacacaatctgcaagagcaaagtccagaatacatagcctattgggagcagaaaaggacgggacaccagaaaaggaaaagggttcctctgggcatacaaagaaacggctttcataccctccatcgccagccaaaggaaggaggtattctggccccccaaagttggaaagcagcttcaatgcaagaaatagcgtggctgctggcgagggaatttaa

SEQ ID NO: 4321 - protein, 478 aa, Populus balsamifera subsp. trichocarpa
  misc_feature (1)..(478): useful for making plants with increased salt and oxidative stress resistance as described in USSN 12/922,143
  misc_feature (1)..(478): Ceres ANNOT ID no.1528800
  misc_feature (1)..(478): Bit score of 1243.2 for HMM based on sequences of FIGURE 16 of USSN 12/922,143.
  misc_feature (115)..(135): Pfam Name: IQ Pfam Description: IQ calmodulin-binding motif
  misc_feature (1)..(478): Functional Homolog Of Ceres SEEDLINE ID no. ME24091
MGRKGKWFSSVKKALSPDPKEKTDQKSNKSKKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 4322 - DNA, 1440 bp, Populus balsamifera subsp. trichocarpa
  misc_feature (1)..(1440): useful for making plants with increased salt and oxidative stress resistance as described in USSN 12/922,143
  misc_feature (1)..(1440): Ceres ANNOT ID no.1484880
atggggaggaaaggaaaatggttttctagtgtaaagaaagctcttagccctgattccaaggagaagaaagaccagaaatcaaataaatcgaagaagaaatggtttggcaagcaacaactggattcggattccacttctttagaaaatgttacaatgcgatctcctcctcctcctcaaccagacgaggtgaaattaattgaaaccacaaatgaagagaaccagcatacttactctgttccagttgtcactgctgcagtagctgagcatgctccgattactgttcaaaccaccactgaggtttttcaaccaaccaaggttaataaatatgctggcaaatcaaaggaagaagtggcggcaattaagattcagacagcattccgaggatacatggcaagaagagcattgcgggctctgagagggctgttcaggctcaaatctctgatggaagggcctacgataaaaagacaagcaacccatactctccactgcatgcagactctagctcgggtgcagtcacagatacacacaaggaggattagaatgtcagaagagaaccaggccctacagagacaactcctacatgagcatgcaaaagagtttgaaagcttgcagattggagaggaatgggatgacagtctacagtcaaaggaacagattgaagctaacctgctaaacaagtttgaggcagctgtgagaagggaaagagcactggcttattctttctctcatcagcaagcctggaaaatttcttcacgagctgtaaacccaatgttcatgagtggcaatccatcctggggttggagctggttggaacgatggatggcagcccatccatgggagagccggagcatgacggagaaagaacttaataatgaccactcatctctaaagagtgcgagccgcagcattactggaggggatataagcaaatcttatgctcgctaccagctcaattctgataaactaactccaagagaaagtgaaaggccaaccaaaaccgcgaacctacagttccaatcaactcctaacaagccagctgcttctacagttgctagaaaattgaagtcagccagcccaaggagtggcattgggggcctagatgatgaatctaaaagtgtggtcagtgttcagtcagatcatagtagaaggcatagcattgcaggttcatttgtacgagatgatgagagccttggaagctctccaccacttccaagttacatggtacctacagaatccgcgagagcaaagtccagattacaaaacccattgggggcagagatgaacggagcgcctgaaaaggaaaagggatccttggggtctgccaagaagcggctttcctaccctccctcaccagccaaagcaaggaggtattcaggtcccccgaaattggaaagcagcttaaaagcagaaaacagtgaggctgctggcgagggcatttaa

SEQ ID NO: 4323 - protein, 479 aa, Populus balsamifera subsp. trichocarpa
  misc_feature (1)..(479): useful for making plants with increased salt and oxidative stress resistance as described in USSN 12/922,143
  misc_feature (1)..(479): Ceres ANNOT ID no.1484880
  misc_feature (1)..(479): Bit score of 1129.7 for HMM based on sequences of FIGURE 16 of USSN 12/922,143.
  misc_feature (116)..(136): Pfam Name: IQ Pfam Description: IQ calmodulin-binding motif
  misc_feature (1)..(479): Functional Homolog Of Ceres SEEDLINE ID no. ME24091
MGRKGKWFSSVKKALSPDSKEKKDQKSNKSKKKWFGKQQLDSDSTSLENVTMRSPPPPQPDEVKLIETTNEENQHTYSVPVVTAAVAEHAPITVQTTTEVFQPTKVNKYAGKSKEEVAAIKIQTAFRGYMARRALRALRGLFRLKSLMEGPTIKRQATHTLHCMQTLARVQSQIHTRRIRMSEENQALQRQLLHEHAKEFESLQIGEEWDDSLQSKEQIEANLLNKFEAAVRRERALAYSFSHQQAWKISSRAVNPMFMSGNPSWGWSWLERWMAAHPWESRSMTEKELNNDHSSLKSASRSITGGDISKSYARYQLNSDKLTPRESERPTKTANLQFQSTPNKPAASTVARKLKSASPRSGIGGLDDESKSVVSVQSDHSRRHSIAGSFVRDDESLGSSPPLPSYMVPTESARAKSRLQNPLGAEMNGAPEKEKGSLGSAKKRLSYPPSPAKARRYSGPPKLESSLKAENSEAAGEGI

SEQ ID NO: 4324 - DNA, 1455 bp, Populus balsamifera subsp. trichocarpa
  misc_feature (1)..(1455): useful for making plants with increased salt and oxidative stress resistance as described in USSN 12/922,143
  misc_feature (1)..(1455): Ceres ANNOT ID no.1475350
atggggaggaaaggaaaatggttttctagtgtaaagaaagctcttagccctgatcccaaggagaagacagaccagaaatcaaataaatcaaagaagaaatggtttggaaagcaacaactggattcggattccacttctttagaaaatgtcacaatgctgtctcctcctccccaaccagaagaagtgaaattaattgagacaacagatgaagtgaaccagcatactttccctgttccagttgccactgctgcagtacctgagcctgctccgactactgtccaaaccaatattgaggttgttcaactgaccaaggtaaacaaatatgctggcaaatcaaaggaagaagaggcggcaattaagattcaaacaacattcagaggatacatggccagaagagcattgcgggctctgagagggttggcgaggctcaaatttctgatggaagggcctagaataaaaaggcaagcaacacataccctccgctgcatgcagactctagctcgggtgcagtcacagattcacacaaggaggatcagaatgtcagaagagaaccaggccctacagagacaactcctacagaagcatgccaaagagcttgaaaacttgcggggcatgcaatgttttcatattggagaggaatgggatgacagtctacagtcgaaggaacagattgaagctagcctgctaaacaagtttgaggccgctacgagaagggaaagagcactggcttatgctttctctcatcagcaaactttgaagaattcttcacgatctgcaaaccccatgttcatgaatgggaatccttcctggggttggagctggttggaacgatggatggcagcccatccatgggagagccggagcttgatggagaaagaacacaataacgaccactcatctgtaaagagtgccagccgcagcattactggaggagaaataagcaaatcttatgctcgctaccagctcaattctgataaattaactccaagagaaagtgaaaggccaaccaaaaccacgaacctacagtccccatcaactcctaaaaagccagctgcttctacagttgctagaaaattgaagtcagcaagcccaaggagtaacattgggggcattgaagatgactctagaagcatggtcagtgttcaatcagatcgtagtagaaggcatagcattgctggttcatttgtgcgagatgatgagagcctcggaagctctccagcgcttccaagttacatggtacctacacaatctgcaagagcaaagtccagaatacatagcctattgggagcagaaaaggacgggacaccagaaaaggaaaagggttcctctgggcatacaaagaaacggctttcataccctccatcgccagccaaaggaaggaggtattctggccccccaaagttggaaagcagcttcaatgcaagaaatagcgtggctgctggcgagggaatttaa

SEQ ID NO: 4325 - protein, 484 aa, Populus balsamifera subsp. trichocarpa
  misc_feature (1)..(484): useful for making plants with increased salt and oxidative stress resistance as described in USSN 12/922,143
  misc_feature (1)..(484): Ceres ANNOT ID no.1475350
  misc_feature (1)..(484): Bit score of 1230.9 for HMM based on sequences of FIGURE 16 of USSN 12/922,143.
  misc_feature (115)..(135): Pfam Name: IQ Pfam Description: IQ calmodulin-binding motif
  misc_feature (1)..(484): Functional Homolog Of Ceres SEEDLINE ID no. ME24091
MGRKGKWFSSVKKALSPDPKEKTDQKSNKSKKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRGMQCFHIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 4326 - DNA, 1470 bp, Populus balsamifera subsp. trichocarpa; identical to SEQ ID NO: 3394
  misc_feature (1)..(1470): useful for making plants with increased salt and oxidative stress resistance as described in USSN 12/922,143
  misc_feature (1)..(1470): Ceres ANNOT ID no.1465047

SEQ ID NO: 4327 - protein, 489 aa, Populus balsamifera subsp. trichocarpa
  misc_feature (1)..(489): useful for making plants with increased salt and oxidative stress resistance as described in USSN 12/922,143
  misc_feature (1)..(489): Ceres ANNOT ID no.1465047
  misc_feature (1)..(489): Bit score of 853.1 for HMM based on sequences of FIGURE 16 of USSN 12/922,143.
  misc_feature (116)..(136): Pfam Name: IQ Pfam Description: IQ calmodulin-binding motif
  misc_feature (1)..(489): Functional Homolog Of Ceres SEEDLINE ID no. ME24091
MGKRGSWFSALKKALGSSKKSKSKKKWSEKEKNRDLGVSSHEETVAPSLSPPRTPPPPTAEDVKLTEAENEQSKHAYSVALATAVAAEAAVAAAQAAAEVVRLTTVAHYSGKSKEEIAAIRIQTAFRGYLARRALRALRGLVRLKSLIQGQSVKRQATATLRAMQTLARVQSQIRARRIRMSEENEALQRQLQQKHDKELEKLRTSIGEQWDDSPQSKEEVEASLLQKQEAAMRRERALAYAYSHQQMWKQSSKSANATFMDPNNPRWGWSWLERWMAARPWESRSTIDNNDRASVKSTTSRTMSLGEISRAYSRRDLNHDNKASPGAQKSSRPPSRQSPSTPPSKAPSTSSVTGKAKPPSPRGSAWGGDEDSRSTFSVQSERYRRHSIAGSSIRDDESLASSPSVPSYMAPTRSQSAKAKSRLSSPLGIDNNGTPDKASVGYVKKRLSFSASPAGARRHSGPPRVDASAVKDIQMHREEKMSNGASSK

SEQ ID NO: 4328 - DNA, 1653 bp, Populus balsamifera subsp. trichocarpa
  misc_feature (1)..(1653): useful for making plants with increased salt and oxidative stress resistance as described in USSN 12/922,143
  misc_feature (1)..(1653): Ceres ANNOT ID no.1479891
atgggaaagaaagggagttggttttcagcaatcaagagggtcttttcaccccactccaaggacaaactagctagtcttgggaggattgaaaaaattaagatgaaagttgtccagatgcgtgaggaagcagaacatgaatcagataagagaagcacgaaagaaaagaagaagaagggtcttggaaaactaagacatggagagaccacttcattcattcccctgtttagagaaccaagcagtattgagaaaattttggatgaggctgaaagagagaataaattaattttcaggcctccaacgcctcctgaggaactgacaacaccaccttttgtgcctccaagagccgattctccgagggttgcttctcaaagagtcacctctccaagagctgctactccaagggttgcttcccctagagcggcatctccaagggttgcttcccctagagcagcttctcctaggaatgctcaacgccataaggagatatattacagaccagaaccaactctaagaaaccatcatgcttctgctaccaagatccaagcagcctatagaggctatgttgcaaggaggagcttcagagcactgaagggtcttgtgaggcttcaaggagtgataagaggacagaatgtgaagcggcagacaatgaatgcgatgaaacacatgcagctcttggtgcgggtccagtctcagattcagtctcggaggatccagatgttagaaaaccaagcacgacgtcaagctcaaaacagaaatgataaagaagtggatagtaccttgggcaaatggggccagttgtctgaggcaggtaataacgaagactgggatgacagcgtgctgacgaaggaggaaattgacgcaaggttgcagaaaagggtggaggcagtcgtcaagagagaaagagccatggcttatgcatattcccaccagctgtggaaagccactccaaaatctgctcagtcagctctaatggatatccgttccaatgggtttccatggtggtggaactggttagagcgtcagctacctccaactaatcctcctgaaagccaagccttgaggaattttcaacttacaccaccaaggccacgttccgatatgaaggctagccctaggcccccatccaggagccacaagcaacaacattttgggtttgataatatggatactccaacaccgagatcctcaaaatcaactgtttttgtgccaacgagacaagcgcgaactcctctacatagaactccacaagccaacagccctagcttgtcaaaatattcaatggcaagagccagtgcagcaaattctccttttaacttgccattgaaggatgacgatagcctcatgagctgcccaccattttcagtgccaaactacatgagccctacagtttcagccaaagccaaagaaagagctaatagcaatcccaaggagaggtttccagggaccccaaccagtgaaaagaggagactgtcattccctcttacacagggcattgggtctttcaagtggaacaaaggctccttcactagcaaggattcaagttctcaaaggggtttagataggcatcagtcacttcaatccataggaaacttgagtgtggattcaaccgtctcgatgcctgccacgcgaaagccatttaaccgattcgtgtga

SEQ ID NO: 4329 - protein, 550 aa, Populus balsamifera subsp. trichocarpa
  misc_feature (1)..(550): useful for making plants with increased salt and oxidative stress resistance as described in USSN 12/922,143
  misc_feature (1)..(550): Ceres ANNOT ID no.1479891
  misc_feature (1)..(550): Bit score of 65.2 for HMM based on sequences of FIGURE 16 of USSN 12/922,143.
  misc_feature (174)..(194): Pfam Name: IQ Pfam Description: IQ calmodulin-binding motif
  misc_feature (1)..(550): Functional Homolog Of Ceres SEEDLINE ID no. ME24091
MGKKGSWFSAIKRVFSPHSKDKLASLGRIEKIKMKVVQMREEAEHESDKRSTKEKKKKGLGKLRHGETTSFIPLFREPSSIEKILDEAERENKLIFRPPTPPEELTTPPFVPPRADSPRVASQRVTSPRAATPRVASPRAASPRVASPRAASPRNAQRHKEIYYRPEPTLRNHHASATKIQAAYRGYVARRSFRALKGLVRLQGVIRGQNVKRQTMNAMKHMQLLVRVQSQIQSRRIQMLENQARRQAQNRNDKEVDSTLGKWGQLSEAGNNEDWDDSVLTKEEIDARLQKRVEAVVKRERAMAYAYSHQLWKATPKSAQSALMDIRSNGFPWWWNWLERQLPPTNPPESQALRNFQLTPPRPRSDMKASPRPPSRSHKQQHFGFDNMDTPTPRSSKSTVFVPTRQARTPLHRTPQANSPSLSKYSMARASAANSPFNLPLKDDDSLMSCPPFSVPNYMSPTVSAKAKERANSNPKERFPGTPTSEKRRLSFPLTQGIGSFKWNKGSFTSKDSSSQRGLDRHQSLQSIGNLSVDSTVSMPATRKPFNRFV

SEQ ID NO: 4330 - DNA, 1587 bp, Populus balsamifera subsp. trichocarpa
  misc_feature (1)..(1587): useful for making plants with increased salt and oxidative stress resistance as described in USSN 12/922,143
  misc_feature (1)..(1587): Ceres ANNOT ID no.1534105
atgggaaagaaagggagttggttttcagcaatcaagagggtctttctaccaaactccaaggacaaactagctaatgaatcagataagagaagcgcaaaagaaaagaagaagaagggtcgtggaaaactaagacatggagagaccacttcattcattcccctgtttagagaaccaagtagtatcgagaaaattttggatgaggctgaaagagagcataaattaattttcaggcctcccacacctcctgagcaaccgactacaccaccctttgtgcctccaagatctgcttctccgagggttgcttctcaaagagtcacctctccaagagctgcttcccctagagctgcatctccaagggttgcttctcctagagcagcttctcctaggaatgctcaacgccataaggagatatattacagaccagaaccaactctaagaaaccatcatgcttcagcaaccaagatccaagcagcctatagaggctatgttgcaaggaggagcttcagagctttgaagggtcttgtgaggcttcaaggagtgataagaggacagaatgtgaagcggcagacgatgaatgcaatgaaatacatgcagctcttggttcgggtccagtctcagattcagtcacggaggatccaaatgttagaaaaccaagcacgacgtcaagctcaaaacaaaaatgataaagaagtggatggtaccttgggcaaatggggccagtcgcctgaggcaggtaatagtgaagactgggatgacagcgttctgacgaaggaggaaattgacgcaaggttgcagagaaaggtggaggcagtcgtcaagagagaaagggccatggcgtattcgtattcccaccagctgtggaaagcctcaccaaaatctgctcagtcatctctcatggatatccgttccaatggatttccatggtggtggaactggttagaacgtcagctacctccaacgaatcctcctgaaagccaagccttgaagaattttcaacttacaccgccaaggccacattcagagataaagcctagcccaagacccccatcaagtagccacaagcaacaacatctggggtttgataatatggatactcccacaccgagatcctcaaaatcaactgcatttgtgtcaacaagaccagcgcgaactcctctacttagaactccacaagcaaacagccctagcttgtcaagatattcaagagcaagagccagtggagggaattctcctttcgacttgccattgaaggatgacgatagcctcacgagctgcccaccattttcagtgccaaactacatgactcctacggcctcagccaaggcaaaaacaagagcttatagtaatcccaaagagaggtttccagggaccccaaacagtgaaaagaggagactctcgttccctcttacacaaggcattggatctttcaagtggaacaaaggctccttcttcaccagcaaggattcaagctctcaaaggggtttagataagcatcagtcacttcaatccataggagatttgagtgtggattcaaccgtctcgatgcctgctacggttggacgaaggccatttaaccgatttgtgtga

SEQ ID NO: 4331 - protein, 528 aa, Populus balsamifera subsp. trichocarpa
  misc_feature (1)..(528): useful for making plants with increased salt and oxidative stress resistance as described in USSN 12/922,143
  misc_feature (1)..(528): Ceres ANNOT ID no.1534105
  misc_feature (1)..(528): Bit score of 88.9 for HMM based on sequences of FIGURE 16 of USSN 12/922,143.
  misc_feature (149)..(169): Pfam Name: IQ Pfam Description: IQ calmodulin-binding motif
  misc_feature (1)..(528): Functional Homolog Of Ceres SEEDLINE ID no. ME24091
MGKKGSWFSAIKRVFLPNSKDKLANESDKRSAKEKKKKGRGKLRHGETTSFIPLFREPSSIEKILDEAEREHKLIFRPPTPPEQPTTPPFVPPRSASPRVASQRVTSPRAASPRAASPRVASPRAASPRNAQRHKEIYYRPEPTLRNHHASATKIQAAYRGYVARRSFRALKGLVRLQGVIRGQNVKRQTMNAMKYMQLLVRVQSQIQSRRIQMLENQARRQAQNKNDKEVDGTLGKWGQSPEAGNSEDWDDSVLTKEEIDARLQRKVEAVVKRERAMAYSYSHQLWKASPKSAQSSLMDIRSNGFPWWWNWLERQLPPTNPPESQALKNFQLTPPRPHSEIKPSPRPPSSSHKQQHLGFDNMDTPTPRSSKSTAFVSTRPARTPLLRTPQANSPSLSRYSRARASGGNSPFDLPLKDDDSLTSCPPFSVPNYMTPTASAKAKTRAYSNPKERFPGTPNSEKRRLSFPLTQGIGSFKWNKGSFFTSKDSSSQRGLDKHQSLQSIGDLSVDSTVSMPATVGRRPFNRFV

SEQ ID NO: 4332 - DNA, 1593 bp, Populus balsamifera subsp. trichocarpa
  misc_feature (1)..(1593): useful for making plants with increased salt and oxidative stress resistance as described in USSN 12/922,143
  misc_feature (1)..(1593): Ceres ANNOT ID no.1533356
atgggaaagaaagggagttggttttcagcaatcaagagggtcttttcaccccactccaaggacaaactagctagtgaatcagataagagaagcacgaaagaaaagaagaagaagggtcttggaaaactaagacatggagagaccacttcattcattcccctgtttagagaaccaagcagtattgagaaaattttggatgaggctgaaagagagaataaattaattttcaggcctccaacgcctcctgaggaactgacaacaccaccttttgtgcctccaagagccgattctccgagggttgcttctcaaagagtcacctctccaagagctgctactccaagggttgcttcccctagagcggcatctccaagggttgcttcccctagagcagcttctcctaggaatgctcaacgccataaggagatatattacagaccagaaccaactctaagaaaccatcatgcttctgctaccaagatccaagcagcctatagaggctatgttgcaaggaggagcttcagagcactgaagggtcttgtgaggcttcaaggagtgataagaggacagaatgtgaagcggcagacaatgaatgcgatgaaacacatgcagctcttggtgcgggtccagtctcagattcagtctcggaggatccagatgttagaaaaccaagcacgacgtcaagctcaaaacagaaatgataaagaagtggatagtaccttgggcaaatggggccagttgtctgaggcaggtaataacgaagactgggatgacagcgtgctgacgaaggaggaaattgacgcaaggttgcagaaaagggtggaggcagtcgtcaagagagaaagagccatggcttatgcatattcccaccagctgtggaaagccactccaaaatctgctcagtcagctctaatggatatccgttccaatgggtttccatggtggtggaactggttagagcgtcagctacctccaactaatcctcctgaaagccaagccttgaggaattttcaacttacaccaccaaggccacgttccgatatgaaggctagccctaggcccccatccaggagccacaagcaacaacattttgggtttgataatatggatactccaacaccgagatcctcaaaatcaactgtttttgtgccaacgagacaagcgcgaactcctctacatagaactccacaagccaacagccctagcttgtcaaaatattcaatggcaagagccagtgcagcaaattctccttttaacttgccattgaaggatgacgatagcctcatgagctgcccaccattttcagtgccaaactacatgagccctacagtttcagccaaagccaaagaaagagctaatagcaatcccaaggagaggtttccagggaccccaaccagtgaaaagaggagactgtcattccctcttacacagggcattgggtctttcaagtggaacaaaggctccttcactagcaaggattcaagttctcaaaggggtttagataggcatcagtcacttcaatccataggaaacttgagtgtggattcaaccgtctcgatgcctgccacgcgaaagccatttaaccgattcgtgtga

SEQ ID NO: 4333 - protein, 530 aa, Populus balsamifera subsp. trichocarpa
  misc_feature (1)..(530): useful for making plants with increased salt and oxidative stress resistance as described in USSN 12/922,143
  misc_feature (1)..(530): Ceres ANNOT ID no.1533356
  misc_feature (1)..(530): Bit score of 90.2 for HMM based on sequences of FIGURE 16 of USSN 12/922,143.
  misc_feature (154)..(174): Pfam Name: IQ Pfam Description: IQ calmodulin-binding motif
  misc_feature (1)..(530): Functional Homolog Of Ceres SEEDLINE ID no. ME24091
MGKKGSWFSAIKRVFSPHSKDKLASESDKRSTKEKKKKGLGKLRHGETTSFIPLFREPSSIEKILDEAERENKLIFRPPTPPEELTTPPFVPPRADSPRVASQRVTSPRAATPRVASPRAASPRVASPRAASPRNAQRHKEIYYRPEPTLRNHHASATKIQAAYRGYVARRSFRALKGLVRLQGVIRGQNVKRQTMNAMKHMQLLVRVQSQIQSRRIQMLENQARRQAQNRNDKEVDSTLGKWGQLSEAGNNEDWDDSVLTKEEIDARLQKRVEAVVKRERAMAYAYSHQLWKATPKSAQSALMDIRSNGFPWWWNWLERQLPPTNPPESQALRNFQLTPPRPRSDMKASPRPPSRSHKQQHFGFDNMDTPTPRSSKSTVFVPTRQARTPLHRTPQANSPSLSKYSMARASAANSPFNLPLKDDDSLMSCPPFSVPNYMSPTVSAKAKERANSNPKERFPGTPTSEKRRLSFPLTQGIGSFKWNKGSFTSKDSSSQRGLDRHQSLQSIGNLSVDSTVSMPATRKPFNRFV

SEQ ID NO: 4334 - DNA, 1287 bp, Populus balsamifera subsp. trichocarpa
  misc_feature (1)..(1287): useful for making plants with increased salt and oxidative stress resistance as described in USSN 12/922,143
  misc_feature (1)..(1287): Ceres ANNOT ID no.1515314
atgggtgtctcagggaaatggtttaaagctttggttggtctaaagaagtctgaaaagtcacagtctttggacaaagaggaaaatggggcgactgctagcaagtctcgacataggagaaagcattcggttgagtttgatgctgataaaattcaagaggagtttcataatcataatcataatcataatcataatcataatgatggtgacgccaacattcgttccatcccagatacttctgaatctccttttgattcgcttcaagttcaggatttagctcataatcaacaagttatgagagaagaattggctgccactcgcattcaaacagctttccgcgggtttctggcaagaagagctctgcgagctttgaaaggattagtgagactgcaagctcttgttcggggccatgctgtgagaaaacaagctgcaataactcttcgctgcatgcaagctttggtgagagttcaggctcgagttcgtgcaaggcgtgttcgcttagcattggaaagtcaaacagctcaacagaaacttcagcaacaactagctaatgaggcccgggttcgagaaatagaggaaggatggtgtgatagtgtgggatctgttgaacaaattcaagccaagttgctgaagcggcaggaggctgcagctaagcgtgagagagctattgcatatgctctggcccatcagtggcaggctgggtcaagacaccaggctgttccatctggttttgaaccagataaaagcagttggggctggaactggttggagagatggatggctgttcgcccatgggagaaccgctttcttgacataaatcttagagatggagtgatgattcgtgaggatgaaacagctgctgaggtcaggaatggcagcaaatcccagttaaaaacaactgccaagaaagctattgcctcagatcttcagtcaaccatttcaagtcagaaaaaaggtccatctcattctgatggtggcagttcctcacctagtaagtcagcaggcatgttagaagcacccaacacacttttttctaaaccaaagccaaagccagttcttgaagacctggttgaagaagccatttcaaaacctgctatggctacaagatctcacagcaacccaaaggagagaaccacccaactagataaacaggcaaagaagagattgtctctgcctaacagtggtcagttttctctctcatttttctccttcatgcccacacatttgcacgaaagcacacgtaggttcaaaagtatgcaaggattgccacactgcttgtcacagaaatga

SEQ ID NO: 4335 - protein, 428 aa, Populus balsamifera subsp. trichocarpa
  misc_feature (1)..(428): useful for making plants with increased salt and oxidative stress resistance as described in USSN 12/922,143
  misc_feature (1)..(428): Ceres ANNOT ID no.1515314
  misc_feature (1)..(428): Bit score of 97.2 for HMM based on sequences of FIGURE 16 of USSN 12/922,143.
  misc_feature (101)..(121): Pfam Name: IQ Pfam Description: IQ calmodulin-binding motif
  misc_feature (1)..(428): Functional Homolog Of Ceres SEEDLINE ID no. ME24091
MGVSGKWFKALVGLKKSEKSQSLDKEENGATASKSRHRRKHSVEFDADKIQEEFHNHNHNHNHNHNDGDANIRSIPDTSESPFDSLQVQDLAHNQQVMREELAATRIQTAFRGFLARRALRALKGLVRLQALVRGHAVRKQAAITLRCMQALVRVQARVRARRVRLALESQTAQQKLQQQLANEARVREIEEGWCDSVGSVEQIQAKLLKRQEAAAKRERAIAYALAHQWQAGSRHQAVPSGFEPDKSSWGWNWLERWMAVRPWENRFLDINLRDGVMIREDETAAEVRNGSKSQLKTTAKKAIASDLQSTISSQKKGPSHSDGGSSSPSKSAGMLEAPNTLFSKPKPKPVLEDLVEEAISKPAMATRSHSNPKERTTQLDKQAKKRLSLPNSGQFSLSFFSFMPTHLHESTRRFKSMQGLPHCLSQK

SEQ ID NO: 4336 - DNA, 1314 bp, Populus balsamifera subsp. trichocarpa
  misc_feature (1)..(1314): useful for making plants with increased salt and oxidative stress resistance as described in USSN 12/922,143
  misc_feature (1)..(1314): Ceres ANNOT ID no.1492487
atgggtgtctcagggaaatggtttaaagcattggttggtttaaagaagtctgaaaagtcacagtctttggacaaggatgaaaataggacgagtgccagcaagtttcggcataggaggaagcattcggttgagtttgatggtgataaatttgaagaggagtttgataatcatgacaatgtagctacagttggtgataccaacgttgtttccgttccagatgcgtcggaatctccttctgcttcacttcaagttcaggatgttgctcataatcaacaagttctgagagaagaatgggctgccactcgcatccagacagcttttcgagggtttttggcaagaagagctcttcgagctttgaaaggattagtgagactgcaagcccttgttcggggccatgctgtgaggaaacaagctgcaataactcttcgctgtatgcaagctttggtgagagttcaggctcgtgtccgtgcaagacgtgttcgcttagcattggagagtcaaacagctcaacataaacttcagcaacaactagctaatgaggctcgcgttcaagaaatagaggaaggatggtgtgatagtgtgggatctgttgaacaaattcaagccaagttgctgaagcggcaggaggctgcagctaagcgtgagagagccatggcatatgctttggcccatcagtggcaggctgggtcgagactgcaggctgctccctctgggtttgaacctgataaaagcagttggggctggaactggttggagagatggatggctgttcgcccatgggaaaaccgctttcttgacataaatctcagagatggagtgatgatttatgaagatgaaacagctgctgaggtcaagaatggcagcaaatcccagctaaaaactactaccaagaaaggagttgcctcaaaccttcaatcaaccatttcaagtcagaaaacaggtccatctcattctgatggtggcagttcctcccctagtaagtcagcaggcatgttagatgtgcccgacactctttttactaaaccaaagccaaagctagttcttgaagacctggttgaagaagccaactcaagacgtgctattgttacaagatctcacagcaacccaaaggagagaactacccaactagataaacaggcaaggaagagattgtctctgcctaacagtggggggggtactggcgctcaggtagccaggcatagcagaaacgctactagaggggcacctagctctcagaagcccatcaaggatagatccaagttaaacgggaaaggagatccaaacaccgcaaagtctgttgcacaggctgtttga

SEQ ID NO: 4337 - protein, 437 aa, Populus balsamifera subsp. trichocarpa
  misc_feature (1)..(437): useful for making plants with increased salt and oxidative stress resistance as described in USSN 12/922,143
  misc_feature (1)..(437): Ceres ANNOT ID no.1492487
  misc_feature (1)..(437): Bit score of 93.4 for HMM based on sequences of FIGURE 16 of USSN 12/922,143.
  misc_feature (97)..(117): Pfam Name: IQ Pfam Description: IQ calmodulin-binding motif
  misc_feature (1)..(437): Functional Homolog Of Ceres SEEDLINE ID no. ME24091
MGVSGKWFKALVGLKKSEKSQSLDKDENRTSASKFRHRRKHSVEFDGDKFEEEFDNHDNVATVGDTNVVSVPDASESPSASLQVQDVAHNQQVLREEWAATRIQTAFRGFLARRALRALKGLVRLQALVRGHAVRKQAAITLRCMQALVRVQARVRARRVRLALESQTAQHKLQQQLANEARVQEIEEGWCDSVGSVEQIQAKLLKRQEAAAKRERAMAYALAHQWQAGSRLQAAPSGFEPDKSSWGWNWLERWMAVRPWENRFLDINLRDGVMIYEDETAAEVKNGSKSQLKTTTKKGVASNLQSTISSQKTGPSHSDGGSSSPSKSAGMLDVPDTLFTKPKPKLVLEDLVEEANSRRAIVTRSHSNPKERTTQLDKQARKRLSLPNSGGGTGAQVARHSRNATRGAPSSQKPIKDRSKLNGKGDPNTAKSVAQAV

SEQ ID NO: 4338 - DNA, 1512 bp, Populus balsamifera subsp. trichocarpa
  misc_feature (1)..(1512): useful for making plants with increased salt and oxidative stress resistance as described in USSN 12/922,143
  misc_feature (1)..(1512): Ceres ANNOT ID no.1439623
atggataaaaatgaagtttacccaataataatccaccaccccggcgtattttatcctacgctgggcctcactcctcactctcttcctcttcctcgcccgctcatactcttcctcctcctcctcctactttccttctcccttacactcactgacgctcctgattctctacttcccgcgtcttcctatccctccctcccactcagacgaacagggaaatggtttaaagcattggttggtttaaagaagtctgaaaagtcacagtctttggacaaggatgaaaataggacgagtgccagcaagtttcggcataggaggaagcattcggttgagtttgatggtgataaatttgaagaggagtttgataatcatgacaatgtagctacagttggtgataccaacgttgtttccgttccagatgcgtcggaatctccttctgcttcacttcaagttcaggatgttgctcataatcaacaagttctgagagaagaatgggctgccactcgcatccagacagcttttcgagggtttttggcaagaagagctcttcgagctttgaaaggattagtgagactgcaagcccttgttcggggccatgctgtgaggaaacaagctgcaataactcttcgctgtatgcaagctttggtgagagttcaggctcgtgtccgtgcaagacgtgttcgcttagcattggagagtcaaacagctcaacataaacttcagcaacaactagctaatgaggctcgcgttcaagaaatagaggaaggatggtgtgatagtgtgggatctgttgaacaaattcaagccaagttgctgaagcggcaggaggctgcagctaagcgtgagagagccatggcatatgctttggcccatcagtggcaggctgggtcgagactgcaggctgctccctctgggtttgaacctgataaaagcagttggggctggaactggttggagagatggatggctgttcgcccatgggaaaaccgctttcttgacataaatctcagagatggagtgatgatttatgaagatgaaacagctgctgaggtcaagaatggcagcaaatcccagctaaaaactactaccaagaaaggagttgcctcaaaccttcaatcaaccatttcaagtcagaaaacaggtccatctcattctgatggtggcagttcctcccctagtaagtcagcaggcatgttagatgtgcccgacactctttttactaaaccaaagccaaagctagttcttgaagacctggttgaagaagccaactcaagacgtgctattgttacaagatctcacagcaacccaaaggagagaactacccaactagataaacaggcaaggaagagattgtctctgcctaacagtggggggggtactggcgctcaggtagccaggcatagcagaaacgctactagaggggcacctagctctcagaagcccatcaaggatagatccaagttaaacgggaaaggagatccaaacaccgcaaagtctgttgcacaggctgtttga

SEQ ID NO: 4339 - protein, 503 aa, Populus balsamifera subsp. trichocarpa
  misc_feature (1)..(503): useful for making plants with increased salt and oxidative stress resistance as described in USSN 12/922,143
  misc_feature (1)..(503): Ceres ANNOT ID no.1439623
  misc_feature (1)..(503): Bit score of 84.7 for HMM based on sequences of FIGURE 16 of USSN 12/922,143.
  misc_feature (163)..(183): Pfam Name: IQ Pfam Description: IQ calmodulin-binding motif
  misc_feature (1)..(503): Functional Homolog Of Ceres SEEDLINE ID no. ME24091
MDKNEVYPIIIHHPGVFYPTLGLTPHSLPLPRPLILFLLLLLLSFSLTLTDAPDSLLPASSYPSLPLRRTGKWFKALVGLKKSEKSQSLDKDENRTSASKFRHRRKHSVEFDGDKFEEEFDNHDNVATVGDTNVVSVPDASESPSASLQVQDVAHNQQVLREEWAATRIQTAFRGFLARRALRALKGLVRLQALVRGHAVRKQAAITLRCMQALVRVQARVRARRVRLALESQTAQHKLQQQLANEARVQEIEEGWCDSVGSVEQIQAKLLKRQEAAAKRERAMAYALAHQWQAGSRLQAAPSGFEPDKSSWGWNWLERWMAVRPWENRFLDINLRDGVMIYEDETAAEVKNGSKSQLKTTTKKGVASNLQSTISSQKTGPSHSDGGSSSPSKSAGMLDVPDTLFTKPKPKLVLEDLVEEANSRRAIVTRSHSNPKERTTQLDKQARKRLSLPNSGGGTGAQVARHSRNATRGAPSSQKPIKDRSKLNGKGDPNTAKSVAQAV

SEQ ID NO: 4340 - DNA, 1380 bp, Populus balsamifera subsp. trichocarpa
  misc_feature (1)..(1380): useful for making plants with increased salt and oxidative stress resistance as described in USSN 12/922,143
  misc_feature (1)..(1380): Ceres ANNOT ID no.1526424
atggggaagaaaggaagtggatggtttacatctgtgaagaaagtgttcaaatcatctcccaaggaattaccaatagagaaaaagaaagacaatgtagagaaatggcaacatgaggccccagaagttgtttcatttgagcattttcctgctgaaagttctcctgatgttacacatgatgagagcaatgcatcaagtccagtaactgaagatagaaaccatgtcattgctgtggcagtagcaactgctgctgcagctgctcaagcggcagctaacgttgttcgcttagccggttatggtcgatactctaaggaagaaagagctgccatcctcattcaatcatactataggggctaccttgctcggcgtgccttacgtgccttgaagggattggtgaggcttcaagcactagttaggggccataatgtacgaaagcaagcacaaatgacaatgagatgtatgcaagcacttgttcgagtgcaagcaagagtaagagcaagaaggcttcagttaactcatgagaagcttcaaatgaaggccgaggaagaagatgaacgaagactatcggtggttgaagaaattatgaatcctaagagtccattgaagagttataaatgggatagtaggaatcgaagtccaggtaaaatattcaaggaaaatgcttcaaagaaacatgatgctgtcatgaagagggaaagagcccttgcttatgcttacgcctacgagcagcagcagccattactctcccaaaatagtccaaacggtaaagaaataggacattttgtggatggaagtgagaaggctcaatggggctggaattggcttgagggatggatgtcagcacaaccatataatgtgcgtcaattgggtccaaatgaaggctcctatgtgacattaaacacaaccacagccacagccacgaccgatgacatgtccgagaagacagtggagatggacatggtcaccccaacaggcacgagcaactctaacatgggcatacttgatgccaatctgtcttcgaatcgacaccaacgacaactgagttcgagcaatgtacctagctacatggctccgacccaatccgcgaaggcaaaagtgcgtagtcagggctcgaccaagcaacaatatgccccaggtacacctctgcggaatccattcactaagaaaggatcaagcattaatggtggttcaggttgtgattcttctagttcaggtggcggcacaacttaccaggctctaaggagcccgagcccaaaacaaaacgggatgcgtctccattctaaaagacatgctggcgggtatagccctgatttcaatggtggtggtgatgattggagggtgcctcctcttgatggtcatggatggaggaatgatttcggttga

SEQ ID NO: 4341 - protein, 459 aa, Populus balsamifera subsp. trichocarpa
  misc_feature (1)..(459): useful for making plants with increased salt and oxidative stress resistance as described in USSN 12/922,143
  misc_feature (1)..(459): Ceres ANNOT ID no.1526424
  misc_feature (1)..(459): Bit score of 50.7 for HMM based on sequences of FIGURE 16 of USSN 12/922,143.
  misc_feature (105)..(125): Pfam Name: IQ Pfam Description: IQ calmodulin-binding motif
  misc_feature (1)..(459): Functional Homolog Of Ceres SEEDLINE ID no. ME24091
MGKKGSGWFTSVKKVFKSSPKELPIEKKKDNVEKWQHEAPEVVSFEHFPAESSPDVTHDESNASSPVTEDRNHVIAVAVATAAAAAQAAANVVRLAGYGRYSKEERAAILIQSYYRGYLARRALRALKGLVRLQALVRGHNVRKQAQMTMRCMQALVRVQARVRARRLQLTHEKLQMKAEEEDERRLSVVEEIMNPKSPLKSYKWDSRNRSPGKIFKENASKKHDAVMKRERALAYAYAYEQQQPLLSQNSPNGKEIGHFVDGSEKAQWGWNWLEGWMSAQPYNVRQLGPNEGSYVTLNTTTATATTDDMSEKTVEMDMVTPTGTSNSNMGILDANLSSNRHQRQLSSSNVPSYMAPTQSAKAKVRSQGSTKQQYAPGTPLRNPFTKKGSSINGGSGCDSSSSGGGTTYQALRSPSPKQNGMRLHSKRHAGGYSPDFNGGGDDWRVPPLDGHGWRNDFG

SEQ ID NO: 4342 - DNA, 1398 bp, Populus balsamifera subsp. trichocarpa; identical to SEQ ID NO: 3343
  misc_feature (1)..(1398): useful for making plants with increased salt and oxidative stress resistance as described in USSN 12/922,143
  misc_feature (1)..(1398): Ceres ANNOT ID no.1520883

SEQ ID NO: 4343 - protein, 465 aa, Populus balsamifera subsp. trichocarpa
  misc_feature (1)..(465): useful for making plants with increased salt and oxidative stress resistance as described in USSN 12/922,143
  misc_feature (1)..(465): Ceres ANNOT ID no.1520883
  misc_feature (1)..(465): Bit score of 60.5 for HMM based on sequences of FIGURE 16 of USSN 12/922,143.
  misc_feature (112)..(132): Pfam Name: IQ Pfam Description: IQ calmodulin-binding motif
  misc_feature (1)..(465): Functional Homolog Of Ceres SEEDLINE ID no. ME24091
MGKKGKGWFTSVKRVFKSSSPKELPVGKKKDNAEKWQHEAPEVVSLEHFPTGSSPDVTNDESNVSTPVTEDRNHAIAVAVATAAAAEAAVAAAQAAAKVVRLAGYGRQSKEERAAILIQSFYRGYLARRALRALKGLVRLQALVRGHNVRKQAQMTMRSMQALVRVQARVRARRLELAHEKLQRKTEEEDERRLPVDEDFMNPKNPLKSYKWDRRNQSSDNFKENASKKHDAVMKRERALAYAYAFQQQQQQQLLSQNSPNGKETGHFVNEHEKMQWGWNWLERWMSAQSYNVRQSGPNEGSYVTVNTTTTTTTTEDMSEKTVEMDMVTPTGTSNPNMGMLDTNPYSNRPQWQSSSSNVRSYMAPTQSAKAKVRSQSLIKQRAPATPLWNPSTKKDSSIVGPGCDSSSSGGGTTTYHAPRSPSPKHNGMRLHSRRHAGGYSPDFNGGDDWRLPPLDGHGWRNDFG

SEQ ID NO: 4344 - DNA, 1659 bp, Populus balsamifera subsp. trichocarpa
  misc_feature (1)..(1659): useful for making plants with increased salt and oxidative stress resistance as described in USSN 12/922,143
  misc_feature (1)..(1659): Ceres ANNOT ID no.1467154
atgggaaagaagggcggtacctcatggttgaccatcgtgaaaagagcattcaggtctccaagtaaagagaatgagaaaaagagtagcagaaggagagaagaacatgaccaggaagaggaagaaaagaaaagagagaaaagaagatggctttttagaaagacgtcgtccagcactaaccatgtcccagttcaacgatgtgaagaaaatattgcaataacgaacacaacaagtactgccactgcacccttgagtcctactttggatgctgagaaaaaacttgcagtggcagtggcagcagccacagctgcggcagctgatgctgcagctgtaacagcccaagcagcagtagagattgttagactcactagaccagcttccatctttgttagagctaaactctgggctgctattgccattcaaacggcctttagaggctacctagcaaggagagctctacgtgcactgaaagggctagtgaagcttcaagctttggtaagaggacacaatgtaagaaagcaagcgaagctaacacttcaatacatgcaagctttagctcgagtacaagatcgagtccgtgaccaccgagcaaggctttcacatgaagggagcagaaggtccatgttttctgagactaatagctcatgggagttcaaatatctccacgaaatccgtgagaggaagtccatgtcgagagatgtaagctctgttctagatgattgggatgatcgtccacgcaccaatgaagagattgaagccatggtggaaagtaagaaggaagctgcattaaaacgtgaaaaggccctggcttatgctttctctagccagatatggaggtctagaaggaacccatcagcaggggatgaaaaggagcttgaagacagaacaggatggcttgatcgctggatggcaacaaagcaatgggaggcaagtagcagggcaataacagatagaaaagacaacagtataaagactgtagaaatggacacatctagaccattttcatattctactacaacttcttctcaaagattacaaagccaaaatcacctacaaaaacaaacccccagacattctattgcttctcctctccatagatcacactccagtctttctctccaccaatcgccaatcacaccctctccttgcaaacccaggccccttcaagtacgttcagccagtccaagatgcctaaaagaagaaaaaaaatgctactcagcagcacatactccaagcttgagctctagatatttcatgaacaatggtattggtcgacatggaatggtgggtgcaagtgggggcactgctacaatcttgccaaactacatggcagcaactgagtcagcaaaggctcgtgttaggccacagagtgcaccaaggcagagaccatcgacacctgagagagaacgtggtggatcggttgcgaagaaacgtctgtcattcccagttcaagatcatggaccacatggaaatggtgctggcattattgactacagtagcaataggagcttcagtcagaatttaaggagccctagcttcaagagtgtgcatggttgccactttggaatgggagagcaatcaaattatttctcatgttataatgagagcattggtggagaaatatctccttgttccacgactgaccttaggtggttaaaataa

SEQ ID NO: 4345 - protein, 552 aa, Populus balsamifera subsp. trichocarpa
  misc_feature (1)..(552): useful for making plants with increased salt and oxidative stress resistance as described in USSN 12/922,143
  misc_feature (1)..(552): Ceres ANNOT ID no.1467154
  misc_feature (1)..(552): Bit score of 76.4 for HMM based on sequences of FIGURE 16 of USSN 12/922,143.
  misc_feature (133)..(153): Pfam Name: IQ Pfam Description: IQ calmodulin-binding motif
  misc_feature (1)..(552): Functional Homolog Of Ceres SEEDLINE ID no. ME24091
MGKKGGTSWLTIVKRAFRSPSKENEKKSSRRREEHDQEEEEKKREKRRWLFRKTSSSTNHVPVQRCEENIAITNTTSTATAPLSPTLDAEKKLAVAVAAATAAAADAAAVTAQAAVEIVRLTRPASIFVRAKLWAAIAIQTAFRGYLARRALRALKGLVKLQALVRGHNVRKQAKLTLQYMQALARVQDRVRDHRARLSHEGSRRSMFSETNSSWEFKYLHEIRERKSMSRDVSSVLDDWDDRPRTNEEIEAMVESKKEAALKREKALAYAFSSQIWRSRRNPSAGDEKELEDRTGWLDRWMATKQWEASSRAITDRKDNSIKTVEMDTSRPFSYSTTTSSQRLQSQNHLQKQTPRHSIASPLHRSHSSLSLHQSPITPSPCKPRPLQVRSASPRCLKEEKKCYSAAHTPSLSSRYFMNNGIGRHGMVGASGGTATILPNYMAATESAKARVRPQSAPRQRPSTPERERGGSVAKKRLSFPVQDHGPHGNGAGIIDYSSNRSFSQNLRSPSFKSVHGCHFGMGEQSNYFSCYNESIGGEISPCSTTDLRWLK

SEQ ID NO: 4346 - DNA, 1593 bp, Populus balsamifera subsp. trichocarpa
  misc_feature (1)..(1593): useful for making plants with increased salt and oxidative stress resistance as described in USSN 12/922,143
  misc_feature (1)..(1593): Ceres ANNOT ID no.1462019
atgactccacgcactaagaaacggcatcgttcactgtttaaaatgaaagcaacgagagaatttcatttttccttagcgaatccaaattctcagtcagcgagcgagcgagcgagttttgacttgcgggctgggattgataagatcgaacggtcaaaaaggaagtggcaccatatgggtgtctcagggaaatggtttaaagctttggttggtctaaagaagtctgaaaagtcacagtctttggacaaagaggaaaatggggcgactgctagcaagtctcgacataggagaaagcattcggttgagtttgatgctgataaaattcaagaggagtttcataatcataatcataatcataatcataatcataatgatggtgacgccaacattcgttccatcccagatacttctgaatctccttttgattcgcttcaagttcaggatttagctcataatcaacaagttatgagagaagaattggctgccactcgcattcaaacagctttccgcgggtttctgggagttggggctttggaattctcacatgttccactaaagctctctcaggcaagaagagctctgcgagctttgaaaggattagtgagactgcaagctcttgttcggggccatgctgtgagaaaacaagctgcaataactcttcgctgcatgcaagctttggtgagagttcaggctcgagttcgtgcaaggcgtgttcgcttagcattggaaagtcaaacagctcaacagaaacttcagcaacaactagctaatgaggcccgggttcgagaaatagaggcttgccaagtgccttatatcaatttcacttttacacaggaaggatggtgtgatagtgtgggatctgttgaacaaattcaagccaagttgctgaagcggcaggaggctgcagctaagcgtgagagagctattgcatatgctctggcccatcagtggcaggctgggtcaagacaccaggctgttccatctggttttgaaccagataaaagcagttggggctggaactggttggagagatggatggctgttcgcccatgggagaaccgctttcttgacataaatcttagagatggagtgatgattcgtgaggatgaaacagctgctgaggtcaggaatggcagcaaatcccagttaaaaacaactgccaagaaagctattgcctcagatcttcagtcaaccatttcaagtcagaaaaaaggtccatctcattctgatggtggcagttcctcacctagtaagtcagcaggcatgttagaagcacccaacacacttttttctaaaccaaagccaaagccagttcttgaagacctggttgaagaagccatttcaaaacctgctatggctacaagatctcacagcaacccaaaggagagaaccacccaactagataaacaggcaaagaagagattgtctctgcctaacagtgttgaagcagggggaggtgcgggcactcaggcagctaggaatagcagaaatgctgctagagggacacctagctctcagaagcccatcagagatagatccaagttaaacgggaaaggagattcaaacaccacaaagtctgttgcacaggctgtttga

SEQ ID NO: 4347 - protein, 473 aa, Populus balsamifera subsp. trichocarpa
  misc_feature (1)..(473): useful for making plants with increased salt and oxidative stress resistance as described in USSN 12/922,143
  misc_feature (1)..(473): Ceres ANNOT ID no.1462019
  misc_feature (1)..(473): Bit score of 62.7 for HMM based on sequences of FIGURE 16 of USSN 12/922,143.
  misc_feature (101)..(115): Pfam Name: IQ Pfam Description: IQ calmodulin-binding motif
  misc_feature (1)..(473): Functional Homolog Of Ceres SEEDLINE ID no. ME24091
MGVSGKWFKALVGLKKSEKSQSLDKEENGATASKSRHRRKHSVEFDADKIQEEFHNHNHNHNHNHNDGDANIRSIPDTSESPFDSLQVQDLAHNQQVMREELAATRIQTAFRGFLGVGALEFSHVPLKLSQARRALRALKGLVRLQALVRGHAVRKQAAITLRCMQALVRVQARVRARRVRLALESQTAQQKLQQQLANEARVREIEACQVPYINFTFTQEGWCDSVGSVEQIQAKLLKRQEAAAKRERAIAYALAHQWQAGSRHQAVPSGFEPDKSSWGWNWLERWMAVRPWENRFLDINLRDGVMIREDETAAEVRNGSKSQLKTTAKKAIASDLQSTISSQKKGPSHSDGGSSSPSKSAGMLEAPNTLFSKPKPKPVLEDLVEEAISKPAMATRSHSNPKERTTQLDKQAKKRLSLPNSVEAGGGAGTQAARNSRNAARGTPSSQKPIRDRSKLNGKGDSNTTKSVAQAV

SEQ ID NO: 4348 - DNA, 1713 bp, Populus balsamifera subsp. trichocarpa; identical to SEQ ID NO: 3349
  misc_feature (1)..(1713): useful for making plants with increased salt and oxidative stress resistance as described in USSN 12/922,143
  misc_feature (1)..(1713): Ceres ANNOT ID no.1444522

SEQ ID NO: 4349 - protein, 570 aa, Populus balsamifera subsp. trichocarpa
  misc_feature (1)..(570): useful for making plants with increased salt and oxidative stress resistance as described in USSN 12/922,143
  misc_feature (1)..(570): Ceres ANNOT ID no.1444522
  misc_feature (1)..(570): Bit score of 57.4 for HMM based on sequences of FIGURE 16 of USSN 12/922,143.
  misc_feature (133)..(153): Pfam Name: IQ Pfam Description: IQ calmodulin-binding motif
  misc_feature (1)..(570): Functional Homolog Of Ceres SEEDLINE ID no. ME24091
MGKKGGSSWLTAVKRAFRSPTKESDKRATGVGHDQEEDEEKKRGKRRWLFRKPTNQETATQQNLSKAGNVKASPGGGGGAPADHVSAAAAAEQRHAIAVAVATAAAAEAAVATAQAAAEVARLTRPSYHPREHYAAIVIQTAFRGYLARRALRALKGLVKLQALVRGHNVRKQAKMTLRCMQALARVQARVLDQRVRLSHEGSRKSAFSDTNSVLESRYLQDISDRKSMSRESSSIADDWDDRPHSIEEVKAMLQRRKEAAFKREKTLSQAFSQQLMANWFNFFKPMSKIWRNGRSPSNGNEDELQERPQWLDQWMPAKPWDNSSRARASTDQRDPIKTVEIDTSQPYSYLVPNFRRTNQNQHHQHQRSNSSNNGVAHSAPSPLHRAHQTAPLHHSPITPSPSKTRPLQVRSASPRCAREDRSCNSSQTPSLRSNYFYNGSLNQHGIRGGASVSSNGNATLPNYMAATESAKARLRSQSAPRQRPSTPERDRIGSARKRLSYPAPDPCDVGIVYGGAGYGHGLRSPSFKSVSGSRLGGLEQQSNYSSCCTDSFGGELSPSSTNDLRRWLR

SEQ ID NO: 4350 - DNA, 1918 bp, Arabidopsis thaliana
  misc_feature (1)..(1918): useful for making plants with increased salt and oxidative stress resistance as described in USSN 12/922,143
  misc_feature (1)..(1918): Ceres CLONE ID no.106263
acaaatactcttcttcacacagctttgaatccatctgtcttctcctctctctctcttctccatttgcaattacgataatgtgaaagcaataagaagaggaaaagttatcttcgcacctcagcaaagatccaatcgattcgattcttaagctttttcgtcttctccgataaggtcactacttagaagccgcgttgtggtttagttgactcctccaggttttatcttcaagctttttcgtctatcagatctggtgtcactgtcttctcataggattacatagagatggggaaaaaagctaaatggttttcaagtgttaagaaagcattcagcccagattcaaagaagtcgaagcaaaaattggctgagggacaaaatggtgttatctctaatcctcctgttgtggataatgttagacaatcttcttcttctcctcctcctgctcttgctcctcgtgaagtgagagtagctgaagtgattgttgaacggaacagggatctttcacctccttctacagcagatgctgtgaatgttacagctactgatgttcctgtagttccatcttcatctgctcctggtgttgttcgtcgcgctacacctactcgatttgctggaaagtcaaacgaagaagccgctgctatcttgatccagactatatttagaggttatttggcaaggagagcgttgcgggcaatgaggggtttggtcagacttaagttattgatggaaggatctgttgttaagcggcaagctgcaaatactctaaaatgtatgcagactctctctcgtgtacagtcgcagatccgagctaggagaatcaggatgtcagaagagaatcaggctcgccagaaacaactccttcagaaacatgctaaagagctagctggcttgaagaacggggataactggaatgatagcattcaatcaaaggagaaagttgaagcgaatttgctaagcaagtacgaggcaacaatgagaagggaaagggcattggcttattcatactctcatcagcaaaactggaagaacaactctaaatctggaaacccgatgttcatggatccaagcaacccgacatggggttggagctggttggagagatggatggctggtaggccactagagagttccgagaaagaacaaagcaacagcaacaatgacaatgctgcctcggtcaagggctctattaaccgcaacgaagctgcaaaatctctaacccgcaatggctcaactcaaccaaacacaccatcatccgcaagagggaccccaagaaacaaaaacagtttcttctcacctccaactccctcaaggctaaaccaatcctcgaggaaatccaatgacgacgactccaaaagcacaatctcggtcctgtccgagaggaaccgcagacacagcattgctggttcatcagtcagagacgatgagagcctcgctggctcaccagctctcccgagctacatggttccaactaaatcagctcgagccaggctcaagccccaaagcccattaggtggtaccacacaggaaaacgaagggttcacagacaaggcatcagctaagaaacggctctcgtatccaacttcgcctgcattgcctaaaccacggcggttctcagctccccctaaggtggagagtggcggcgttaccgtgaccaacggagcaggcagctgaggtattttatttaatataattattttcccacttatgaatgtgtccgagattgttgtctcttatgtgttcccttcatttcgtaattcatttgtgcagtgtaagcgccagtcatttatttttttactataataaattttataaccttttaaaattcatgttcttttgtttctttgaatatttaagttatttttattaatgttggatgaattggaatatgatgatgttatttgtattgtaatgcagatccttt

SEQ ID NO: 4351 - protein, 461 aa, Arabidopsis thaliana; identical to SEQ ID NO: 3382
  misc_feature (1)..(461): useful for making plants with increased salt and oxidative stress resistance as described in USSN 12/922,143
  misc_feature (1)..(461): Ceres CLONE ID no.106263
  misc_feature (1)..(461): Bit score of 1078.0 for HMM based on sequences of FIGURE 16 of USSN 12/922,143.
  misc_feature (115)..(135): Pfam Name: IQ Pfam Description: IQ calmodulin-binding motif
  misc_feature (1)..(461): Functional Homolog Of Ceres SEEDLINE ID no. ME24091
  misc_feature (88)..(88): Xaa is any aa, unknown or other
  misc_feature (180)..(180): Xaa is any aa, unknown or other
  misc_feature (243)..(243): Xaa is any aa, unknown or other
  misc_feature (370)..(370): Xaa is any aa, unknown or other
  misc_feature (377)..(377): Xaa is any aa, unknown or other

SEQ ID NO: 4352 - protein, 445 aa, Arabidopsis thaliana; identical to SEQ ID NO: 3400
  misc_feature (1)..(445): useful for making plants with increased salt and oxidative stress resistance as described in USSN 12/922,143
  misc_feature (1)..(445): Public GI ID no.7413581
  misc_feature (1)..(445): Bit score of 995.5 for HMM based on sequences of FIGURE 16 of USSN 12/922,143.
  misc_feature (114)..(134): Pfam Name: IQ Pfam Description: IQ calmodulin-binding motif
  misc_feature (1)..(445): Functional Homolog Of Ceres SEEDLINE ID no. ME24091

SEQ ID NO: 4353 - protein, 454 aa, Arabidopsis thaliana
  misc_feature (1)..(454): useful for making plants with increased salt and oxidative stress resistance as described in USSN 12/922,143
  misc_feature (1)..(454): Public GI ID no.15232741
  misc_feature (1)..(454): Bit score of 578.9 for HMM based on sequences of FIGURE 16 of USSN 12/922,143.
  misc_feature (108)..(128): Pfam Name: IQ Pfam Description: IQ calmodulin-binding motif
  misc_feature (1)..(454): Functional Homolog Of Ceres SEEDLINE ID no. ME24091
MVKKAKWLKNVKKAFSPDSKKLKHESVECQDSVISYPVLIATSRSSSPQFEVRVDEVNYEQKKNLYPPSSDSVTATVAHVLVDSPPSSPESVHQAIVVNRFAGKSKEEAAAILIQSTFRGHLARRESQVMRGQERLKLLMEGSVVQRQAAITLKCMQTLSRVQSQIRSRRIRMSEENQARHKQLLQKHAKELGGLKNGGNWNYSNQSKEQVEAGMLHKYEATMRRERALAYAFTHQQNLKSFSKTANPMFMDPSNPTWGWSWLERWMAGRPWESSEKEQNTTNNDNSSVKNSTNRNSQGGETAKSSNRNKLNSSTKPNTPSASSTATRNPRKKRPIPSSIKSKSSDDEAKSSERNRRPSIARPSVSDDETLSSSTARRSSNLIPTTKSARGKPKSQTSSRVAVTTSTTEESSILPEKAPAKKRLSTSASPAPKPRRSSAPPKVEKGVLKAERTP

SEQ ID NO: 4354 - protein, 430 aa, Arabidopsis thaliana; identical to SEQ ID NO: 3412
  misc_feature (1)..(430): useful for making plants with increased salt and oxidative stress resistance as described in USSN 12/922,143
  misc_feature (1)..(430): Public GI ID no.15231175
  misc_feature (1)..(430): Bit score of 521.2 for HMM based on sequences of FIGURE 16 of USSN 12/922,143.
  misc_feature (108)..(128): Pfam Name: IQ Pfam Description: IQ calmodulin-binding motif
  misc_feature (1)..(430): Functional Homolog Of Ceres SEEDLINE ID no. ME24091

SEQ ID NO: 4355 - protein, 516 aa, Arabidopsis thaliana
  misc_feature (1)..(516): useful for making plants with increased salt and oxidative stress resistance as described in USSN 12/922,143
  misc_feature (1)..(516): Public GI ID no.15225299
  misc_feature (1)..(516): Bit score of 157.2 for HMM based on sequences of FIGURE 16 of USSN 12/922,143.
  misc_feature (137)..(157): Pfam Name: IQ Pfam Description: IQ calmodulin-binding motif
  misc_feature (1)..(516): Functional Homolog Of Ceres SEEDLINE ID no. ME24091
MKDLSENFRRKWKPEKPKRKWSFGKQKSRESFDFPLEETPPVDPSPSSVHRPYPPPPPLPDFAPQPLLPPPSPPPPPPAYTINTRIYGESKESKNRQALALASAVAAEAAVVAAHAAAEVIRLTTPSTPQIEESKEETAAIKIQNAYRCYTARRTLRALRGMARLKSLLQGKYVKRQMNAMLSSMQTLTRLQTQIQERRNRLSAENKTRHRLIQQKGHQKENHQNLVTAGNFDSSNKSKEQIVARSVNRKEASVRRERALAYAYSHQQTWRNSSKLPHQTLMDTNTTDWGWSWLERWMASRPWDAESIDDQVSVKSSLKRENSIKSSPARSKTQKSASQSSIQWPVNNDTKSRKIEVTNRRHSIGGGSSENAKDDESVGSSSSRRNSLDNTQTVKSKVSVETTSNVSNAQTVKPKANVGAKRNLDNTKTLKSKSSVGTTGNLANTEAVKSKVNVGTTSMPKKEVVADKKKPPQMVLPKKRLSSSTSLGKTKKLSDSDKATTGVANGEKKRRNGGSS

SEQ ID NO: 4356 - protein, 517 aa, Arabidopsis thaliana; identical to SEQ ID NO: 3288
  misc_feature (1)..(517): useful for making plants with increased salt and oxidative stress resistance as described in USSN 12/922,143
  misc_feature (1)..(517): Public GI ID no.15231733
  misc_feature (1)..(517): Bit score of 78.0 for HMM based on sequences of FIGURE 16 of USSN 12/922,143.
  misc_feature (169)..(189): Pfam Name: IQ Pfam Description: IQ calmodulin-binding motif
  misc_feature (1)..(517): Functional Homolog Of Ceres SEEDLINE ID no. ME24091

SEQ ID NO: 4357 - DNA, 1703 bp, Glycine max; identical to SEQ ID NO: 3403
  misc_feature (1)..(1703): useful for making plants with increased salt and oxidative stress resistance as described in USSN 12/922,143
  misc_feature (1)..(1703): Ceres CLONE ID no.467508

SEQ ID NO: 4358 - protein, 477 aa, Glycine max; identical to SEQ ID NO: 3404
  misc_feature (1)..(477): useful for making plants with increased salt and oxidative stress resistance as described in USSN 12/922,143
  misc_feature (1)..(477): Ceres CLONE ID no.467508
  misc_feature (1)..(477): Bit score of 1227.7 for HMM based on sequences of FIGURE 16 of USSN 12/922,143.
  misc_feature (119)..(139): Pfam Name: IQ Pfam Description: IQ calmodulin-binding motif
  misc_feature (1)..(477): Functional Homolog Of Ceres SEEDLINE ID no. ME24091

SEQ ID NO: 4359 - protein, 468 aa, Medicago truncatula
  misc_feature (1)..(468): useful for making plants with increased salt and oxidative stress resistance as described in USSN 12/922,143
  misc_feature (1)..(468): Public GI ID no.92868235
  misc_feature (1)..(468): Bit score of 1210.9 for HMM based on sequences of FIGURE 16 of USSN 12/922,143.
  misc_feature (108)..(128): Pfam Name: IQ Pfam Description: IQ calmodulin-binding motif
  misc_feature (1)..(468): Functional Homolog Of Ceres SEEDLINE ID no. ME24091
MGKKGNWFSTVKKALSPDSKKSSKSKKKWFGKQKLQTSDPSVEIDTALPLPPPEDIKLTDIENQNNHHNVAEITTVVDVEEPVRSVQTAVVKTQAATVSRFAGKPKDEVAAIKIQTAFRGYLARRALRALRGLVRLKTLMEGPAVKRQAMSTLRSMQTLARVQSQIRSRRVRMLEENQALQRQLLQKHAKELETMRIGEEWDDSLQSKEQIEAKLLSKYEATMRRERALAYAFTHQQNSKNSSRSMNPMFVDPTNPTWGWSWIERWMAARPWESRGLVDKELNDHSSVKSSSRSIIGGEISKSFARFQLNSEIHSPVASQNPGSPSFQSNSTPTKPASASVARKLKKASPKGSWVMDDDSKSMASVQSDRFRRHSIAGSSVRDDESLASSPSVPSYMVPTQSAKARLRTQSQSPLAKENGKQEKGSFGTAKKRLSFPASPARPRRHSGPPKVETAINAELPVPNGVAS

SEQ ID NO: 4360 - protein, 438 aa, Medicago truncatula
  misc_feature (1)..(438): useful for making plants with increased salt and oxidative stress resistance as described in USSN 12/922,143
  misc_feature (1)..(438): Public GI ID no.92876066
  misc_feature (1)..(438): Bit score of 74.3 for HMM based on sequences of FIGURE 16 of USSN 12/922,143.
  misc_feature (96)..(116): Pfam Name: IQ Pfam Description: IQ calmodulin-binding motif
  misc_feature (1)..(438): Functional Homolog Of Ceres SEEDLINE ID no. ME24091
MGVPGKWIRALVGLKKSEKRESLEKDGNASKFRHRRKNSVEIDNGKLQNEFDNDGAAPIGDADHANPQSNLEAHYSPSTSQQVQDPAHNHQITSEEWAAICIQTAFRGFLARRALRALKGLVRLQALVRGHAVRKQAAITLRCMQALVRVQARVRARRVRLSLESQTEQQKLQQQLVNEARVREIEEGWCDSVGSVEEIQAKILKRQEAAAKRERAMAYALAHQWQAGSRQQAISSGFEPDKSSWGWNWLERWMAVRPWENRFLDINTKDGVKADENDVMDGRNGIRPQFKSTNTKSNLANIHPSVVSHKTGPSLSDGCDSSSTSKSAGLLETSNTQSVKPKSNANVQNPVEETNSKSGVQRSQSNPKERNSQVDKPAKKRLSLPNHGVGSGAQTAKYPTRSNMKGTRSTQKPTRDKPKLNGGGDVNLTKSVPPPAVV

SEQ ID NO: 4361 - DNA, 1695 bp, Triticum aestivum; identical to SEQ ID NO: 3392
  misc_feature (1)..(1695): useful for making plants with increased salt and oxidative stress resistance as described in USSN 12/922,143
  misc_feature (1)..(1695): Ceres CLONE ID no.826796

SEQ ID NO: 4362 - protein, 378 aa, Triticum aestivum; identical to SEQ ID NO: 3393
  misc_feature (1)..(378): useful for making plants with increased salt and oxidative stress resistance as described in USSN 12/922,143
  misc_feature (1)..(378): Ceres CLONE ID no.826796
  misc_feature (1)..(378): Bit score of 469.0 for HMM based on sequences of FIGURE 16 of USSN 12/922,143.
  misc_feature (4)..(24): Pfam Name: IQ Pfam Description: IQ calmodulin-binding motif
  misc_feature (1)..(378): Functional Homolog Of Ceres SEEDLINE ID no. ME24091

SEQ ID NO: 4363 - DNA, 1806 bp, Zea mays; identical to SEQ ID NO: 3401
  misc_feature (1)..(1806): useful for making plants with increased salt and oxidative stress resistance as described in USSN 12/922,143
  misc_feature (1)..(1806): Ceres CLONE ID no.228069

SEQ ID NO: 4364 - protein, 476 aa, Zea mays; identical to SEQ ID NO: 3402
  misc_feature (1)..(476): useful for making plants with increased salt and oxidative stress resistance as described in USSN 12/922,143
  misc_feature (1)..(476): Ceres CLONE ID no.228069
  misc_feature (1)..(476): Bit score of 1140.1 for HMM based on sequences of FIGURE 16 of USSN 12/922,143.
  misc_feature (108)..(128): Pfam Name: IQ Pfam Description: IQ calmodulin-binding motif
  misc_feature (1)..(476): Functional Homolog Of Ceres SEEDLINE ID no. ME24091

SEQ ID NO: 4365 - DNA, 2117 bp, Panicum virgatum
  misc_feature (1)..(2117): useful for making plants with increased salt and oxidative stress resistance as described in USSN 12/922,143
  misc_feature (1)..(2117): Ceres Clone ID no. 1806867
gtcactctcgccactgctcccagctgttgcgacttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttgtgcgtgtttgccaccgtggtcttgttatcatcgtccaacgttgggtcgtctgatagatatagatctgggccatctggtgatttgcttgttcctcttcagggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactgacccgtccagcctccaggcaatccccttcgacgccctctgctaaagtagcgccaatacctgctaggagaaaatccgccacgccaaagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccggagaaaggaagctctgctggaccggtcaagaaaaggttgtcatttcaaggtggaacagcggctgcctcaccaatgcgacggcattctggtcctcccaaggtggacagtgtgatgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttccg

SEQ ID NO: 4366 - protein, 471 aa, Panicum virgatum
  misc_feature (1)..(471): useful for making plants with increased salt and oxidative stress resistance as described in USSN 12/922,143
  misc_feature (1)..(471): Ceres Clone ID no. 1806867
  misc_feature (1)..(471): Bit score of 1130.7 for hmm based on sequences of FIGURE 16.
  misc_feature (104)..(124): Pfam Name: IQ Pfam Description: IQ calmodulin-binding motif
  misc_feature (1)..(471): Functional Homolog Of SEQ ID NO. 922
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPKNGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSVMKDIVAPPQPEALVINGGSK

SEQ ID NO: 4367 - DNA, 2233 bp, Panicum virgatum
  misc_feature (1)..(2233): useful for making plants with increased salt and oxidative stress resistance as described in USSN 12/922,143
  misc_feature (1)..(2233): Ceres Clone ID no. 1883040
gagaaaaaaggttgggctgcttgcccttcctttgctttttggtactttctttccgtctccggtttatttttccttcgtcctggatgcgctggtcgcgggtttgatctgaccaagacgtagaggcggtggtagaggtccgtggggtgggcggtggcttgctagagttaggtccttggcgcattcaggcgggtgaggaaggtgaggggctcagggctttcggtggttgcttgcttgcttgcttgctttgcctttctcgcggtaaaatcggatcttttggggttttgcgcgccgctatttgattcttcttggctggcttcgcctgcgcctttgttttggggttttgctgggttggtttcttcgcgattgtggtcgagggcggtgcggcgggtgcctcaggcacagctgcgagggtttctctgggtctggggcaacatccactcttcccgtttgtgattcgaccttctggcttgccgccgagacattgaagacacagtaatagaacacaaaaaatgggtaaaaagggaaagtggtttagtgctgtcaagaaagtcttcggctcctctgatccagatggaaaggaagcaaaggttgagaaggcggataagtcaaaatccaggaggagatggccatttggaaagtcgaggcactctgatccttctacctcaatggtgtcagggactgctccagtagctccgttgcctccgccaccaccaatacaacttactcagccacactcccaggagattaaagatgtcaagccagttgaaacagacagtgagcagaacaagcatgcatactctgttgcccttgcatccgctgttgctgctgaagctgatgcagttgctgcccaggccgctgctgaggttgtgcgcctcacagcagttaccacggcagcaccaaaaatgcctgtaacttcaagggaagaacttgccgccatcaagattcagactgccttcaggggttatctggcaaggagagcattgcgggcactaagagggctagttagattgaagtcacttgtcgatggaaatgctgtcaagcgccaaacttctcacactttgcattgcacacaaacgatgacaagagttcaaactcaaatctactctagaagggtgaagttggaggaggaaaaacaagctcttcaaaggcagctccaattgaaacatcaaagggaacttgagaaaatgaagattgaagaagactgggatcacagccatcaatccaaagaacaaattgaggccagcctagttatgaaacaagaagctgcactaaaacgagaaagagcacttgcatatgcattttctcaccagtggagaaattctggtcgaactataaccccaactttcacagaacctgggaatcctaactggggctggagctggatggaacgctggatgacagcaagaccttgggagagccgattggcagcatcagacaaggataataaagagcgttctctgacaaagaattccagcagcagtgctgttcgaatgtctgtaccccgtgccatctcaatccagaggccagcaacaccaaacaagtcaagccgtccaccaagccggcagtcaccttcaacaccgccatcgaaggcaccatctacctcaggaaagaccaggccagcaagtccaaggggcagctggctgtacaaggaagatgacctgaggagcatcacaagcatacgctctgaacgcccaaggaggcaaagcataggcggaggctcggtccgggatgatgcaagcctgactagcacaccacctctccccagttatatgcagtcgacagagtctgcgagggcaaagtctcgataccgcagcttgttgactgaaaagcttgaggtttcagagagggcacctctggcccattcggttgttaagaagcgcctctccttccctgtcatcgacaaaccgagcagtccaccggcagataagacaaaggaaagagcgaggcgccattcagaccctccgaaggttgatcctgcaatgctgaaggatgcccctgttgcctgatcaggcccttgtgattgttaggtttcgtgctgttttaactccatgatgtattttctatgttagattgttttctctgcgtaatgtctaatctgtccgggttgatttgagaattgaggcaattctaactgtatttgctgtcatggttttctccctgtagattgatacgtgtgattctaatagtgtatgcccttggctttcaatgtacgatataacggtttttgacagac

SEQ ID NO: 4368 - protein, 498 aa, Panicum virgatum
  misc_feature (1)..(498): useful for making plants with increased salt and oxidative stress resistance as described in USSN 12/922,143
  misc_feature (1)..(498): Ceres Clone ID no. 1883040
  misc_feature (1)..(498): Bit score of 578.4 for hmm based on sequences of FIGURE 16.
  misc_feature (139)..(159): Pfam Name: IQ Pfam Description: IQ calmodulin-binding motif
  misc_feature (1)..(498): Functional Homolog Of SEQ ID NO. 922
MGKKGKWFSAVKKVFGSSDPDGKEAKVEKADKSKSRRRWPFGKSRHSDPSTSMVSGTAPVAPLPPPPPIQLTQPHSQEIKDVKPVETDSEQNKHAYSVALASAVAAEADAVAAQAAAEVVRLTAVTTAAPKMPVTSREELAAIKIQTAFRGYLARRALRALRGLVRLKSLVDGNAVKRQTSHTLHCTQTMTRVQTQIYSRRVKLEEEKQALQRQLQLKHQRELEKMKIEEDWDHSHQSKEQIEASLVMKQEAALKRERALAYAFSHQWRNSGRTITPTFTEPGNPNWGWSWMERWMTARPWESRLAASDKDNKERSLTKNSSSSAVRMSVPRAISIQRPATPNKSSRPPSRQSPSTPPSKAPSTSGKTRPASPRGSWLYKEDDLRSITSIRSERPRRQSIGGGSVRDDASLTSTPPLPSYMQSTESARAKSRYRSLLTEKLEVSERAPLAHSVVKKRLSFPVIDKPSSPPADKTKERARRHSDPPKVDPAMLKDAPVA

SEQ ID NO: 4369 - DNA, 1593 bp, Panicum virgatum
  misc_feature (1)..(1593): useful for making plants with increased salt and oxidative stress resistance as described in USSN 12/922,143
  misc_feature (1)..(1593): Ceres CLONE ID no.1769872
aaagcggaggcgaaagcgaaggggagtgggagggcagcggtcggctggtcgggccggcggcgacggtgacgcctcgctcgctgcggccctacgcattccgcgcaggtgctagctgttgaactcgcacccaaaaaaaaaaagagctatcatggggatttcagctaagtggataaaatcacttgttgggctaagaaagcatgaaaaggggcgaaacgctgaaagcagcgccgggaggagctctggtgcccagttgctacacacacaggatcattctgtagatacagaaggtgctcttgcagctgaagaactcagagtacaagctgaaccattggctgctgaagcaaacacagagacaatatcaaattccccttcctcaccaagcacatcttttcaagtttctcagactgaacatggtacaaaggagtaccaggctgctgtggttattcagtccacctttcgagcattcctggcaaggcgtgctttacgagcgttaaaagggctagttagactccaggcacttgtaagaggtcatgctgtaagaaagcaagcagcagaaacacttcagtgcatgcaagcgctggtgagagctcaaactcgtgtgagagcaagacgagtccgtgtttctttggaaagccaagggacccaaaagaaacctcctgaaaagaatgctcatgaggaccatgttcgagatattgaggaagactggtgtggtagtataggttcagtagaagaaattaaagctaaggcgttaaaaaggcaagaagctgcagctaagcgggaaagggcgatggcttatgctttaacccatcagtggcaaacaggttcgaggaaacagaaagcagcgagcctccaagaccaaggacttgcaggggacgaaaatcagtgggggcgaaactggttagaaaggtggatggctgcacgcccatgggagaacaggttacttgacagtaatgccaaagaaagtgtcacagttggtgatgacaaacctgctgaggaagacaaggctaaagctctgaacaaaccgaagggaaaagtacctgtttcaaccacacaatcaaatggatcgcggcagaagaaagtcacaggccacaagaagtcacattctgatgtaagtggctcttcatcggggcagtctgcaagtgtgcaaccaactgcttctttggagtcatccaagatcaaagagaagccatcagatgaaatcactgatgaagtcagctctcaaccttcgaaattggcttcccgatccacgagcaatccaaaagaaaggccagcacaaatcaatgcaccagcgaagaagcgattatcccttcctaacaatgcaacagccaacgggggtgtaggaaagcgccatgccaacagtagccggacaacccaggccacgagatcgaagaatgcagtgaaaggagcctccaaatctgaatcaagagagcagtcgaagccttctagcacaaccgtgaagccagttgaggcacaagcctgagaccaaaccactcccatttcattcagaccattggtgatgcccctttgtcatgcgtgctgctggaatatttttttatttttaatcttttttttaataatattttaagtttaacc

SEQ ID NO: 4370 - protein, 443 aa, Panicum virgatum
  misc_feature (1)..(443): useful for making plants with increased salt and oxidative stress resistance as described in USSN 12/922,143
  misc_feature (1)..(443): Ceres CLONE ID no.1769872
  misc_feature (1)..(443): Bit score of 51.8 for HMM based on sequences of FIGURE 16 of USSN 12/922,143.
  misc_feature (93)..(113): Pfam Name: IQ Pfam Description: IQ calmodulin-binding motif
  misc_feature (1)..(443): Functional Homolog Of Ceres SEEDLINE ID no. ME24091
MGISAKWIKSLVGLRKHEKGRNAESSAGRSSGAQLLHTQDHSVDTEGALAAEELRVQAEPLAAEANTETISNSPSSPSTSFQVSQTEHGTKEYQAAVVIQSTFRAFLARRALRALKGLVRLQALVRGHAVRKQAAETLQCMQALVRAQTRVRARRVRVSLESQGTQKKPPEKNAHEDHVRDIEEDWCGSIGSVEEIKAKALKRQEAAAKRERAMAYALTHQWQTGSRKQKAASLQDQGLAGDENQWGRNWLERWMAARPWENRLLDSNAKESVTVGDDKPAEEDKAKALNKPKGKVPVSTTQSNGSRQKKVTGHKKSHSDVSGSSSGQSASVQPTASLESSKIKEKPSDEITDEVSSQPSKLASRSTSNPKERPAQINAPAKKRLSLPNNATANGGVGKRHANSSRTTQATRSKNAVKGASKSESREQSKPSSTTVKPVEAQA

SEQ ID NO: 4371 - protein, 500 aa, Oryza sativa subsp. indica; identical to SEQ ID NO: 3409
  misc_feature (1)..(500): useful for making plants with increased salt and oxidative stress resistance as described in USSN 12/922,143
  misc_feature (1)..(500): Public GI ID no.125550655
  misc_feature (1)..(500): Bit score of 1135.6 for HMM based on sequences of FIGURE 16 of USSN 12/922,143.
  misc_feature (107)..(121): Pfam Name: IQ Pfam Description: IQ calmodulin-binding motif
  misc_feature (1)..(500): Functional Homolog Of Ceres SEEDLINE ID no. ME24091

SEQ ID NO: 4372 - protein, 474 aa, Oryza sativa subsp. japonica
  misc_feature (1)..(474): useful for making plants with increased salt and oxidative stress resistance as described in USSN 12/922,143
  misc_feature (1)..(474): Public GI ID no.54306075
  misc_feature (1)..(474): Bit score of 1173.0 for HMM based on sequences of FIGURE 16 of USSN 12/922,143.
  misc_feature (107)..(127): Pfam Name: IQ Pfam Description: IQ calmodulin-binding motif
  misc_feature (1)..(474): Functional Homolog Of Ceres SEEDLINE ID no. ME24091
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 4373 - protein, 500 aa, Oryza sativa subsp. japonica
  misc_feature (1)..(500): useful for making plants with increased salt and oxidative stress resistance as described in USSN 12/922,143
  misc_feature (1)..(500): Public GI ID no.125592647
  misc_feature (1)..(500): Bit score of 1139.1 for HMM based on sequences of FIGURE 16 of USSN 12/922,143.
  misc_feature (107)..(127): Pfam Name: IQ Pfam Description: IQ calmodulin-binding motif
  misc_feature (1)..(500): Functional Homolog Of Ceres SEEDLINE ID no. ME24091
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLLSENSSWLFISSAAFIYHCVGANITKARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 4374 - DNA, 1698 bp, Arabidopsis thaliana
  misc_feature (1)..(1698): useful for making plants with increased salt and oxidative stress resistance as described in USSN 12/922,143
  misc_feature (1)..(1698): Ceres Annot ID no. 555419
atgcccttatcctttgaaaggtttcaaggggagggggtgtttggtttatcttcttcttctttctattcagattctcagaaaatctggtccaatcaagacaaaaccgaagcaaaacaagaagatcttggttatgttgtcggtggttttttaccggagccgacgtctgttctcgacgctctaagaagtcctagtcctctcgcttcttattcttctaccaccaccacgctgtcttcctctcacggcggcggtggtaccaccgtcaccaacaccaccgtaaccgccggtgatgataacaataacaataaatgtagtcagatgggtttggatgatcttgacggtgttctctctgcttcttctcctggtcaagagcagagtatcttgagacttatcatggacccgggttctgccttcggtgttttcgacccgggtttcggattcgggtctggttccgggcctgtgtctgctccggtgagtgataattcgaatcttctgtgtaacttcccgtttcaagagattacgaatccagcagaagctttgatcaatccttcaaatcattgcctgttctataatcctccgttatctccaccgctgttcaacgcggcggagctaatcggaaccaccggaaacaacaacggcgaccacaccgttctcgcgcaagggatattggcgcggctcaatcaccatctcaacactagtagtaaccacaagtctccgtttcaaagagcagcttctcacatcgctgaagctctcctctcactcatccacaacgaatcatcaccaccgttaatcacgccggagaatctgattctccgaatcgccgcttacagatccttctccgaaacctcgccgtttctccaattcgttaacttcacagcgaatcaatcgattcttgagtcctgcaacgaatcagggtttgatcggatccacattatcgatttcgacgttggatatggaggacaatggtcgtctctaatgcaagaactcgcttccggagttggaggaagaagaagaaacagagcatcgtctctgaaattaacagtctttgctcctccaccttctacagtctccgacgagttcgagcttcgtttcacagaggaaaatctcaaaacattcgccggagaagtcaagattcctttcgaaatcgagttactaagcgtagagcttcttctaaacccagcttattggccactctctctacgttcatcggaaaaagaagcaatcgcagtgaatcttccagtaaactccgtcgcctccggttaccttccgttaatcctccgattccttaaacaactatcaccaaacatcgtcgtttgctcagacagaggatgtgaccgtaacgacgcgccgtttccaaacgcagtgattcattcgcttcaataccacacttctctgcttgagtctcttgatgctaatcagaaccaggacgattcgagtatcgagaggttttgggttcaaccatcgatagagaagctgttgatgaaacgacaccgttggattgaaagatctccaccgtggagaatcttgtttacacaatgtgggttttctccggcgagtttgagtcagatggcggaagctcaggcggagtgtttgttgcagagaaatccggtgagagggtttcacgttgagaaaaggcagtcttcacttgtcatgtgttggcaaaggaaagaacttgttactgtctctgcttggaaatgttag

SEQ ID NO: 4375 - protein, 565 aa, Arabidopsis thaliana
  misc_feature (1)..(565): useful for making plants with increased salt and oxidative stress resistance as described in USSN 12/922,143
  misc_feature (1)..(565): Ceres Annot ID no. 555419
  misc_feature (1)..(565): Bit score of 574.9 for hmm based on sequences of FIGURE 6.
  misc_feature (167)..(477): Pfam Name: GRAS Pfam Description: GRAS family transcription factor
  misc_feature (1)..(565): Functional Homolog Of SEQ ID NO. 149
MPLSFERFQGEGVFGLSSSSFYSDSQKIWSNQDKTEAKQEDLGYVVGGFLPEPTSVLDALRSPSPLASYSSTTTTLSSSHGGGGTTVTNTTVTAGDDNNNNKCSQMGLDDLDGVLSASSPGQEQSILRLIMDPGSAFGVFDPGFGFGSGSGPVSAPVSDNSNLLCNFPFQEITNPAEALINPSNHCLFYNPPLSPPLFNAAELIGTTGNNNGDHTVLAQGILARLNHHLNTSSNHKSPFQRAASHIAEALLSLIHNESSPPLITPENLILRIAAYRSFSETSPFLQFVNFTANQSILESCNESGFDRIHIIDFDVGYGGQWSSLMQELASGVGGRRRNRASSLKLTVFAPPPSTVSDEFELRFTEENLKTFAGEVKIPFEIELLSVELLLNPAYWPLSLRSSEKEAIAVNLPVNSVASGYLPLILRFLKQLSPNIVVCSDRGCDRNDAPFPNAVIHSLQYHTSLLESLDANQNQDDSSIERFWVQPSIEKLLMKRHRWIERSPPWRILFTQCGFSPASLSQMAEAQAECLLQRNPVRGFHVEKRQSSLVMCWQRKELVTVSAWKC

SEQ ID NO: 4376 - DNA, 1548 bp, Sorghum bicolor
  misc_feature (1)..(1548): useful for making plants with increased salt and oxidative stress resistance as described in USSN 12/922,143
  misc_feature (1)..(1548): Ceres Annot ID no. 8734484
atgtccgagctccaggacgacggcgccggcggaaatggccaagacgaaaccgcccccgccgccgccttcgcgtcgccggccaagcgcctccgcagcaggtcgccggcgtcggagcccacctccgtgctctacaaccgcagccccagcccgcccacgtcctcctccctggcctcttcctccgcgcccgagccgccccccatcagcgccgaggactgggagtgggaggccgtcctcgacatggccgcgccaccagccgccgcacggtctcaggacaccacctccttcctccgctggatcatggacgccgacgcccaagttgacgcctttgatcccttcctgcctccgccgccttgccaggagaccgccgccgtcgagcccttcttgcacccgcagctccagctcccgctcccgctccccgtggcgcaggaggaccttgaccttgagccaggggtggcggtggacgagctcctcgaggcggcgcgccgagccgacgccggggactccgctggcgcgcgcgagatattgacgcggctcaatcaccggcggctaccctcgatgtcgctgccggggcacccgcaccctcctctcctccgcgccgccgctcaccttcgggacgcgctcctgcgcctcctcgtcgcgctccccctcccgcacggctcctccgtctcgaccccgctcgacgtcgcgctcaaggtcgccgcacacagggcactggcggacgcgtcgccgaccgtccagttcgccagcttcacgtccacgcaggcgctcctcgacgtgctcggcgccgcgcgccgcgtgcacgtcgtcgacttggacgtcggcttcggcggtcggtgggcgccgctcatgcaggagctcgcgctccagtggcgccgagcacccgtctcgccgccgccgtgcttcaaggtgacggcattggtctcgccggggtcagcgcaccccttggagctccacctcacgcacgagggcctgacgcgcttcgccgccgagctcggcatctcgttcgagttcaacgccgtcgccttcgacccctcggacccgttgcccccaacggagttgtccgtcgcgcccggcgaggccgtcgccgttcacctccccatcggctccggtactccgttgccgacgactctccgcgtcgtgaagcagctccggcccgccatcgtggtgtgcgtcgacgaccacggatgccaccgcggcgacctgccgctgtcgcatcacgcgctcaacgtcgtgcgctccaccgcggcgttcctcgagtcgctggacgcggccggcgcgccggcggacgcggtggcgaggctggagcagtacgtcctgcgtcccagggtggagcgcctgttgctaggggacaggatgcctccatggcagaccatgcttgcgtccgccggattcgcgccggtgcagctcagcaacgccgccgaggcacaggccgagtgccttgtcagccgcacgcccacgccgggcttccatgtggagaagcggcaggcggcgcttgcactgcggtggcaggaatcggagctggtgatggtgtcggcgtggcggtgctga

SEQ ID NO: 4377 - protein, 515 aa, Sorghum bicolor
  misc_feature (1)..(515): useful for making plants with increased salt and oxidative stress resistance as described in USSN 12/922,143
  misc_feature (1)..(515): Ceres Annot ID no. 8734484
  misc_feature (1)..(515): Bit score of 585.7 for hmm based on sequences of FIGURE 6.
  misc_feature (127)..(434): Pfam Name: GRAS Pfam Description: GRAS family transcription factor
  misc_feature (1)..(515): Functional Homolog Of SEQ ID NO. 149
MSELQDDGAGGNGQDETAPAAAFASPAKRLRSRSPASEPTSVLYNRSPSPPTSSSLASSSAPEPPPISAEDWEWEAVLDMAAPPAAARSQDTTSFLRWIMDADAQVDAFDPFLPPPPCQETAAVEPFLHPQLQLPLPLPVAQEDLDLEPGVAVDELLEAARRADAGDSAGAREILTRLNHRRLPSMSLPGHPHPPLLRAAAHLRDALLRLLVALPLPHGSSVSTPLDVALKVAAHRALADASPTVQFASFTSTQALLDVLGAARRVHVVDLDVGFGGRWAPLMQELALQWRRAPVSPPPCFKVTALVSPGSAHPLELHLTHEGLTRFAAELGISFEFNAVAFDPSDPLPPTELSVAPGEAVAVHLPIGSGTPLPTTLRVVKQLRPAIVVCVDDHGCHRGDLPLSHHALNVVRSTAAFLESLDAAGAPADAVARLEQYVLRPRVERLLLGDRMPPWQTMLASAGFAPVQLSNAAEAQAECLVSRTPTPGFHVEKRQAALALRWQESELVMVSAWRC

SEQ ID NO: 4378 - protein, 507 aa, Zea mays
  misc_feature (1)..(507): useful for making plants with increased salt and oxidative stress resistance as described in USSN 12/922,143
  misc_feature (1)..(507): Public GI ID no. 194700774
  misc_feature (1)..(507): Bit score of 616.1 for hmm based on sequences of FIGURE 6.
  misc_feature (120)..(426): Pfam Name: GRAS Pfam Description: GRAS family transcription factor
  misc_feature (1)..(507): Functional Homolog Of SEQ ID NO. 149
MTSALPHMSELPDGGAGGNGQDEAAAFASPAKRLRRSPALEPTSVLYNRSPSPPTSSSLVSSAAPEPPPISAEDWEAVLSGGDMAAPPAAARSQDASFLRWIMDADAQVDAFDPFLPCQETAVVEPFLQPQLPLPVADDLEPGATVDELLEAVRRADAGDSTGAREILARLNHRLPSPPGHPHPPILRAAAHLRDALLRVLVTSAPAPAAVSTTPLDVALKVAAHRALADASPTVQFANFTSTQALLDALGTARRVHVVDLDVGFGGRWAPLMQELALQWRRAPVSPLPPPCLKVTALVSPGSSAHPLELHLTHQGLTRFAADLGISFEFNAVAFDPLDPLPPTGLSVAPGDAVAVHLSVGSGVPSAATLRVVKQLRPAVVVCVDHGCHRGDLPLSHHALSVVRSSAAFLESLDAAGAPADAVARLEEYVVRPRVERLLLGDRMPPWRTMLDSAGFAPVQLSNAAEAQAECLVRRTPTPGFHVEKRQAALALRWQDSELVMVSAWRC

SEQ ID NO: 4379 - DNA, 1607 bp, Zea mays
  misc_feature (1)..(1607): useful for making plants with increased salt and oxidative stress resistance as described in USSN 12/922,143
  misc_feature (1)..(1607): Ceres Clone ID no. 447391
atgacaagcgcgctgccgcacatgtctgagctcccggacggcggcgccggcggaaatggccaagacgaagccgccgccttcgcctcgccggccaagcgcctccgtaggtcgccggcgctcgagcccacctccgtgctctacaaccgcagcccgagcccgcccacatcctcctccctggtctcctccgccgcgcccgagccgccccccatcagcgccgaggattgggaggccgtcctctccggcggcgacatggccgcgccaccagccgccgcgcggtctcaagacgcctctttcctccgctggatcatggacgccgacgcccaagtcgacgccttcgatcccttcctgccttgccaagagaccgccgtcgtcgagcccttcttgcagccgcagctcccgctccccgtggccgacgacctcgagccaggggcgacggttgacgagctcctcgaggcggtgcgccgcgccgacgccggggactccactggcgcgcgcgagatattggcgcggctcaatcaccggctcccctcaccgccggggcacccgcaccctccactcctccgcgccgcggctcacctccgggacgcgctcctgcgcgtcctcgtcacgtccgcgcccgcgcccgccgccgtctcgacgaccccgctcgacgtcgcgctcaaggtagccgcgcacagggccctggcggacgcgtcaccgaccgtccagttcgccaacttcacgtccacgcaggcgctcctcgacgcgctcggcaccgcgcgccgcgtgcacgtcgtcgacttggacgtcggcttcggcggccggtgggcgccgctcatgcaagagctcgcgctccagtggcgccgagcacccgtctcgccgctgccgccgccgtgcttgaaggtgacggccttggtctcgccagggtcatcagcgcaccccttggagctccacctcacgcaccagggcctgacgcgcttcgccgccgacctcggcatctcgttcgagttcaacgccgtcgcgttcgaccccttggacccgttgccccccacggggctgtccgtcgcgcccggcgatgccgtcgccgttcacctctccgtcggctccggggtcccgtcggcagctactctccgcgtcgtgaagcagctccgccccgccgtcgtggtgtgcgtcgaccacggatgccaccgcggcgacctgccgctgtcgcaccacgcgctgagcgtcgtgcgctccagcgcggcgttcctcgagtcgctggacgcggccggggcgccggcggacgcggtggcgaggctggaggagtacgtcgtgcgtcccagggtggagcgcctgttgctaggcgacaggatgcctccatggcggaccatgcttgactccgccggattcgcgccggtgcagctcagcaacgccgccgaggcacaggccgaatgcctcgtcaggcgcacgcccacgccgggcttccatgtggagaagcggcaggcggcgctcgcgctgcggtggcaggactcggagctggtgatggtgtcggcgtggcggtgctgaatcggggcactgggacagttcctgtaaagattgaacctttttctgttctcatgtgcagtaaaattagctagtaacttgttgtc

SEQ ID NO: 4380 - protein, 507 aa, Zea mays
  misc_feature (1)..(507): useful for making plants with increased salt and oxidative stress resistance as described in USSN 12/922,143
  misc_feature (1)..(507): Ceres Clone ID no. 447391
  misc_feature (1)..(507): Bit score of 619.8 for hmm based on sequences of FIGURE 6.
  misc_feature (120)..(426): Pfam Name: GRAS Pfam Description: GRAS family transcription factor
  misc_feature (1)..(507): Functional Homolog Of SEQ ID NO. 149
MTSALPHMSELPDGGAGGNGQDEAAAFASPAKRLRRSPALEPTSVLYNRSPSPPTSSSLVSSAAPEPPPISAEDWEAVLSGGDMAAPPAAARSQDASFLRWIMDADAQVDAFDPFLPCQETAVVEPFLQPQLPLPVADDLEPGATVDELLEAVRRADAGDSTGAREILARLNHRLPSPPGHPHPPLLRAAAHLRDALLRVLVTSAPAPAAVSTTPLDVALKVAAHRALADASPTVQFANFTSTQALLDALGTARRVHVVDLDVGFGGRWAPLMQELALQWRRAPVSPLPPPCLKVTALVSPGSSAHPLELHLTHQGLTRFAADLGISFEFNAVAFDPLDPLPPTGLSVAPGDAVAVHLSVGSGVPSAATLRVVKQLRPAVVVCVDHGCHRGDLPLSHHALSVVRSSAAFLESLDAAGAPADAVARLEEYVVRPRVERLLLGDRMPPWRTMLDSAGFAPVQLSNAAEAQAECLVRRTPTPGFHVEKRQAALALRWQDSELVMVSAWRC

SEQ ID NO: 4381 - protein, 750 aa, Vitis vinifera
  misc_feature (1)..(750): useful for making plants with increased salt and oxidative stress resistance as described in USSN 12/922,143
  misc_feature (1)..(750): Public GI ID no. 157349396
  misc_feature (1)..(750): Bit score of 1061.9 for hmm based on sequences of FIGURE 6.
  misc_feature (364)..(664): Pfam Name: GRAS Pfam Description: GRAS family transcription factor
  misc_feature (1)..(750): Functional Homolog Of SEQ ID NO. 149
MKDMPLPLELEGKGVFEICLNSLLEKWNKEEEEGGCCVGTEPTSVLDTRRSPSPPTSTSTLSSSCGGGGSDTAGVAAVSGNPSQKWPPAQPDTTSSNAGVELHPIPASVDLGAGEKCGLGMEDWESVLSETAASPSQEQSILRWIMGDVEDPSVGLNKLLQSGGGGPPDFEFSSGFGVVDQGFGFEPCLGSGSSMNAPCPGFPPTSNSVNSINHGRIGPVSNPNQPNFKIHNPQSNPNFAKSGNNLMPISFNQQQLQQQPFEALDEKPQILIPQVLINQHQAQHTQNPAFFLPLPYAQQEQNLLLPPQAKRHNTGPIGSIEQNCPVPKVPFSDSGQELFARRQQQQQQAQGFPQQLQLLPHHLQPRPAMGSKPKMVGEEMGHHQQYQQVIIDQLFKAAELVETGNTILAQGILARLNHQLSPIGKPFQRAAFYFKEALQLLLHSNSNNTNPLATSPHSSPFSLIFKIGAYKSFSEISPLIQFANFTCIQAILEALEGFDRIHIIDFDIGYGGQWASLMQELALRNGGAPSLKITAFASLSNHDQLELGLARENLNHFAGEINMAFELEILSLDSLNSLPLHLSENEAVAVNLPVGSFSNYPLPLPLVLRVVKQLSPKIMVSLDRGCDRTDLPYSHHILHAFQSYLALLESLDAVNVNSDALQKIERFLLQPGIEKIVLGRHRSPEKTPPWRALLLSSGFSPLTFSNFSESQAECLVKRTPVRGFHVEKRQSSLVLCWQRKDLISASAWRC

SEQ ID NO: 4382 - DNA, 1914 bp, Sorghum bicolor
  misc_feature (1)..(1914): useful for making plants with increased salt and oxidative stress resistance as described in USSN 12/922,143
  misc_feature (1)..(1914): Ceres Annot ID no. 8639910
atgctctttgctggtagcgcacgagaagggcacgcggggacactgctgcagcagcaacagcaacgacaggggctcgccgccggcaaagtctccggcgccggcgacctctgggagcccacctcggtgcttgaccaccgacacagcccgagcccgagccctccgacctcggtttccacgctgtcgtcgcccctgggcgccgcgaccgccggtgtggcggccctcgccggtgccaacgccaagaacgtctccccgccgccggtggcggcggcatggccagggggagggcccggggaggaggccgtggcgggcggcaaggaggagtggcagctcacgccgctcgacatgggccttagcgccggcgaagggtgggacgccgccggcgccgtcctgtccgatggcgccgcgccgccgggactcgcccccgaccacaccttcctcaggtggatcattggcggcgaggacgcgtctgcggccatggggtctgtcatggacccgccggtccttgagctggaccacgcgccgtccatgatgtcgccggcgttcggggccagcatgccgttcgcgccggccatggaggacgtcaaggcggtgcctttcggccacacgcccaacttcctggtccaccatcaccagcaccacccccagccacacgccgccttcttcggctcgcactcccacgcatccctcgacgcggcgccgcagccgaagcgaccccaccccatggccggcgcgccggcgccaaagctgccatctttccctgggcccgtcgcccagccgggcgggttcgcgcccgctttgaagcccaaggcggaggcagctaacgacgaggcgaccgctgcggtggaccagcttgccgaggcggccaagcttgccgaggctggcgacgccttcggcgcccgcgagatattggcgcggctcaattatcggctccccgccgtcccaacggccgggacgccgctgctccgctcggccttctacttcaaggaggccctgcgcgtggcgctctccccaaccggcgaggccccggcggccccggtctccacgccgtacgacgtggtcctcaagctcggggcgtacaaggccttctcggaggtctcccccgtgctccagttcgcgcacctgacctgcgtgcaggcggtgttggacgagctcggcggcgccagccgcatccacgtgctcgacttcgacattggcatgggcgagcagtgggcgtcgctgatgcaggagctcgcgcagcgctgccccgcggcgacgctcaaggtgaccgcattggtgacatcggcgtcgcaccacccgctggagctgaacctgatccacgagaacctctccggcttcgcccgcgagctgggcgtcttcctccagttcgcggtgttcaacatcgacaccctggaccccgcggagctggtggccatcaccagcggcgacgccgtggccgtgcacctccccgtcgggtcggcccacgtggccgcaatgccggccgtgctccgcctcgtgaagcggctcggcgccaaggtggtggtctccgtggaccacggctgcgaccgcacggagctgccgttcgccacgcacctgttccaggcgttccagtcgtgcgtgtccctgctcgactccgtcgacgccgtgggcgcggacgcggaggcggtggccaggatcgagcggttcctggtccagcccgacgtggagctgcgcgtggtgtcgcgccaccgcgcgtcggcgccgccgccggcgtggcggaccgtgttcgcgtcggcggggttcgtgccggtgcaggccagcacgttcgccgagtcgcaggccgaggccctcctcaagaggatggcgctcatggggttccgcgtggagaagcgcggcggcgcgctctgcctctactggcagcgcggcgagctggtgtccgtgtcggcgtggcggtgctga

SEQ ID NO: 4383 - protein, 637 aa, Sorghum bicolor
  misc_feature (1)..(637): useful for making plants with increased salt and oxidative stress resistance as described in USSN 12/922,143
  misc_feature (1)..(637): Ceres Annot ID no. 8639910
  misc_feature (1)..(637): Bit score of 1236.4 for hmm based on sequences of FIGURE 6.
  misc_feature (254)..(551): Pfam Name: GRAS Pfam Description: GRAS family transcription factor
  misc_feature (1)..(637): Functional Homolog Of SEQ ID NO. 149
MLFAGSAREGHAGTLLQQQQQRQGLAAGKVSGAGDLWEPTSVLDHRHSPSPSPPTSVSTLSSPLGAATAGVAALAGANAKNVSPPPVAAAWPGGGPGEEAVAGGKEEWQLTPLDMGLSAGEGWDAAGAVLSDGAAPPGLAPDHTFLRWIIGGEDASAAMGSVMDPPVLELDHAPSMMSPAFGASMPFAPAMEDVKAVPFGHTPNFLVHHHQHHPQPHAAFFGSHSHASLDAAPQPKRPHPMAGAPAPKLPSFPGPVAQPGGFAPALKPKAEAANDEATAAVDQLAEAAKLAEAGDAFGAREILARLNYRLPAVPTAGTPLLRSAFYFKEALRVALSPTGEAPAAPVSTPYDVVLKLGAYKAFSEVSPVLQFAHLTCVQAVLDELGGASRIHVLDFDIGMGEQWASLMQELAQRCPAATLKVTALVTSASHHPLELNLIHENLSGFARELGVFLQFAVFNIDTLDPAELVAITSGDAVAVHLPVGSAHVAAMPAVLRLVKRLGAKVVVSVDHGCDRTELPFATHLFQAFQSCVSLLDSVDAVGADAEAVARIERFLVQPDVELRVVSRHRASAPPPAWRTVFASAGFVPVQASTFAESQAEALLKRMALMGFRVEKRGGALCLYWQRGELVSVSAWRC

SEQ ID NO: 4384 - DNA, 1320 bp, Solanum lycopersicum
  misc_feature (1)..(1320): useful for making plants with increased salt and oxidative stress resistance as described in USSN 12/922,143
  misc_feature (1)..(1320): Ceres Annot ID no. 8464611
atgactcctgctcctaccgatgaagaggaggagatgcttgttccgcgttcagatttggtatttgaaggacctcagcctatggaaggcttaggtcctaagcggacaatatcactattgggctgggctgtgacgtcacaagcagaaaccggcaatgatgtggaaaagcagccaccagaggatcctcaaacttcaaggtttacttggaagatagataacttctctaggttgaatgtaaagaaactatactctgacccttttgttgtcggtggctataaatggcggattttaatttttcccaaggggaacaatgttgattacctatccatgtatctggatgttgctgattcagctaatttaccttacgggtggagtagatatgcccagttcaacttgtcaattgttaaccaaattcataacaagtactccatcagaaaagagacacaacaccaattcaatgccagagaaagtgattggggtttcacatcctttatgccacttggtgaactatatgatccaaacaaaggttatcttgttgatgatacatgtgttgttgatgctgaggtagctgtgcgaaaaattgttgactattggtcgtatgactcaaaaatggaaactggctttgttggactgaagaaccaaggagctacctgttatatgaactcacttcttcaaactctctaccatattccttacttcaggaaggctgtataccacatgcctacaactgaaaatgatatgccctctgctagtatccctctagcgttgcaaagcttattctataagctccagtacagtgacaacagtgtagcaacaaaggagttgacaaaatcattcggatgggacacatatgattctttcttgcagcatgatgtgcaagaactcaatcgtgttctctgtgaaaagcttgaagaaaaaatgaagggtactgttgtggaaggcactatacagcagttattcgaagggcaccatatgaactatattgagtgcatcaatgtggactacaaatctacgagaaaggagtcattttatgatcttcagcttgatgtcaaagggtgtgctgatgtttatgcttcgtttgataaatatgttgaagttgaacgtcttgagggcgataacaagtaccatgccgaacaatatggtttgcaggatgctaagaagggtgtcttattcatggatttcccccctgtcctgcagcttcagttaaagcgctttgaatatgatttttcacgggacactatggtaaagcaatttaggattttctcatctaaaaagcaagccggtagcaagatatctttagttatatcgcaaaacagtttttag

SEQ ID NO: 4385 - protein, 439 aa, Solanum lycopersicum
  misc_feature (1)..(439): useful for making plants with increased salt and oxidative stress resistance as described in USSN 12/922,143
  misc_feature (1)..(439): Ceres Annot ID no. 8464611
  misc_feature (1)..(439): Bit score of 844.1 for hmm based on sequences of FIGURE 10.
  misc_feature (70)..(190): Pfam Name: MATH Pfam Description: MATH domain
  misc_feature (1)..(439): Functional Homolog Of SEQ ID NO. 389
MTPAPTDEEEEMLVPRSDLVFEGPQPMEGLGPKRTISLLGWAVTSQAETGNDVEKQPPEDPQTSRFTWKIDNFSRLNVKKLYSDPFVVGGYKWRILIFPKGNNVDYLSMYLDVADSANLPYGWSRYAQFNLSIVNQIHNKYSIRKETQHQFNARESDWGFTSFMPLGELYDPNKGYLVDDTCVVDAEVAVRKIVDYWSYDSKMETGFVGLKNQGATCYMNSLLQTLYHIPYFRKAVYHMPTTENDMPSASIPLALQSLFYKLQYSDNSVATKELTKSFGWDTYDSFLQHDVQELNRVLCEKLEEKMKGTVVEGTIQQLFEGHHMNYIECINVDYKSTRKESFYDLQLDVKGCADVYASFDKYVEVERLEGDNKYHAEQYGLQDAKKGVLFMDFPPVLQLQLKRFEYDFSRDTMVKQFRIFSSKKQAGSKISLVISQNSF

SEQ ID NO: 4386 - DNA, 2151 bp, Sorghum bicolor
  misc_feature (1)..(2151): useful for making plants with increased salt and oxidative stress resistance as described in USSN 12/922,143
  misc_feature (1)..(2151): Ceres Annot ID no. 8681439
atgagggcggcgctgttcggtgcccagcggaacggggctgcggacctcgtcggaggcgggaatacgctgttctggccggaggaggggaaggcgaaggtgctgctggagccgaggtccgtgctggactgcacacggagccccagccctaacaactcgacatcgacgctgtcgtcgtccctgggcggcggcggcggcgctgcggactcgaccggcggcgtggcggcggtttccgacagcagcgctgccgctaccgccgccgaagccaccaaatggggagcccccggcgagtacggcggcggcgggaaggaggactgggccggcggctgtgagctgccgccgattcctaccggcctcaacatggaggtcatcggcggcagcgacagctgggacgccatgctcggcagcgccgctgcggcggggcaggaccagacgttcttgaactggatcattggggccgccggcgacctggatcagtcagggccgccgctccccgtgcaccagcagccgctccttgacaatgtgggcttcgggttcccggcggcggaccccctgggtttctcgctcgatccccacctcggcggcgttgcctcggacatgtcgtcccctggtgcggtgtcgcacgctaccaacagcgctggcggtggcaacaaggcgtcctcggccttcggcctcttctcaccggagtctgcttcgctccagccgccgccgccaccggtgctgttccacgaaggtatcgacacaaagccccctcttcttggtgcgcagccgcccggcctcctccaccagtaccagcaccagccgacccccgccacaaccttcttcatgcccatcccctccttccccaaccacaatcagcagtcgccactcgttcaaccaccgcccaaacgtcatcaatccataggggatgacctctatctcgcccgaaatcggcttctgtctccgccggcggggcaaggtcacgcctttccaccactaaatggtcctgctccgttccagctccagccttcgccaccaccgccccacggggcgatgaagacgacggctgcggaggcagcgcagcagcagttgctggacgagcttgcggcggcggcaaaggccgctgaagccggcaattccattggcgcgcgagagatattggcgcggctcaatcaccagcttcccccgctcgggaagccgttcctccgctccgcctcctacctcaaggaggccctcctcctcgcgctcgccgaaggtcaccatggcggctgccacctcacatcaccgctcgacgttgccctcaagctcgcggcgtacaagactttctctgaccactcgcccgtgctccagttcaccaacttcaccgcaacgcaggcacttctcgacgaaattgccagcagcacatcgtcctgcatccatgtcatcgattttgatcttggcgttggaggccagtgggcttctttcttgcaggagcttgcacaccgccgtggagcaggtggtgcagctctgccgttcgtcaagctcactgcctttgtatcagctgcttcccaccatccactggaactgcgtcttgcgcgtgacaacattgcacagtttgctgcagaccttggaattccctttgggttcagtgctatcagtgctgatacgatcaaccctacagagctaatttctgccactggtgatgaagttgtagctgttgtcctcccggctggttgctctgctcgtgcaccaccactgccagcgatccttcggttggtgaaacagctggctcctaagatcgtgatagccatagaccatggcgctgatcgtgctgatcttcccttctcacagcacttcttgaattgctttcagtcttgcatgttcctccttgattcgcttgatgctgctggcattgatgctgattctgccggcaagattgagaagttcctgattcagccaagaattgaggattcagtgcttgggcggggcaaggtggacaagccaattgcatggagaagtgcatttgcaggtgctgggttcgcacctgttccgcccagcagtttggcggaggcacaggccgactgcctcctgaagcgggtgcaggtccgcggattccacgtggagaaatgtggcgtcgggctcacactatactggcagcgaggcgagcttgtcactgtatcagcatggcggtgctga

SEQ ID NO: 4387 - protein, 716 aa, Sorghum bicolor
  misc_feature (1)..(716): useful for making plants with increased salt and oxidative stress resistance as described in USSN 12/922,143
  misc_feature (1)..(716): Ceres Annot ID no. 8681439
  misc_feature (1)..(716): Bit score of 1501.6 for hmm based on sequences of FIGURE 6.
  misc_feature (330)..(631): Pfam Name: GRAS Pfam Description: GRAS family transcription factor
  misc_feature (1)..(716): Functional Homolog Of SEQ ID NO. 149
MRAALFGAQRNGAADLVGGGNTLFWPEEGKAKVLLEPRSVLDCTRSPSPNNSTSTLSSSLGGGGGAADSTGGVAAVSDSSAAATAAEATKWGAPGEYGGGGKEDWAGGCELPPIPTGLNMEVIGGSDSWDAMLGSAAAAGQDQTFLNWIIGAAGDLDQSGPPLPVHQQPLLDNVGFGFPAADPLGFSLDPHLGGVASDMSSPGAVSHATNSAGGGNKASSAFGLFSPESASLQPPPPPVLFHEGIDTKPPLLGAQPPGLLHQYQHQPTPATTFFMPIPSFPNHNQQSPLVQPPPKRHQSIGDDLYLARNRLLSPPAGQGHAFPPLNGPAPFQLQPSPPPPHGAMKTTAAEAAQQQLLDELAAAAKAAEAGNSIGAREILARLNHQLPPLGKPFLRSASYLKEALLLALAEGHHGGCHLTSPLDVALKLAAYKTFSDHSPVLQFTNFTATQALLDEIASSTSSCIHVIDFDLGVGGQWASFLQELAHRRGAGGAALPFVKLTAFVSAASHHPLELRLARDNIAQFAADLGIPFGFSAISADTINPTELISATGDEVVAVVLPAGCSARAPPLPAILRLVKQLAPKIVIAIDHGADRADLPFSQHFLNCFQSCMFLLDSLDAAGIDADSAGKIEKFLIQPRIEDSVLGRGKVDKPIAWRSAFAGAGFAPVPPSSLAEAQADCLLKRVQVRGFHVEKCGVGLTLYWQRGELVTVSAWRC

SEQ ID NO: 4388 - protein, 177 aa, Chlamydomonas reinhardtii
  misc_feature (1)..(177): useful for making plants with increased salt and oxidative stress resistance as described in USSN 12/922,143
  misc_feature (1)..(177): Public GI ID no. 159477973
  misc_feature (1)..(177): Bit score of 164.9 for hmm based on sequences of FIGURE 11.
  misc_feature (24)..(48): Pfam Name: zf-LSD1 Pfam Description: LSD1 zinc finger
  misc_feature (1)..(177): Functional Homolog Of SEQ ID NO. 316
MSVWMPPGGGSGSMAPPSQSHLVCGGCRCLLMYPQGASNVRCSRCGHITSAPASAGADSSQIVCNGCRVLLSYPRGAQSVQCSLCHAVTQVPVYGHLVCNGCSIMLMYPVGAQSVKCSVCHYVTPVTAATAAAGGASGSVPAARPKTKQTVVVENPPSYDEKGNEVANIAVGVKADT

SEQ ID NO: 4389 - protein, 243 aa, Picea sitchensis
  misc_feature (1)..(243): useful for making plants with increased salt and oxidative stress resistance as described in USSN 12/922,143
  misc_feature (1)..(243): Public GI ID no. 116786199
  misc_feature (1)..(243): Bit score of 323.9 for hmm based on sequences of FIGURE 11.
  misc_feature (74)..(98): Pfam Name: zf-LSD1 Pfam Description: LSD1 zinc finger
  misc_feature (1)..(243): Functional Homolog Of SEQ ID NO. 316
MLSGGYSTRSDTTPVNNGSANGPIGSAPPRINSIQNNNPGAVRPGWGTMPLRMNPYPPQPMPLPPPNVQGQLVCNGCRTLLVYPQGAPNVCCAVCNAVTAVPPPGTEMAQLICGHCRTLLMYVRGATSVQCSCCTTVNLAMEANQVAHVNCGNCFTTLVYPYGAPSVKCAVCHYVTSVGQISNMRMPLPAQRPPAAATTAPASSSALPTRSQTQTVVVENPMTVDERGKMVSNVAVGVTTEKL

SEQ ID NO: 4390 - DNA, 1101 bp, Zea mays
  misc_feature (1)..(1101): useful for making plants with increased salt and oxidative stress resistance as described in USSN 12/922,143
  misc_feature (1)..(1101): Ceres Clone ID no. 100931106
  misc_feature (624)..(624): r is g or a
  misc_feature (639)..(639): s is g or c
ccgatacggtgcctctcgcggtctcgctccccctcgcaggtcttttggtttttttagttcctccctttgcttcttggaggtgtttgttgccgtctcacccgcagttcttgagacatgcagagccagatagtgtgccacgggtgcaggacccttctgttctacccaagaggtgctccgagcgtgtgttgtgcggtatgccatgtggtcaccaatgtgccgcctccagcaatggagatggctcgacttatatgtggtggctgccagacattattgatgtatgctcgcagtgcaacaactgtaagatgctcatgttgtgacacagtcaatcttgtcagaccagtgagtagcatagctcatgtgaactgtggccagtgccaaacagtgttgatgtatccatacggagcaccgtctgtcaaatgtgctgtttgcaacttcattacaaatgttggcggggtgactcccatgatacctttgccaccaccagcactaactgcatcaagtggaacttcatatatcatcccgtcaatttccgtgccgacgaatcaaccgcggaatgtaactgttgtcgttgaaaacccaatgacagtagatgacaagggaaaattggtgagcaatgttgtagtrggggttacgagcggsgggaaaaagtgacggcatatcccaacccgtatagctttgtccaaactatttaaaaagggtttaagaatacatcccttgtatcatactgctgttgggcgatgggctgctggagggaggaatccccctcccgggagagggtaggggcaaggcagcgctgctttcgccactgcgatggtgttagaaggagccaaaaaaaaaaaaaggaagtgggggggggcatattcagagtatatttgtagcttgttaccccttgatttttttgtatgtaatatgggttctgcctgactttcactgtgtgatcaaatttccaagcccgtgggcgcggttgctgcgtgccttgttattagtgaataacaaacattgcaaatggttcttgaaatacagggggtgggtgttttaatctttctgcatttatgttaatcagcaggtgcccccatttgctgttccagactgataatgcag

SEQ ID NO: 4391 - protein, 178 aa, Zea mays
  misc_feature (1)..(178): useful for making plants with increased salt and oxidative stress resistance as described in USSN 12/922,143
  misc_feature (1)..(178): Ceres Clone ID no. 100931106
  misc_feature (1)..(178): Bit score of 346.0 for hmm based on sequences of FIGURE 11.
  misc_feature (7)..(31): Pfam Name: zf-LSD1 Pfam Description: LSD1 zinc finger
  misc_feature (1)..(178): Functional Homolog Of SEQ ID NO. 316
  misc_feature (170)..(170): Xaa is any aa, unknown or other
  misc_feature (175)..(175): Xaa is any aa, unknown or other
MQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVXGVTSXGKK

SEQ ID NO: 4392 - protein, 171 aa, Vitis vinifera
  misc_feature (1)..(171): useful for making plants with increased salt and oxidative stress resistance as described in USSN 12/922,143
  misc_feature (1)..(171): Public GI ID no. 157354198
  misc_feature (1)..(171): Bit score of 362.9 for hmm based on sequences of FIGURE 11.
  misc_feature (7)..(31): Pfam Name: zf-LSD1 Pfam Description: LSD1 zinc finger
  misc_feature (1)..(171): Functional Homolog Of SEQ ID NO. 316
MQSHLMCNGCRSILVYPRGATNVCCALCNSVTSVPPPGLEMAQLICGGCRTLLMYTRGATSVRCSCCHTVNLAPAPSNQVAHVNCGNCRTTLMYPYGAPSVKCAVCHYVTSVGMVNVRVPIPVHRPNAAAISASTPSTSSSQTVVVKNPMSVDESGKLVSNVVVGVTTEKK

SEQ ID NO: 4393 - protein, 309 aa, Zea mays
  misc_feature (1)..(309): useful for making plants with increased salt and oxidative stress resistance as described in USSN 12/922,143
  misc_feature (1)..(309): Public GI ID no. 212723554
  misc_feature (1)..(309): Bit score of 349.7 for hmm based on sequences of FIGURE 11.
  misc_feature (138)..(162): Pfam Name: zf-LSD1 Pfam Description: LSD1 zinc finger
  misc_feature (1)..(309): Functional Homolog Of SEQ ID NO. 316
MFRCLAGWMRRVRRSVERSNRAGKLGRSVWGNRIAWMGFGIGREAGGCLFSPVPKLSVDDGDNRGRAKLIECLADVGLGGICWIANCSIWCTKNWTALGLGLGLGWDCFAFDCVYAYYVLIRCGFGRNFADMQSQIVCHGCRTLLFYPRGAPSVCCAVCHVVTNVPPPAMEMARLICGGCQTLLMYARSATTVRCSCCDTVNLVRPVSSIAHVNCGQCQTVLMYPYGAPSVKCAVCNFITNVGGVTPMIPLPPPALTASSGTSYIIPSISVPTNQPRNVTVVVENPMTVDDKGKLVSNVVVGVTSGGKK

SEQ ID NO: 4394 - protein, 179 aa, Hordeum vulgare subsp. vulgare
  misc_feature (1)..(179): useful for making plants with increased salt and oxidative stress resistance as described in USSN 12/922,143
  misc_feature (1)..(179): Public GI ID no. 170780164
  misc_feature (1)..(179): Bit score of 393.1 for hmm based on sequences of FIGURE 11.
  misc_feature (7)..(31): Pfam Name: zf-LSD1 Pfam Description: LSD1 zinc finger
  misc_feature (1)..(179): Functional Homolog Of SEQ ID NO. 316
MQSQIVCHGCRSVLLYPRGAPSVCCAVCHAVTSAPPPGMEMAQLICVGCRTLLMYTRNATTVRCSCCDTVNLARPAPPVNSIAHVNCGQCQTVLMYPYGASSVKCAICNFITNIGMNTMRPLPATMHAPNGISYSVPSTSAPSTQSQNVTVVVENPMTVDDKGKLVSNVVVGVTTGGKK

SEQ ID NO: 4395 - protein, 177 aa, Hordeum vulgare subsp. vulgare
  misc_feature (1)..(177): useful for making plants with increased salt and oxidative stress resistance as described in USSN 12/922,143
  misc_feature (1)..(177): Public GI ID no. 170780162
  misc_feature (1)..(177): Bit score of 343.6 for hmm based on sequences of FIGURE 11.
  misc_feature (7)..(31): Pfam Name: zf-LSD1 Pfam Description: LSD1 zinc finger
  misc_feature (1)..(177): Functional Homolog Of SEQ ID NO. 316
MQSQIVCHRCRRVLAYPSGAPSVCCAMCRAITAVPPPAPAVEMAQLICGGCRTLLMYTRNADTVRCSCCSTVNLVRPVNNIAHVNCGRCRTTLMYPHGAPSVKCAICDFITNTGINAMSPAPCPRPTSNESAYNASSASVPTSQPQNVTVVVENPMTVDEKGKLVSNVVVGITPGKN

SEQ ID NO: 4396 - protein, 181 aa, Physcomitrella patens subsp. patens
  misc_feature (1)..(181): useful for making plants with increased salt and oxidative stress resistance as described in USSN 12/922,143
  misc_feature (1)..(181): Public GI ID no. 168002291
  misc_feature (1)..(181): Bit score of 285.7 for hmm based on sequences of FIGURE 11.
  misc_feature (13)..(37): Pfam Name: zf-LSD1 Pfam Description: LSD1 zinc finger
  misc_feature (1)..(181): Functional Homolog Of SEQ ID NO. 316
MQGGQPQQGQLICSGCRTLLVYPQGASNVRCALCSSVTQVPSHGTEMAQLVCGGCRTLLMYMRGATSVQCSCCHTVNLAMEAPQVAHINCGGCGMTLMYAYGAQSVKCALCQFVTTITMPSMRVQLPSISQQPRPPQAHGGPPPALTSSHTQTVVVENPMTMDESGKLVSNVAVGVSTDRR

SEQ ID NO: 4397 - protein, 141 aa, Picea sitchensis
  misc_feature (1)..(141): useful for making plants with increased salt and oxidative stress resistance as described in USSN 12/922,143
  misc_feature (1)..(141): Public GI ID no. 116782827
  misc_feature (1)..(141): Bit score of 67.1 for hmm based on sequences of FIGURE 3.
  misc_feature (38)..(126): Pfam Name: Cystatin Pfam Description: Cystatin domain
  misc_feature (1)..(141): Functional Homolog Of SEQ ID NO. 102
MQSRRQIDSFGVFVLCVIAIGVLGISSSRGAAAMGTLGGLRDVKDFQNSIETLDLGRFAVDEHNKQQNGDISFRRVVAAQEQVVAGTMYHLTIEAEDGDHPKLYKAKVWVKPWENFKRLEDFKPVEQPSVSRADLGVKQGS

SEQ ID NO: 4398 - protein, 141 aa, Picea sitchensis
  misc_feature (1)..(141): useful for making plants with increased salt and oxidative stress resistance as described in USSN 12/922,143
  misc_feature (1)..(141): Public GI ID no. 116784931
  misc_feature (1)..(141): Bit score of 70.1 for hmm based on sequences of FIGURE 3.
  misc_feature (38)..(126): Pfam Name: Cystatin Pfam Description: Cystatin domain
  misc_feature (1)..(141): Functional Homolog Of SEQ ID NO. 102
MQSRRQIDSFGVFVLCVIAIGVLGISSSRGAAAMGTLGGLRDVKDFQNSIETLDLGRFAVDEHNKQQNGDITFRRVVAAQEQVVAGTMYHLTIEAEDGDHPKLYKAKVWVKPWENFKRLEDFKPVEQPSVSRADLGVKQGS

SEQ ID NO: 4399 - protein, 231 aa, Picea sitchensis
  misc_feature (1)..(231): useful for making plants with increased salt and oxidative stress resistance as described in USSN 12/922,143
  misc_feature (1)..(231): Public GI ID no. 116784187
  misc_feature (1)..(231): Bit score of 67.1 for hmm based on sequences of FIGURE 3.
  misc_feature (38)..(126): Pfam Name: Cystatin Pfam Description: Cystatin domain
  misc_feature (1)..(231): Functional Homolog Of SEQ ID NO. 102
MQSRRQIDSFGVFVLCVIAIGVLGISSSRGAAAMGTLGGLRDVKDFQNSIETLDLGRFAVDEHNKQQNGDISFRRVVAAQEQVVAGTMYHLTIEAEDGDHPKLYKAKVWVKPWENFKRLEDFKPVEQPSVSRADLGVKQVHAEGLGWRTVPVHDPVVQEAAQHAVKNIQQQSNSLAAYELQEVLSAKAEVVDASSKVDLHLKTKRGSKVEEHKVEMHCNPDGKWILRSRLT

SEQ ID NO: 4400 - protein, 231 aa, Picea sitchensis
  misc_feature (1)..(231): useful for making plants with increased salt and oxidative stress resistance as described in USSN 12/922,143
  misc_feature (1)..(231): Public GI ID no. 116793617
  misc_feature (1)..(231): Bit score of 70.1 for hmm based on sequences of FIGURE 3.
  misc_feature (38)..(126): Pfam Name: Cystatin Pfam Description: Cystatin domain
  misc_feature (1)..(231): Functional Homolog Of SEQ ID NO. 102
MQSRRQIDSFGVFVLCVIAIGVLGISSSRGAAAMGTLGGLRDVKDFQNSIETLDLGRFAVDEHNKQQNGDITFRRVVAAQEQVVAGTMYHLTIEAEDGDHPKLYKAKVWVKPWENFKRLEDFKPVEQPSVSRADLGVKQVHAEGLGWRTVPVHDPVVQEAAQHAVKNIQQQSNSLAAYELQEVLSAKAEVVDASSKVHLHLKTKRGSKVEEHKVEMHCNPDGKWILRSLLT

SEQ ID NO: 4401 - protein, 130 aa, Picea sitchensis
  misc_feature (1)..(130): useful for making plants with increased salt and oxidative stress resistance as described in USSN 12/922,143
  misc_feature (1)..(130): Public GI ID no. 116779648
  misc_feature (1)..(130): Bit score of 66.3 for hmm based on sequences of FIGURE 3.
  misc_feature (38)..(126): Pfam Name: Cystatin Pfam Description: Cystatin domain
  misc_feature (1)..(130): Functional Homolog Of SEQ ID NO. 102
MCMKMSMKMPMRCSRTMAVLILLLGCLCMLSDASTRIGGIRDIPDVEHKKEIQDLGRFAVDEYNTQQNVGISFSKVVKAQEQVVSGLLYYLTIKTKEGSKTKLYAAKIWVKPWEKFKQLQEFKPVQTLHK

SEQ ID NO: 4402 - DNA, 460 bp, Brassica napus
  misc_feature (1)..(460): useful for making plants with increased salt and oxidative stress resistance as described in USSN 12/922,143
  misc_feature (1)..(460): Ceres Clone ID no. 1090776
aattccacaaaaaaacaacggttacaaaatacagactgcgaaaatgaataacaaggcaacatccattcttctcctctctctcgttctcctccctctatacgcgtctgcgtcgccgcgtgtcggcggatggcgtcccctcagcgacgttaatgaccctcacgtcgtagagatcggcagattctcggtgtccgagtacaacatgcagagtaaatcgggactcaagttcgtggcggttgttagcggcgagactcaggtagttgctggcatgaattaccggcttattgttgcggttaatgatggcgtaaagatagccggtgctggtgccagcaagaactacgaggctattgtatgggagagggcgtggttgaaatcgatgaatctcacttctttcaagcctgccatttaattaatggctgtttcgtctgagttcttccatatgtaatgatctgataaaaacagt

SEQ ID NO: 4403 - protein, 120 aa, Brassica napus
  misc_feature (1)..(120): useful for making plants with increased salt and oxidative stress resistance as described in USSN 12/922,143
  misc_feature (1)..(120): Ceres Clone ID no. 1090776
  misc_feature (1)..(120): Bit score of 217.2 for hmm based on sequences of FIGURE 3.
  misc_feature (27)..(120): Pfam Name: Cystatin Pfam Description: Cystatin domain
  misc_feature (1)..(120): Functional Homolog Of SEQ ID NO. 102
MNNKATSILLLSLVLLPLYASASPRVGGWRPLSDVNDPHVVEIGRFSVSEYNMQSKSGLKFVAVVSGETQVVAGMNYRLIVAVNDGVKIAGAGASKNYEAIVWERAWLKSMNLTSFKPAI

SEQ ID NO: 4404 - DNA, 517 bp, Brassica napus
  misc_feature (1)..(517): useful for making plants with increased salt and oxidative stress resistance as described in USSN 12/922,143
  misc_feature (1)..(517): Ceres Clone ID no. 1264803
aaaaaaaaagatgcaaagccgtttcttcttcttcatcattgttatctctctctcatccatcttcgtttcctctctgatcgctacttcctgcaacaacgacatggccatgctcggcggcgttcgcgatgtaccttccaacgagaacagtgtcgaggtcgagagcctcgctcgtttcgctgtcgatgagcacaacaagaaagagaatgcactgctcgagttcgcgagagtggtgaaggcgaaagagcaagttgtggcgggaacgatgcaccacctgactcttgagatcatcgaggctgggaagaagaagctttacgaggctaaagtgtgggtgaagccttggttgaacttcaaggagttgcaggagttcaagccttctactaccatcactccctcagatcttggctgcaagaaaggtgagggtgcatctggatggagggaagttccaggagatgatccggaagtgcagcacgttgctgatcatgctgttaagagtatacagcagaggtctaactccttg

SEQ ID NO: 4405 - protein, 169 aa, Brassica napus
  misc_feature (1)..(169): useful for making plants with increased salt and oxidative stress resistance as described in USSN 12/922,143
  misc_feature (1)..(169): Ceres Clone ID no. 1264803
  misc_feature (1)..(169): Bit score of 68.9 for hmm based on sequences of FIGURE 3.
  misc_feature (35)..(123): Pfam Name: Cystatin Pfam Description: Cystatin domain
  misc_feature (1)..(169): Functional Homolog Of SEQ ID NO. 102
MQSRFFFFIIVISLSSIFVSSLIATSCNNDMAMLGGVRDVPSNENSVEVESLARFAVDEHNKKENALLEFARVVKAKEQVVAGTMHHLTLEIIEAGKKKLYEAKVWVKPWLNFKELQEFKPSTTITPSDLGCKKGEGASGWREVPGDDPEVQHVADHAVKSIQQRSNSL

SEQ ID NO: 4406 - DNA, 390 bp, Solanum lycopersicum
  misc_feature (1)..(390): useful for making plants with increased salt and oxidative stress resistance as described in USSN 12/922,143
  misc_feature (1)..(390): Ceres Annot ID no. 8459058
atggccataaaattcaaccgcaatctcgccggaactctcttcgccgccgtggtagtcgcttccctcttcttccacgcctccgctgcactcggcggaggaaaaggcggtttactcggcggttggagccgtataaccgacacaaaagacagtaaagtagcggagatcggtaaattcgcagtggatcagtacaacgagaataccaaatccaaattagtgtttaaacgagtggtgaaaggagaaacacaagtcgtcgccgggacaaattaccgactggtcatctccgccacagacggcggtcgtcgtagccgcagcggcgataagtacttggcggaagtttgggataagccatggatgagctggaggaatctcacttccttcaaaaaattgtag

SEQ ID NO: 4407 - protein, 129 aa, Solanum lycopersicum
  misc_feature (1)..(129): useful for making plants with increased salt and oxidative stress resistance as described in USSN 12/922,143
  misc_feature (1)..(129): Ceres Annot ID no. 8459058
  misc_feature (1)..(129): Bit score of 160.9 for hmm based on sequences of FIGURE 3.
  misc_feature (39)..(117): Pfam Name: Cystatin Pfam Description: Cystatin domain
  misc_feature (1)..(129): Functional Homolog Of SEQ ID NO. 102
MAIKFNRNLAGTLFAAVVVASLFFHASAALGGGKGGLLGGWSRITDTKDSKVAEIGKFAVDQYNENTKSKLVFKRVVKGETQVVAGTNYRLVISATDGGRRSRSGDKYLAEVWDKPWMSWRNLTSFKKL

SEQ ID NO: 4408 - DNA, 372 bp, Sorghum bicolor
  misc_feature (1)..(372): useful for making plants with increased salt and oxidative stress resistance as described in USSN 12/922,143
  misc_feature (1)..(372): Ceres Annot ID no. 8640378
atggctactacgagagctcttctcctgacgacgactgcggcggcgctgctgctcctgctcgccggcggcggaggcgcggcggcggcgcgtgggccgctggcgggcgggtggagcccgatcaggaacgtgagcgagccgcacatccaggagctgggcgggtgggcggtgacggagcacgtcagggtggccaacgacgggctgaggttcggcgaggtgacgagcggggagcagcaggtggtgtccgggatgaactacaggctcgtcctccacgccacggacgccgacggggacgtcgcggcgtacggggccctggtgtacgagcagtcgtggaccaacacccgcgagctcatgtccttcgcgtccgccaactga

SEQ ID NO: 4409 - protein, 123 aa, Sorghum bicolor
  misc_feature (1)..(123): useful for making plants with increased salt and oxidative stress resistance as described in USSN 12/922,143
  misc_feature (1)..(123): Ceres Annot ID no. 8640378
  misc_feature (1)..(123): Bit score of 165.5 for hmm based on sequences of FIGURE 3.
  misc_feature (35)..(123): Pfam Name: Cystatin Pfam Description: Cystatin domain
  misc_feature (1)..(123): Functional Homolog Of SEQ ID NO. 102
MATTRALLLTTTAAALLLLLAGGGGAAAARGPLAGGWSPIRNVSEPHIQELGGWAVTEHVRVANDGLRFGEVTSGEQQVVSGMNYRLVLHATDADGDVAAYGALVYEQSWTNTRELMSFASAN

SEQ ID NO: 4410 - DNA, 408 bp, Sorghum bicolor
  misc_feature (1)..(408): useful for making plants with increased salt and oxidative stress resistance as described in USSN 12/922,143
  misc_feature (1)..(408): Ceres Annot ID no. 8640379
atggcgacgcccggccaccacctcccgctcctcctcctcgtcctggccacccttgccgcggccgccttcgccgtcgccccagtccccggcccggcggcgctgggcggcggcggcccgctgctgggcgggtggaacccgatcccggacgtgggggacaagcacatccaggagctgggcgggtgggcgctggggcaggccaagtaccagaagctggccgccaacgcgctgcggttccgccgcgtggtgcgcggcgaggagcaggtcgtgtccgggatgaggtaccgcctctacgtcgacgccgccgaccgcgccggccgctccgtcacctacgtcgccgtcatctacgagcaggtctggaccaacacccgcaagctcgcctccttcaccctggcgtcccgcgcccactga

SEQ ID NO: 4411 - protein, 135 aa, Sorghum bicolor
  misc_feature (1)..(135): useful for making plants with increased salt and oxidative stress resistance as described in USSN 12/922,143
  misc_feature (1)..(135): Ceres Annot ID no. 8640379
  misc_feature (1)..(135): Bit score of 156.1 for hmm based on sequences of FIGURE 3.
  misc_feature (35)..(123): Pfam Name: Cystatin Pfam Description: Cystatin domain
  misc_feature (1)..(135): Functional Homolog Of SEQ ID NO. 102
MATPGHHLPLLLLVLATLAAAAFAVAPVPGPAALGGGGPLLGGWNPIPDVGDKHIQELGGWALGQAKYQKLAANALRFRRVVRGEEQVVSGMRYRLYVDAADRAGRSVTYVAVIYEQVWTNTRKLASFTLASRAH

SEQ ID NO: 4412 - DNA, 402 bp, Sorghum bicolor
  misc_feature (1)..(402): useful for making plants with increased salt and oxidative stress resistance as described in USSN 12/922,143
  misc_feature (1)..(402): Ceres Annot ID no. 8669169
atgcgcaaacatcgaatcgtcccactcgtggctgccctgctcgtgctgcttgccctcgccgtatcgtccacccgcaaccgcaacgcacaagagggggaggagtccatggcgttggccggcggcatcaaggacgtgccggcgaacgagaacgacctccacctgcaggagctcgcccgcttcgccgtcgaggagcacaacaagaaggccaatgctcttctggggtatgagaagcttgtgaaggccaagacacaagtggttgctggcacgatgtactatctcactgttgaggtgaaggatggcgaagtcaagaagctctacgaagctaaggtctgggagaagccatgggagaacttcaaggagctgcaggaattcaagcctgttgaagagggtgctagcgcctaa

SEQ ID NO: 4413 - protein, 133 aa, Sorghum bicolor
  misc_feature (1)..(133): useful for making plants with increased salt and oxidative stress resistance as described in USSN 12/922,143
  misc_feature (1)..(133): Ceres Annot ID no. 8669169
  misc_feature (1)..(133): Bit score of 104.9 for hmm based on sequences of FIGURE 3.
  misc_feature (40)..(128): Pfam Name: Cystatin Pfam Description: Cystatin domain
  misc_feature (1)..(133): Functional Homolog Of SEQ ID NO. 102
MRKHRIVPLVAALLVLLALAVSSTRNRNAQEGEESMALAGGIKDVPANENDLHLQELARFAVEEHNKKANALLGYEKLVKAKTQVVAGTMYYLTVEVKDGEVKKLYEAKVWEKPWENFKELQEFKPVEEGASA

SEQ ID NO: 4414 - DNA, 483 bp, Sorghum bicolor
  misc_feature (1)..(483): useful for making plants with increased salt and oxidative stress resistance as described in USSN 12/922,143
  misc_feature (1)..(483): Ceres Annot ID no. 8680268
atgcgtcctggccaaaagctactatttaagtggcacctagtcatcttcctaataggtcactactccacggcaaaccaaaaccaattgcttcttcacggacttgcgaccaccaagcctgccatgagggccgccgtcctcctcggagttttgggcatcgccatcgttgccattcacattgttgcgatggcaacacccgccatggctcaaaccttcggtgtgtggtaccctgtagacctcagcgaggggcacgtccagtacatcggcaggtgggcggtcgcggagcacgtgaagcaggccaaggacgggctcaagttcgacaaggtcgtcggcggcgagatgatgatgagtataggcatagacttccgcctcgtcatcgacgcatcatccaccagcgacggcaagcatgccaactacgaggcgagggtgcacgagagggactggatggacggaataagtctcctgtcatttaagccggcaaagtga

SEQ ID NO: 4415 - protein, 160 aa, Sorghum bicolor
  misc_feature (1)..(160): useful for making plants with increased salt and oxidative stress resistance as described in USSN 12/922,143
  misc_feature (1)..(160): Ceres Annot ID no. 8680268
  misc_feature (1)..(160): Bit score of 94.7 for hmm based on sequences of FIGURE 3.
  misc_feature (72)..(160): Pfam Name: Cystatin Pfam Description: Cystatin domain
  misc_feature (1)..(160): Functional Homolog Of SEQ ID NO. 102
MRPGQKLLFKWHLVIFLIGHYSTANQNQLLLHGLATTKPAMRAAVLLGVLGIAIVAIHIVAMATPAMAQTFGVWYPVDLSEGHVQYIGRWAVAEHVKQAKDGLKFDKVVGGEMMMSIGIDFRLVIDASSTSDGKHANYEARVHERDWMDGISLLSFKPAK

SEQ ID NO: 4416 - DNA, 348 bp, Sorghum bicolor
  misc_feature (1)..(348): useful for making plants with increased salt and oxidative stress resistance as described in USSN 12/922,143
  misc_feature (1)..(348): Ceres Annot ID no. 8634192
atgagaaccagcttcctgctcctcgctgctgccatctgcgccgttgtcgcatccgtggtctccgccgattcccaaggatggttcccgttgccggacattgacgccccgaaagtgcagcagcttggcaggtgggcggtgacggagcacgacaagaaggcgaacgacaaggtcaagttcaaccgggtggtgagcggcgaggagacgttggatccggagctagtaggcatcaagtaccacttggtcattgatgcgtcggatggcagtggccagcataggaagtacgaggccgtgctaggcgaggaatggataggtcgtatcattcttatctcctttaatcctgctagatga

SEQ ID NO: 4417 - protein, 115 aa, Sorghum bicolor
  misc_feature (1)..(115): useful for making plants with increased salt and oxidative stress resistance as described in USSN 12/922,143
  misc_feature (1)..(115): Ceres Annot ID no. 8634192
  misc_feature (1)..(115): Bit score of 75.3 for hmm based on sequences of FIGURE 3.
  misc_feature (28)..(115): Pfam Name: Cystatin Pfam Description: Cystatin domain
  misc_feature (1)..(115): Functional Homolog Of SEQ ID NO. 102
MRTSFLLLAAAICAVVASVVSADSQGWFPLPDIDAPKVQQLGRWAVTEHDKKANDKVKFNRVVSGEETLDPELVGIKYHLVIDASDGSGQHRKYEAVLGEEWIGRIILISFNPAR

SEQ ID NO: 4418 - DNA, 502 bp, Triticum aestivum
  misc_feature (1)..(502): useful for making plants with increased salt and oxidative stress resistance as described in USSN 12/922,143
  misc_feature (1)..(502): Ceres Clone ID no. 774977
acaactccccaggccccaacaccagtccatcttcatggcgcgggtacccgtcctcctcctcgccctcttcgccgcggccctcgcggccgccccggcggcggcgctgggcggccgcggcgcgcgggtcggcgggtggggccccatcccggacgtgacggacgcgcacatccaagaactcggcggatgggcggtggagcagcacgcgaggctgaccagcgacgggctgcggttccgccgggtcacgcgcggcgagcagcaggtcgtctccggcatgaactaccgcctcttcgtcgacgcggccgacggctccggcaagagcgcgccctacgtcgccgaggtgtacgagcagtattggaccaagacccgccagctcacctccttcaagccggcggccaactgatccgctccccctccggcgcatgccgatccgcggccggcgaccgcgtccgctctggttaatctcatctgcccgtccttcgtagtttgtactaccactagtgct

SEQ ID NO: 4419 - protein, 121 aa, Triticum aestivum
  misc_feature (1)..(121): useful for making plants with increased salt and oxidative stress resistance as described in USSN 12/922,143
  misc_feature (1)..(121): Ceres Clone ID no. 774977
  misc_feature (1)..(121): Bit score of 206.8 for hmm based on sequences of FIGURE 3.
  misc_feature (32)..(120): Pfam Name: Cystatin Pfam Description: Cystatin domain
  misc_feature (1)..(121): Functional Homolog Of SEQ ID NO. 102
MARVPVLLLALFAAALAAAPAAALGGRGARVGGWGPIPDVTDAHIQELGGWAVEQHARLTSDGLRFRRVTRGEQQVVSGMNYRLFVDAADGSGKSAPYVAEVYEQYWTKTRQLTSFKPAAN

SEQ ID NO: 4420 - DNA, 557 bp, Triticum aestivum
  misc_feature (1)..(557): useful for making plants with increased salt and oxidative stress resistance as described in USSN 12/922,143
  misc_feature (1)..(557): Ceres Clone ID no. 778279
aacaccgaaaagtgaaaaccaaaagcaagagaactcggccatggcgagaccgctcttcctgctcgccctcctggccacggctctcgcagccacctcaaccctcggccgccgcggcgggctcctgggcgggtggagccccgtcccggacgtgaacgacgcgcacgtccaggagctcggcgggtgggcggtggcccagcaccccagcctagccaacgacgggctgctcttccgccgggtgacgcgcggcgagcagcaggtggtgtccgggatgaactaccgcctcttggtggtcgcggcggacggctccggcaagagcgtgatctatctcgcgcagatctacgagcactggagcggcacccgcaaactcacgtccttcaagccggctgccggcggctaactgatgcgccttgaatttcatctgttcgtcctttgtgcatgtacgtagtactccactacaagtaaataaatgagtcgtgtggtttgatcgtcaggcatgcagttcatcctgactaataatatttgctatcactagcaaataaaaatgtgattactcttcc

SEQ ID NO: 4421 - protein, 118 aa, Triticum aestivum
  misc_feature (1)..(118): useful for making plants with increased salt and oxidative stress resistance as described in USSN 12/922,143
  misc_feature (1)..(118): Ceres Clone ID no. 778279
  misc_feature (1)..(118): Bit score of 172.1 for hmm based on sequences of FIGURE 3.
  misc_feature (29)..(116): Pfam Name: Cystatin Pfam Description: Cystatin domain
  misc_feature (1)..(118): Functional Homolog Of SEQ ID NO. 102
MARPLFLLALLATALAATSTLGRRGGLLGGWSPVPDVNDAHVQELGGWAVAQHPSLANDGLLFRRVTRGEQQVVSGMNYRLLVVAADGSGKSVIYLAQIYEHWSGTRKLTSFKPAAGG

SEQ ID NO: 4422 - DNA, 491 bp, Zea mays
  misc_feature (1)..(491): useful for making plants with increased salt and oxidative stress resistance as described in USSN 12/922,143
  misc_feature (1)..(491): Ceres Clone ID no. 337918
aaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtatgggagaagccatgggagaagttcaaggagctgcaggaattcaaacctgttgaagagggtgctaccgctaaggatgtctccttctccatgtgcgagcctgaagctcaaagcaggttcaccatttaaaggtcttggtaactgaagtcccgaaatccttctcccat

SEQ ID NO: 4423 - protein, 121 aa, Zea mays
  misc_feature (1)..(121): useful for making plants with increased salt and oxidative stress resistance as described in USSN 12/922,143
  misc_feature (1)..(121): Ceres Clone ID no. 337918
  misc_feature (1)..(121): Bit score of 73.1 for hmm based on sequences of FIGURE 3.
  misc_feature (10)..(98): Pfam Name: Cystatin Pfam Description: Cystatin domain
  misc_feature (1)..(121): Functional Homolog Of SEQ ID NO. 102
MANNTGTLVGGIQDVPGSENDLHLQELARFAVDEHNKKANALLGFEKLVKAKTQVVAGTMYYLTIEVKDGEVKKLYEAKVWEKPWEKFKELQEFKPVEEGATAKDVSFSMCEPEAQSRFTI

SEQ ID NO: 4424 - DNA, 772 bp, Zea mays
  misc_feature (1)..(772): useful for making plants with increased salt and oxidative stress resistance as described in USSN 12/922,143
  misc_feature (1)..(772): Ceres Clone ID no. 1598477
gcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcaaggggctgcaggaattcaagcctgttgaagagggtgctagcgcctaaggatgtctccttctccatgtgcgagcctgaagctcaaagcaaagttgcagaataaggagccatgctcccttgtgtaatttcataagactacaaccctattagggcttgtttggttgtgtctgtatcgaagggaattgaaggtgattaattttccttctattctaatagaggggttttaatctcctccaatactcttcaatccacacctaaccgaacaagcccttaatatgatatcttacattgccgtatctgtgtaatatcatgaataaaatttgctattatgtattctaaggttaaaaaaaaaagcccactccagcgctgaaggcctgcagcgccagcgcagcgcctctctgctactgtgctggctga

SEQ ID NO: 4425 - protein, 103 aa, Zea mays
  misc_feature (1)..(103): useful for making plants with increased salt and oxidative stress resistance as described in USSN 12/922,143
  misc_feature (1)..(103): Ceres Clone ID no. 1598477
  misc_feature (1)..(103): Bit score of 67.7 for hmm based on sequences of FIGURE 3.
  misc_feature (10)..(98): Pfam Name: Cystatin Pfam Description: Cystatin domain
  misc_feature (1)..(103): Functional Homolog Of SEQ ID NO. 102
MANNTGTLVGGIQDVPGSENDLHLQELARFAVDEHNKKANALLGFEKLVKAKTQVVAGTMYYLTIEVKDGEVKKLYEAKVWEKPWENLKGLQEFKPVEEGASA

SEQ ID NO: 4426 - protein, 118 aa, Vitis vinifera
  misc_feature (1)..(118): useful for making plants with increased salt and oxidative stress resistance as described in USSN 12/922,143
  misc_feature (1)..(118): Public GI ID no. 147854421
  misc_feature (1)..(118): Bit score of 228.1 for hmm based on sequences of FIGURE 3.
  misc_feature (32)..(118): Pfam Name: Cystatin Pfam Description: Cystatin domain
  misc_feature (1)..(118): Functional Homolog Of SEQ ID NO. 102
  misc_feature (44)..(44): Xaa is any aa, unknown or other
  misc_feature (61)..(61): Xaa is any aa, unknown or other
MAWGQNRLFLFLTAALLLLNGGFAARTEALAGGWRPIKNISDPXVQEIGEFAVTEHNKQAXESLKFQSVVSGETQVVSGTNYRLVVVAEDGGVSNKYEAVVWEKPWMGFRNLTSFTRV

SEQ ID NO: 4427 - DNA, 783 bp, Panicum virgatum
  misc_feature (1)..(783): useful for making plants with increased salt and oxidative stress resistance as described in USSN 12/922,143
  misc_feature (1)..(783): Ceres Clone ID no. 1890423
aacacaaacaggaacagctacccagcaactagctagcatccatgcagccaatggcatccctcacagcgaacgcactgtgcgtcgtccccaccatggcgacggcagctgcaccgcgccgccaccgcagcctcgtcgtggccagagcttctgctgccaaggttgatgacgccgccggtgggcggcgccgagccatggtgttgctcgccgccgcggcggccaccactgcctcgacagcagccgccggccggtccgcgagagccgctgtgtccacgaaaaccgggcagtgggcggaaatagagaacgtgacggacccttacgtgcaggatctcggcaaatgggctgtcacggagcacaacaagcagtctggggagggtttggagtttggtaaggtcgtcagaggcaggcagcaagtcgtcgcgggcatgaactacagtctcgagatcgaaacgaagggaccctcccgtttctacgaagcgggtctgtttgtttccctgccgccggagaagcgtcagctcaagtccttcacgcccttgcttgggtgatgggaacaggttgctgcaagctgaggacggccattgcatgctctgagtctctctgatgtgtgtgtttgggccttgctactgttccccaatgtctgagagtcgtatgtggtgttctactaataatttggttttgcagaataaagggaacaaattaaaggtggcttgtgtttttcttttctcaattaactgtctatgttttcatgcatgcatgcaaggacatggccccgagaaaggtttcacg

SEQ ID NO: 4428 - protein, 166 aa, Panicum virgatum
  misc_feature (1)..(166): useful for making plants with increased salt and oxidative stress resistance as described in USSN 12/922,143
  misc_feature (1)..(166): Ceres Clone ID no. 1890423
  misc_feature (1)..(166): Bit score of 103.6 for hmm based on sequences of FIGURE 3.
  misc_feature (80)..(166): Pfam Name: Cystatin Pfam Description: Cystatin domain
  misc_feature (1)..(166): Functional Homolog Of SEQ ID NO. 102
MQPMASLTANALCVVPTMATAAAPRRHRSLVVARASAAKVDDAAGGRRRAMVLLAAAAATTASTAAAGRSARAAVSTKTGQWAEIENVTDPYVQDLGKWAVTEHNKQSGEGLEFGKVVRGRQQVVAGMNYSLEIETKGPSRFYEAGLFVSLPPEKRQLKSFTPLLG

SEQ ID NO: 4429 - DNA, 642 bp, Panicum virgatum
  misc_feature (1)..(642): useful for making plants with increased salt and oxidative stress resistance as described in USSN 12/922,143
  misc_feature (1)..(642): Ceres Clone ID no. 2025090
agatgcgcaaacacctaatcgccggaccggtcgctgccctgctcgccctcgccctcaccctcaccctcaccctcaccctctcgctcacccgcagcgcgcaagaggagccgctcatggccgaccgcgagccgctggctggcggcgtcacggacgcgccgcagaacgacaacgacatccacctccaggagctcgcccgcttcgccgtcgacgagcacaacaagaagaccaatgctctcctggagttcgagaagcttgtgaaggcgaagacgcaagtggttgctggaaccatgtactatctcactgttgaggtgaaggatggggaaaccaagaagctctatgaagctaaggtctgggagaagccatgggagaacttcaaggagctgcaggaattcaagcctgtggaagagagtgctagcgcttaaggatccctcgtcttccacgtgcaattgctgcctgaagcgctaaacagacttgcagaataaggagctggatcggatgtaatagttgtgtcgttgtgagctccgttgtgtaatatcgtatgaacaccttgccctttgtgtaatatcatgaatgacagtgccctttgtgtataactaaataactgcgctgagttttcatcagtacagtcgcgacggaattctc

SEQ ID NO: 4430 - protein, 139 aa, Panicum virgatum
  misc_feature (1)..(139): useful for making plants with increased salt and oxidative stress resistance as described in USSN 12/922,143
  misc_feature (1)..(139): Ceres Clone ID no. 2025090
  misc_feature (1)..(139): Bit score of 77.5 for hmm based on sequences of FIGURE 3.
  misc_feature (46)..(134): Pfam Name: Cystatin Pfam Description: Cystatin domain
  misc_feature (1)..(139): Functional Homolog Of SEQ ID NO. 102
MRKHLIAGPVAALLALALTLTLTLTLSLTRSAQEEPLMADREPLAGGVTDAPQNDNDIHLQELARFAVDEHNKKTNALLEFEKLVKAKTQVVAGTMYYLTVEVKDGETKKLYEAKVWEKPWENFKELQEFKPVEESASA

SEQ ID NO: 4431 - DNA, 655 bp, Panicum virgatum
  misc_feature (1)..(655): useful for making plants with increased salt and oxidative stress resistance as described in USSN 12/922,143
  misc_feature (1)..(655): Ceres Clone ID no. 1959764
agatgcgcaaacaccggatcgccggactcgtggctgccctgctcgccctcgccctcgccctctccctctccctctcgtccctccgcaccgcgcaagaggagccgcccatggcggacagcgggcctctggcgggcggcgtcacggacgtgccgcagaacgaaaacgacatccacctacaggagctcgcccgcttcgccgtcgacgagcacaacaagaaggccaatgctctcctggggttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgttgaagagagtgctagcgcttaaggatatctcgtcttccacgtgcaattgctacctgaagcactaaacagacttgcagaataaggagctggttcggatgtataatagatgtgctgttgcgagctccgttgtgtagtatcataagatcaccttgccctttgtgtaatatcatgaataacggtgtcctttgtgtaaaatcatgaattcagtgccctttatgtgtaacattataaataaataacaggggctgagtattcatcagt

SEQ ID NO: 4432 - protein, 137 aa, Panicum virgatum
  misc_feature (1)..(137): useful for making plants with increased salt and oxidative stress resistance as described in USSN 12/922,143
  misc_feature (1)..(137): Ceres Clone ID no. 1959764
  misc_feature (1)..(137): Bit score of 86.6 for hmm based on sequences of FIGURE 3.
  misc_feature (44)..(132): Pfam Name: Cystatin Pfam Description: Cystatin domain
  misc_feature (1)..(137): Functional Homolog Of SEQ ID NO. 102
MRKHRIAGLVAALLALALALSLSLSSLRTAQEEPPMADSGPLAGGVTDVPQNENDIHLQELARFAVDEHNKKANALLGFEKLVKAKTQVVAGTMYYLTVEVKDGEAKKLYEAKVWEKPWENFKELQEFKPVEESASA

SEQ ID NO: 4433 - DNA, 627 bp, Panicum virgatum
  misc_feature (1)..(627): useful for making plants with increased salt and oxidative stress resistance as described in USSN 12/922,143
  misc_feature (1)..(627): Ceres Clone ID no. 1721159
agatgcgcaaacaccgaatcgccggaccggtcgctgccctgctcgccctcaccctcaccctctcgctcccccgcagcgcgcaagaggagccgcccatggccgaccgcgggccgctggctggcggcgtcacggacgcgccgcagaacgacaacgacatccacctccaggagctcgcccgcttcgccgtcgacgagcacaacaagaagaccaatgctctcctggagttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgtggaagagagtgctagcgcttaaggatccctcgtcttccacgtgcaattgctgcctgcagcgctaaacagacttgcagaataaggagctggatcggatgtaatagctgtgtcgttgtgagctccgttgtgtaatatcgtatgaacaccttgccctttgtgtaatatcatgaatgacagtgccctttgtgtataactaaataactgcgctgagttttcattagtacgagtcgcgacggaattctcat

SEQ ID NO: 4434 - protein, 133 aa, Panicum virgatum
  misc_feature (1)..(133): useful for making plants with increased salt and oxidative stress resistance as described in USSN 12/922,143
  misc_feature (1)..(133): Ceres Clone ID no. 1721159
  misc_feature (1)..(133): Bit score of 76.5 for hmm based on sequences of FIGURE 3.
  misc_feature (40)..(128): Pfam Name: Cystatin Pfam Description: Cystatin domain
  misc_feature (1)..(133): Functional Homolog Of SEQ ID NO. 102
MRKHRIAGPVAALLALTLTLSLPRSAQEEPPMADRGPLAGGVTDAPQNDNDIHLQELARFAVDEHNKKTNALLEFEKLVKAKTQVVAGTMYYLTVEVKDGEAKKLYEAKVWEKPWENFKELQEFKPVEESASA

SEQ ID NO: 4435 - DNA, 632 bp, Panicum virgatum
  misc_feature (1)..(632): useful for making plants with increased salt and oxidative stress resistance as described in USSN 12/922,143
  misc_feature (1)..(632): Ceres Clone ID no. 1865100
agatgcgcaaacaccgaatcgccggaccggtcgctgccctgctcgccctcaccctcaccctcaccctctcgctcacccgcagcgcgcaagaggagccgcccatggccgaccgcgggccgctggctggcggcgtcacggacgcgccgcacaacgacaacgacatccacctccaggagctcgcccgcttcgccgtcgacgagcacaacaagaagaccaatgctctcctggagttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcacgaattcaagcctgtggaagagagtgctagcgcttaaggatccctcgtcttccacatgcaattgctgcctgaaccgctaaacagacttgcagaataaggagctggattggatgtaatagctgtgtcattgtgagctccgttgtgtaatatcgtatgaacaccttgccctttgtgtaatatcatgaatgacagtgccctttgtgtataactaaataactgcgctgagttttcatcaaaaaaagttttcacccccaaccct

SEQ ID NO: 4436 - protein, 135 aa, Panicum virgatum
  misc_feature (1)..(135): useful for making plants with increased salt and oxidative stress resistance as described in USSN 12/922,143
  misc_feature (1)..(135): Ceres Clone ID no. 1865100
  misc_feature (1)..(135): Bit score of 77.5 for hmm based on sequences of FIGURE 3.
  misc_feature (42)..(130): Pfam Name: Cystatin Pfam Description: Cystatin domain
  misc_feature (1)..(135): Functional Homolog Of SEQ ID NO. 102
MRKHRIAGPVAALLALTLTLTLSLTRSAQEEPPMADRGPLAGGVTDAPHNDNDIHLQELARFAVDEHNKKTNALLEFEKLVKAKTQVVAGTMYYLTVEVKDGEAKKLYEAKVWEKPWENFKELHEFKPVEESASA

SEQ ID NO: 4437 - DNA, 688 bp, Panicum virgatum
  misc_feature (1)..(688): useful for making plants with increased salt and oxidative stress resistance as described in USSN 12/922,143
  misc_feature (1)..(688): Ceres Clone ID no. 2050930
agatgcgcaaacaccgaatcgccggaccggtcgctgccctgctcgccctcaccctcaccctcaccctctcgctcacccgcagcgcgcaagaggagccgcccatggccgaccgcgggccgctggctggcggcgtcacggacgcgccgcagaacgacaacgacatccacctccaggagctcgcccgcttcgccgtcgacgaccacaacaagaagaccaatgctctcctggagttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgtggaagagagtgctagcgcttaaggatccctcgtcttccacgtgcaattgctgcctgaagcgctaaacagacttgcagaataaggagctggatcggatgtaatagctgtgtcgttgtgagctccgttgtgtaatatcgtatgaacaccttgccctttgtgtaatatcatgaatgacagtgccctttgtgtataactaaataactgcgctgagttttcatcagtacgagtcgtgacggaattctcatatcgcagtcttcaactaggagcacgttgattgttcaagtcttctgttagcttgtt

SEQ ID NO: 4438 - protein, 135 aa, Panicum virgatum
  misc_feature (1)..(135): useful for making plants with increased salt and oxidative stress resistance as described in USSN 12/922,143
  misc_feature (1)..(135): Ceres Clone ID no. 2050930
  misc_feature (1)..(135): Bit score of 72.2 for hmm based on sequences of FIGURE 3.
  misc_feature (42)..(130): Pfam Name: Cystatin Pfam Description: Cystatin domain
  misc_feature (1)..(135): Functional Homolog Of SEQ ID NO. 102
MRKHRIAGPVAALLALTLTLTLSLTRSAQEEPPMADRGPLAGGVTDAPQNDNDIHLQELARFAVDDHNKKTNALLEFEKLVKAKTQVVAGTMYYLTVEVKDGEAKKLYEAKVWEKPWENFKELQEFKPVEESASA

SEQ ID NO: 4439 - DNA, 664 bp, Panicum virgatum
  misc_feature (1)..(664): useful for making plants with increased salt and oxidative stress resistance as described in USSN 12/922,143
  misc_feature (1)..(664): Ceres Clone ID no. 1882676
agatgcgcaaacaccggatcgccggactcgtggctgccctgctcgccctcgccctctccctctccctctcgtccctccgcaccgcgcaagaggagccgcccatggcggacagcgggcctctggcgggcggcgtcacggacgtgccgcagaacgaaaacgacatccacctacaggggctcgcccgcttcgccgtcgacgagcacaacaagaaggccaatgctctcctggggttcgagaagcttgtgaaggcgaagacgcaagtggttgctggaaccatgtactatctcactgttgaggtgaaggatggggaagccaagaagctctatgaagctaaggtctgggagaagccatgggagaacttcaaggagctgcaggaattcaagcctgttgaagagagtgctagcgcttaaggatatctcgtcttccacgtgcaattgctacctgaagcactaaacagacttgcagaataaggagctggttcggatgtataatagatgtgctgttacgagctccgttgtgtagtatcataagatcaccttgccctttgtgtaatatcatgaataacggtgtcctttgtgtaaaatcatgaattcagtgccctttatgtgtaacattataaataaataacagggctgagtattcatcagtacgactcgtgacggat

SEQ ID NO: 4440 - protein, 135 aa, Panicum virgatum
  misc_feature (1)..(135): useful for making plants with increased salt and oxidative stress resistance as described in USSN 12/922,143
  misc_feature (1)..(135): Ceres Clone ID no. 1882676
  misc_feature (1)..(135): Bit score of 81.4 for hmm based on sequences of FIGURE 3.
  misc_feature (42)..(130): Pfam Name: Cystatin Pfam Description: Cystatin domain
  misc_feature (1)..(135): Functional Homolog Of SEQ ID NO. 102
MRKHRIAGLVAALLALALSLSLSSLRTAQEEPPMADSGPLAGGVTDVPQNENDIHLQGLARFAVDEHNKKANALLGFEKLVKAKTQVVAGTMYYLTVEVKDGEAKKLYEAKVWEKPWENFKELQEFKPVEESASA

SEQ ID NO: 4441 - protein, 140 aa, Oryza sativa subsp. indica
  misc_feature (1)..(140): useful for making plants with increased salt and oxidative stress resistance as described in USSN 12/922,143
  misc_feature (1)..(140): Public GI ID no. 146403773
  misc_feature (1)..(140): Bit score of 75.5 for hmm based on sequences of FIGURE 3.
  misc_feature (48)..(135): Pfam Name: Cystatin Pfam Description: Cystatin domain
  misc_feature (1)..(140): Functional Homolog Of SEQ ID NO. 102
MRKYRVAGLVAALLVLHSLATPSAQAEAHRAGGEGEEKMSSDGGPVLGGLEPVGNENDLHLVDLARFAVTEHNKKANSLFEFEKRVSVKQQVVAGTLYYFTIEVKEGEAKKLYEAKVWEKPWMDFKELQEFKPVDASANA

SEQ ID NO: 4442 - protein, 481 aa, Zea mays
  misc_feature (1)..(481): useful for making plants with increased salt and oxidative stress resistance as described in USSN 12/922,143
  misc_feature (1)..(481): Public GI ID no. 194697654
  misc_feature (1)..(481): Bit score of 1227.3 for hmm based on sequences of FIGURE 7.
  misc_feature (40)..(476): Pfam Name: p450 Pfam Description: Cytochrome P450
  misc_feature (1)..(481): Functional Homolog Of SEQ ID NO. 441
MMMMMAGEHVLAALATLLLASLLTLVLNHFLPLPLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 4443 - protein, 472 aa, Vitis vinifera
  misc_feature (1)..(472): useful for making plants with increased salt and oxidative stress resistance as described in USSN 12/922,143
  misc_feature (1)..(472): Public GI ID no. 157350959
  misc_feature (1)..(472): Bit score of 1107.3 for hmm based on sequences of FIGURE 7.
  misc_feature (36)..(467): Pfam Name: p450 Pfam Description: Cytochrome P450
  misc_feature (1)..(472): Functional Homolog Of SEQ ID NO. 441
MAVGFWFVLLVGLVGLVLGLILNHFLPLFFKLGHVPKGTFGWPLLGETLCFLKPHPSNSLGAFLQDRCSRFGKVFKSHLFFSPTVVSCDQELNYFILQNEDKLFQCSYPKPIHGILGKISMLVAVGDTHKRLRNVALSLVTTTKTKPEFLNEVERAAIRVLDSWKDKPQIIFCEEARKFTFNVIVKQVLGLTPDDPQTAKILQDFLTFMRGLISLPLYIPGTPYARAVQARIRISSTVKAIIEERRRDAENSSKRDDFLEILLCVDTLSEDEKVSFVLDSLLGGYETTSLLMALAVHFLGKSPTALEQLKLEHQKIRSMKQKDDYLNWDDYKRMDFTQNVIHEALRCGNVVKFVHRKALKDVKFRDYLIPSGWKVLPVFSAVHLDPSLHASALQFHPWRWEGRDQTCKKFTPFGGGSRCCPGSELAKIQVAFFLHHLVQNFRWNTKDGDQPFAYPYVEFQRGLALNLDHCST

SEQ ID NO: 4444 - protein, 488 aa, Vitis vinifera
  misc_feature (1)..(488): useful for making plants with increased salt and oxidative stress resistance as described in USSN 12/922,143
  misc_feature (1)..(488): Public GI ID no. 157348151
  misc_feature (1)..(488): Bit score of 1078.7 for hmm based on sequences of FIGURE 7.
  misc_feature (34)..(482): Pfam Name: p450 Pfam Description: Cytochrome P450
  misc_feature (1)..(488): Functional Homolog Of SEQ ID NO. 441
MSDLEFFLLLLASISVPLVILNLIKRKQSGLNLPPGNTGWPFLGETIGYLKPYSATSIGDFMEQHISRFGEIYKSNLFGEPTIVSADSGLNRFILQNEGKLFECSYPRSIGGILGKWSMLVLVGDMHRDMRTISLNFLSHGRLRTHLLPEVVKHTLLVLSSWKENCTFSAQDEAKKFTFNLMAKHIMSLDPGKPETEQLKKEYVTFMKGVVSAPLNFPGTAYRKALQSRSTILKFIELKMEERIQKLRGGGFENMEDDDLLGWVLKHSNLSTEQILDLVLSLLFAGHETSSVAIALAIYFLEGCPNAVQQLREEHLEISRAKKQSGELELSWEDYKKMEFTQCVISETLRLGNVVRFLHRKALKDVRYKGYDIPCGWKVLPVIAAVHLDPSLFDQPQHFNPWRWQQNNGNRGNSTSWSTATNQNFMPFGGGPRLCAGSELAKLEMAVFIHHLVLNYNWELVDKDQAFAFPFVDFPKGLPIKVRHHNFT

SEQ ID NO: 4445 - protein, 485 aa, Pisum sativum
  misc_feature (1)..(485): useful for making plants with increased salt and oxidative stress resistance as described in USSN 12/922,143
  misc_feature (1)..(485): Public GI ID no. 144905175
  misc_feature (1)..(485): Bit score of 1049.1 for hmm based on sequences of FIGURE 7.
  misc_feature (36)..(480): Pfam Name: p450 Pfam Description: Cytochrome P450
  misc_feature (1)..(485): Functional Homolog Of SEQ ID NO. 441
MSDSDITFYCLSSILSLLLIFILIKTKQTKPKLNLPPGKMGWPFLGETIGYLKPYSATTIGEFMEQHIARYGKIYKSKLFGEPAIVSADAGLNRFILQNEGKLFECSYPRSIGGILGKWSMLVLVGDMHRDMRVISLNFLSHARLRTHLLKEVEKHTLLVLSSWKEKSTFAAQDEAKKFTFNLMAEHIMSLQPGEIETEKLKKEYVTFMKGVVSAPLNFPGTAYWKALKSRCKILKFIEEKMEERIKRMKDGNENLEEDDLLNWVLKHSNLSTEQILDLILSLLFAGHETSSVSIALAIYFLPGCPRAIQQLREEHREIARVKKQAGETELTWEDYKKMEFTHCVVNETLRLGNVVRFLHRKALKDVRYKGYDIPCGWKVLPVIAAVHLDPLLFDQPQHFNPWRWQNNGNCSNASSNNNNNFLPFGGGPRLCAGSELAKLEMAVFIHYLILNYHWELIDNNDQAFAYPFVDFPKGLRIQVQPHQL

SEQ ID NO: 4446 - protein, 476 aa, Pisum sativum
  misc_feature (1)..(476): useful for making plants with increased salt and oxidative stress resistance as described in USSN 12/922,143
  misc_feature (1)..(476): Public GI ID no. 144905184
  misc_feature (1)..(476): Bit score of 756.1 for hmm based on sequences of FIGURE 7.
  misc_feature (38)..(473): Pfam Name: p450 Pfam Description: Cytochrome P450
  misc_feature (1)..(476): Functional Homolog Of SEQ ID NO. 441
MDTTWILFATPIFLCTLILYYRNRLSLKLKSKHGNQLPLGSLGWPFIGETIDFVSCAYTDRPESFMTKRRTMYGKVFKSHIFGSPTIVSTDADVNKFILQSDAKVFVPSYPKSLMKLMGESSILLINGTLQRRIHGLIGAFFKSQQLKIQITTDMEKYVQESMANWKEDQPIYIQDETKKIAFHVLVKALISLDPGEEMEFLIKHFKEFISGLMSLPISLPGTKLYQSLQAKKKMAKLVRKTIEARRNKGVTEVPKDVVDVLLNDTSEKLTDDLIADNIIDMMIPGEDSVPILMTLATKYLSECPDALQQLTEENIKIKKLKDQLEEPLCWSDYLSLPFTQKIITETLRMGNIINGVMRKALKDVEIKGYIIPQGWCVFANFRSVHLDEKNYDCPYQFNPWRWQEKDMNLNSNNFSPFGGGQRLCPGIDLARLEASIYLHHLVTQFRWYAEEDTIVNFPTVRMKRRMPVLVKRVEI

SEQ ID NO: 4447 - protein, 470 aa, Vitis vinifera
  misc_feature (1)..(470): useful for making plants with increased salt and oxidative stress resistance as described in USSN 12/922,143
  misc_feature (1)..(470): Public GI ID no. 157335513
  misc_feature (1)..(470): Bit score of 365.8 for hmm based on sequences of FIGURE 7.
  misc_feature (36)..(464): Pfam Name: p450 Pfam Description: Cytochrome P450
  misc_feature (1)..(470): Functional Homolog Of SEQ ID NO. 441
MEKPGFLAYVVIFLLALLFYILRREKREPKHRAKLPPGSMGWPYIGETLQLYSQDPSVFFAAKQKRYGEIFKTHILGCPCVMLASPEAARFVLVTQAHLFKPTYPKSKERLIGPSALFFHQGDYHNRLRKLVQGSLSPEAIRNLVADIEALAVSALDSWAGGHVFNTFHEIKKFSFEVGILAIFGRLEAHYREELKKNYCIVDRGYNSFPTNIPGTPYKKALWARKRLSKILSELIGQRKEKRLADKDLLGSLLNSKDEKGETLTNDQIADNIIGVLFAAQDTTASVMTWILKYLHDDPKLLEAVKAEQKAINKSNEEGNRPLTWSQTRNMPVTHKVILESLRMASIISFTFREAVADVEFKGYLIPKGWKVMPLFRNIHHDPKFFPDPQKFDPSRFEVAPKPNTFVPFGNGVHACPGNELAKLEMLIMTHHLVTKFRWEVAGFQSGIQYGPFPVPVNGLPARLWKQSTT

SEQ ID NO: 4448 - DNA, 1479 bp, Sorghum bicolor
  misc_feature (1)..(1479): useful for making plants with increased salt and oxidative stress resistance as described in USSN 12/922,143
  misc_feature (1)..(1479): Ceres Annot ID no. 8713588
atggctttcctcctcgctgtagcttgcatctacatcgtgttctcactactcactctgttggtgctgctcgtcgtgagcagacgcagaacgacggcggtcactgccggaaaaaccggaggtgccaccacggagcaggatcacaacaagctgcctcctggctccctgggcctgccgatcatcggcgagactctccagctctacacccagaatccaaaggacttctttgcctccaggctgaagaggtacggcgaggtgttcaagacgcacgtcctgggttgcccgtgcgtgatcctggcaagcccggaggcggcgcggatggtgctggtgtcgcaggcgcacctgttcaagccgacgtacccgccgagcaaggagcgcatgatcggggcgcaggccctcttcttccaccagggcgactaccaccgccgcctgcgccgcctcgtccagagctgggtcggccccgacgcgctccgcgccctcgtgcccgacgtcgaggccgccgtggcgtccacgctccgccggtgggaaggcaacgtcaccagcaccttccacaccatgaagacgctcaccttcgacgtcggcgtcgtcaccatcttcggccgccggctggccgaccacgtgaaggaggagctcaggaagcactacttgatcgtggagaaaggctacaacagcttccccatccccgtccccttcactagctactgccaggccatcaaggcgaggcggcggctgggcgagatactgagcggcatcctggcggagcggcggcgtgcgcggagcggcgacctgggcggcggcggcgacgacgacgacctcctgaacaccctcatgcgctaccgcgacgacaccggggcggcgctctcggacgaccaggtcgccgacaacgtcatcggcgtgctgttcgcggcgcaggacacgacggcgagcgtgctcacctggatcctcaagttcctccacgacaacccgaagcttctggaagccgtcaaggcggaacagatggcaatctacgaggagaacgatggcgggaagctgccgctgacgtgggcgcagacgaggaggatgccgataacacacctggttatcttggagagtctgaggatggcgagcatcatctccttcacgttcagagaggctgttgaggacgtgcactatcaagggttcctgattcccaaagggtggaaggtgatgcctctgttcaggaacatgcactacagcccggactacttccaggatccacacaagttcgacccttcccggttcaaggtgacgccgcgccccggcacgttcctgccgttcgggagcggcgtgcacgcgtgccccggcaacgacctggccaagctcgagatgctcgtcctcatccaccgcctcgtcaccacctacaggtgggaggtggaggggtcgagcgacgacgtgacctacagcccgttcccggtgccgaagcgcggcctccaggcgaggctcaccagggccgccaccgcctga

SEQ ID NO: 4449 - protein, 492 aa, Sorghum bicolor
  misc_feature (1)..(492): useful for making plants with increased salt and oxidative stress resistance as described in USSN 12/922,143
  misc_feature (1)..(492): Ceres Annot ID no. 8713588
  misc_feature (1)..(492): Bit score of 315.2 for hmm based on sequences of FIGURE 7.
  misc_feature (51)..(486): Pfam Name: p450 Pfam Description: Cytochrome P450
  misc_feature (1)..(492): Functional Homolog Of SEQ ID NO. 441
MAFLLAVACIYIVFSLLTLLVLLVVSRRRTTAVTAGKTGGATTEQDHNKLPPGSLGLPIIGETLQLYTQNPKDFFASRLKRYGEVFKTHVLGCPCVILASPEAARMVLVSQAHLFKPTYPPSKERMIGAQALFFHQGDYHRRLRRLVQSWVGPDALRALVPDVEAAVASTLRRWEGNVTSTFHTMKTLTFDVGVVTIFGRRLADHVKEELRKHYLIVEKGYNSFPIPVPFTSYCQAIKARRRLGEILSGILAERRRARSGDLGGGGDDDDLLNTLMRYRDDTGAALSDDQVADNVIGVLFAAQDTTASVLTWILKFLHDNPKLLEAVKAEQMAIYEENDGGKLPLTWAQTRRMPITHLVILESLRMASIISFTFREAVEDVHYQGFLIPKGWKVMPLFRNMHYSPDYFQDPHKFDPSRFKVTPRPGTFLPFGSGVHACPGNDLAKLEMLVLIHRLVTTYRWEVEGSSDDVTYSPFPVPKRGLQARLTRAATA

SEQ ID NO: 4450 - DNA, 1452 bp, Sorghum bicolor
  misc_feature (1)..(1452): useful for making plants with increased salt and oxidative stress resistance as described in USSN 12/922,143
  misc_feature (1)..(1452): Ceres Annot ID no. 8722834
atggattcctctcttatcctagcgctgatactcgccgtcgctttggccctgctcctccatctcctaacgagtgcaaataataagccacggcgggccaagcaggtgcccccgggctccctgggcctgccggtgatcggccagagcctgagccttctccgcgccatgcgcgccaactccggcgagcggtggatccaggaccggatccaccggtacggcccggtgtccaagctatcgctgttcggtgcgccgacggtgctccttgcggggcccgccgccaacaagttcaccttcttcagcagggccctagcgatgcagcagccccggtcggtgcagaggatcctcggggagaagagcatcctggagctcgtcggcgccgaccacaagcggatccgcggcgcgctggccgagttcctcaagccggacatgctgaggctgtacgtgggcaagatcgacggcgaggtgcggcgccacctcgacgagcgctgggccggccgcaccaccgtcacggtgatgccgctcatgaagcggctcacgttcgacatcatctccctgctgctcttcggcctccagcggggcgccccgctccaggacgcgctcgccgccgacttcgcgcgcgtcatggatggcatctgggccgtcccggtgaacctgcccttcacggccttcagccggagcctcagggccagcgccagggctcgccggctcatcgccgggatcctgcgggagaccagggccaagctggaaaccggcgaggcctcccggagcagcgacctcatcgcgtgcctgctcagcctgaccgaccaccacagcggcgcgccgctgctgagcgacaaggagatcgtcgacaactccgtcgtcgccctcgtcgccggccacgacacgtcgtccatcctcatgacgttcatggtccgccagctcgccaacgacccggacaccctcgccgccatggtccaagagcacgacgacatcgcaaagagcaagggcgacggcgaggccctggactgggaggacctggcgaagatgaagtacacgtggcgcgtcgcgctggagacgcttcgcctggtgcctcccatgttcggcgacttccggcgagcgttacaggacgtcgagttcgacggctacctgatcccgaaaggatggcaggtgttctgggtggcgagcgtgacgcacatggacccgggcatcttcccggagccggccaggtttgagccgtctcggttcgagaaccaatcgccgccgtgctcgttcgtcgcgttcggcgggggtccgaggatctgcgtcggcatggagttcgccaggatcgagacgctggtgacgatgcattacctcgtcaggcgatttaggtggaaactctgctgcaagaaggacacgtatgccagggaccccatgccattgccgctgcacggactgcccatacaacttgagcacaaggtatcgccatgtgtcatgtga

SEQ ID NO: 4451 - protein, 483 aa, Sorghum bicolor
  misc_feature (1)..(483): useful for making plants with increased salt and oxidative stress resistance as described in USSN 12/922,143
  misc_feature (1)..(483): Ceres Annot ID no. 8722834
  misc_feature (1)..(483): Bit score of 304.4 for hmm based on sequences of FIGURE 7.
  misc_feature (36)..(476): Pfam Name: p450 Pfam Description: Cytochrome P450
  misc_feature (1)..(483): Functional Homolog Of SEQ ID NO. 441
MDSSLILALILAVALALLLHLLTSANNKPRRAKQVPPGSLGLPVIGQSLSLLRAMRANSGERWIQDRIHRYGPVSKLSLFGAPTVLLAGPAANKFTFFSRALAMQQPRSVQRILGEKSILELVGADHKRIRGALAEFLKPDMLRLYVGKIDGEVRRHLDERWAGRTTVTVMPLMKRLTFDIISLLLFGLQRGAPLQDALAADFARVMDGIWAVPVNLPFTAFSRSLRASARARRLIAGILRETRAKLETGEASRSSDLIACLLSLTDHHSGAPLLSDKEIVDNSVVALVAGHDTSSILMTFMVRQLANDPDTLAAMVQEHDDIAKSKGDGEALDWEDLAKMKYTWRVALETLRLVPPMFGDFRRALQDVEFDGYLIPKGWQVFWVASVTHMDPGIFPEPARFEPSRFENQSPPCSFVAFGGGPRICVGMEFARIETLVTMHYLVRRFRWKLCCKKDTYARDPMPLPLHGLPIQLEHKVSPCVM

SEQ ID NO: 4452 - DNA, 1446 bp, Sorghum bicolor
  misc_feature (1)..(1446): useful for making plants with increased salt and oxidative stress resistance as described in USSN 12/922,143
  misc_feature (1)..(1446): Ceres Annot ID no. 8655960
atggattcctcctctcttgtcctagcgctcatcgccgtcgccttgcccgtcctcctccatctcctaacgaggccaaacaagccacggcggccggccgcggccaagctactacccccgggctcgctgggcctgccggtgatcggccagagcctgagccttctccgcgccatgcgcgccaacaccgccgagcggtggatccaggaccggatccaccggtacggcccggtgtccaagctgtcgctgttcggcgcgccgacggtgctcctcacggggcccgccgccaacaagttcatcttcttcagcagcgccctggcgctgcagcagccccggtcagtgcagaggatcctcggggacgagagcatcctggacctgatgggcgccgaccacaagcgggtccgcggcgcgctggccgagttcctcaagccggacatgctgaggctgtacgtgggcaagatcgacggcgaggtgcggcgccacctcgacgagcgctgggccggccagcgcgccgtcacggtgatgccgctcatgaagaggctcacgttcgacatcatctccctgctgctcttcggcctggagcggagcccgctccaggacgcgctcgccgccgacttcgcgggcgtcatggatggcatgtgggccgtcccggtgaacctgccgttcacggcgttcagccggagcttcagggccagcgccagagctcgccggctcatcgccgggatcgcgcgggagaccagggccaagctgcacagcggcgaggcctcccggagcagcgacctcatcgcgtgcctgctcagtctgaccgaccacaccggcgcgccgctgctgagcgacaaggagatcgtggacaactccatggtggccctcatcgccggccacgacacgtcgtccatcctcatgaccttcatggtccgccacctcgccaacgacccggacaccctcgccgccatggtccaagagcacgaggagatcgcaaagagcaagggcgacggcgaggccctggactgggaggacctggcgaagatgaagtacacgtggcgcgtcgcgctggagacccttcgcctggtgccccccatcttcggcaacttccggcgagcgacacaggacgtcgagttcgacggctacctcatcccaaaaggatggcaggtgttctgggcggcgagcgtgacgcacatggacacgggcatcttccacgagccggccaagttcgacccgtctcggttcgagaaccagtcggcgccaccgtgctcgttcgtcgcgttcggcgggggtccgaggatctgcgtcggcatggagttcgccaggatcgagacgctggtgacgatgcattacctcgtcaggggatttaggtggaagctctgcagcaagaacgacacctttgccagggaccccatgccgtcgccgctgcacggcctgcccatagagctcgagcagaagggatcgccgtga

SEQ ID NO: 4453 - protein, 481 aa, Sorghum bicolor
  misc_feature (1)..(481): useful for making plants with increased salt and oxidative stress resistance as described in USSN 12/922,143
  misc_feature (1)..(481): Ceres Annot ID no. 8655960
  misc_feature (1)..(481): Bit score of 291.8 for hmm based on sequences of FIGURE 7.
  misc_feature (38)..(477): Pfam Name: p450 Pfam Description: Cytochrome P450
  misc_feature (1)..(481): Functional Homolog Of SEQ ID NO. 441
MDSSSLVLALIAVALPVLLHLLTRPNKPRRPAAAKLLPPGSLGLPVIGQSLSLLRAMRANTAERWIQDRIHRYGPVSKLSLFGAPTVLLTGPAANKFIFFSSALALQQPRSVQRILGDESILDLMGADHKRVRGALAEFLKPDMLRLYVGKIDGEVRRHLDERWAGQRAVTVMPLMKRLTFDIISLLLFGLERSPLQDALAADFAGVMDGMWAVPVNLPFTAFSRSFRASARARRLIAGIARETRAKLHSGEASRSSDLIACLLSLTDHTGAPLLSDKEIVDNSMVALIAGHDTSSILMTFMVRHLANDPDTLAAMVQEHEEIAKSKGDGEALDWEDLAKMKYTWRVALETLRLVPPIFGNFRRATQDVEFDGYLIPKGWQVFWAASVTHMDTGIFHEPAKFDPSRFENQSAPPCSFVAFGGGPRICVGMEFARIETLVTMHYLVRGFRWKLCSKNDTFARDPMPSPLHGLPIELEQKGSP

SEQ ID NO: 4454 - DNA, 1518 bp, Sorghum bicolor
  misc_feature (1)..(1518): useful for making plants with increased salt and oxidative stress resistance as described in USSN 12/922,143
  misc_feature (1)..(1518): Ceres Annot ID no. 8734549
atgctcggcgaggaggcggcgctgctgtcgtgggccgcggcgctgctgctgggcgccgccgcgttggtgctcgtggacgcggcggcgcggtgggcgcacgggtggtacagggaggcgcctctgggcgcggcgcggcgggcgcggctgccgccgggggagatggggtggcccgtcgtcggcggcatgtgggcgttcctccgcgccttcaagtccggcaagcccgacgccttcatcgcctccttcgtccgacggttcgggcgcacgggcgtgtaccgaggcttcatgttcagcagcccgacggtgctggtgacgacgccggaggcgtgcaagcaggttctgatggacgacgacgcgttcgtgacgggttggcccaaggcgacggtggcgctgatcggtcccaagtcgttcgtggcgatgccgtacgacgagcaccggcggctgcgcaagctcacggccgcgcccatcaacggcttcgacgcgctcaccgcgtacctgcccttcatcgaccgcaccgtgacgtcgtcgctgcgcgcgtgggccgacgagtcgtcttccggcgccggcgccgggacgggggtcgagttcctgacggagctccggcggatgacgttcaagatcatcgtgcagatcttcctgggcggcgcggacgagcccacgacgcgtgcgctggagcggagctacacggacctcaactacgggatgcgcgccatggccatcaacctgcccgggttcgcgtaccacagggcgctgcgcgcgcggcggcgcctcgtggccgtgctgcagggcgtgctggacgagcggcgcgccgcgaaggccaagggggtgtcgggtgccggcgtggacatgatggaccggctgatcgaggcggaggacgagcgcgggcggcggctggacgacgacgagattatcgacgtgctcatcatgtacctcaacgccgggcacgagtcgtcggggcacatcaccatgtgggccaccgtgttcctgcaggagaacccggacatcttcgcaaaggcaaaggcggagcaggaggcgatcatgaggagcatcccggcgtcgcagcaggggctcacgctcagggacttcaggaagatggagtacctctcacaggtgatcgacgagacgctgcggctcgtcaacatctccttcgtctccttccgtcaggccaccaaagacgtcttcgtgaacgggtacctgatccccaaggggtggaaggtgcagctgtggtaccggagcgtgcacatggacccacaggtgtaccctgaccccaccaagttcaacccgtcaagatgggagggccactcgccgagagccggcactttcctggcgttcgggctcggcgccaggctctgccccggcaacgacctcgccaagctcgagatctccgtcttcctccaccacttcctcctcggctacaggctggcgaggacgaaccctaggtgccgggtgaggtacctgccgcatccgaggccggtggacaattgcttggccaagatcaccagagtctccgaagaatactag

SEQ ID NO: 4455 - protein, 505 aa, Sorghum bicolor
  misc_feature (1)..(505): useful for making plants with increased salt and oxidative stress resistance as described in USSN 12/922,143
  misc_feature (1)..(505): Ceres Annot ID no. 8734549
  misc_feature (1)..(505): Bit score of 239.2 for hmm based on sequences of FIGURE 7.
  misc_feature (50)..(495): Pfam Name: p450 Pfam Description: Cytochrome P450
  misc_feature (1)..(505): Functional Homolog Of SEQ ID NO. 441
MLGEEAALLSWAAALLLGAAALVLVDAAARWAHGWYREAPLGAARRARLPPGEMGWPVVGGMWAFLRAFKSGKPDAFIASFVRRFGRTGVYRGFMFSSPTVLVTTPEACKQVLMDDDAFVTGWPKATVALIGPKSFVAMPYDEHRRLRKLTAAPINGFDALTAYLPFIDRTVTSSLRAWADESSSGAGAGTGVEFLTELRRMTFKIIVQIFLGGADEPTTRALERSYTDLNYGMRAMAINLPGFAYHRALRARRRLVAVLQGVLDERRAAKAKGVSGAGVDMMDRLIEAEDERGRRLDDDEIIDVLIMYLNAGHESSGHITMWATVFLQENPDIFAKAKAEQEAIMRSIPASQQGLTLRDFRKMEYLSQVIDETLRLVNISFVSFRQATKDVFVNGYLIPKGWKVQLWYRSVHMDPQVYPDPTKFNPSRWEGHSPRAGTFLAFGLGARLCPGNDLAKLEISVFLHHFLLGYRLARTNPRCRVRYLPHPRPVDNCLAKITRVSEEY

SEQ ID NO: 4456 - DNA, 1533 bp, Sorghum bicolor
  misc_feature (1)..(1533): useful for making plants with increased salt and oxidative stress resistance as described in USSN 12/922,143
  misc_feature (1)..(1533): Ceres Annot ID no. 8721897
atggcgagttcccgcggtggcatcgacgagattctaggaattagtttggccacaatccagaaacacaacgaaccaagaatatcaaacaaggtttacatggctgcaagaaaggaaaggcctttgtttaccgctggccaagcaaccagtgtcagaataacaagatctcaggctgctgcaaatcgtacaagatctgggctggctccttatgtaccactacccctgaaaactgagtataaacatgcagtgaaaggaaagatgaaaagggaagcttcaggtgaaaatgctgatgctggagcttcagctcctcagcctaaaaggcgcacagttctcaagaatgtaactaacataagctgtgctaaaacttccaaaaggtgcaatactgtgactgggctgaagaaggttggacagagcataaacaagcaatgcacaaacaagatccccaagcttctccctctggctgttggggggagctcacttgtcaatgattctagtagtgctgaagaaacacaaaaggtagaccttttggcacagaaagagaagcagattgttttgcttaagggggctcagccattacacaatactgaacagaacaaagccggcgcttgtaatgagacattcgttgagggaagaaatgccaggaatgtacttgaaactgctgccttaaaggctggagtctctaatggtttaaacattgtagacattgacaaaaataatggtgatccccaaatgtgtgttacctacgttgcagagatatatagaaatctaatggcctcagagcttataagaagacctaggtcaaattacatggagactttgcaacaggacatcacagctagcatgcgaggtgttctaattgattggcttgttgaggtttctgaggaatataagcttgtggcagatacactttaccttgcagtacatcttattgaccaatttctttctcagaactgtattcagacacggaaactacaacttcttgggataactagtatgctgattgcctcgaaatatgaagagtattctgctcctagtgctgaagaattttgtaacataacagatagtacatatgcaaaggctgaggttctggaattggaacaacatgtgcttaatgatgtgggctttcatttatctgttccaacaacaaacacatttctcaggagattcctcagagcagcacaggcttcttgtatagctcctttggtccctttgacttatctggcgaattatctcgctgagttgactttaatcagctacggtttcctgaaatttcttccatcagtggtggcagcatcttcagttttccttgcaaaatggacgcttgaccaatctgaccatccttggaaccctactcttgagcactacacctcttacaaaagctccaatcttagaagttgcgtgcgggctctacaggaactgcagcacaataccagcaattgcccccttaacgccatccgtgaaaagtatgggcagcaaaagttcgagtgtgttgccaacctgaggtcaccggagctgctgcagtcactcttcagttga

SEQ ID NO: 4457 - protein, 510 aa, Sorghum bicolor
  misc_feature (1)..(510): useful for making plants with increased salt and oxidative stress resistance as described in USSN 12/922,143
  misc_feature (1)..(510): Ceres Annot ID no. 8721897
  misc_feature (1)..(510): Bit score of 1076.6 for hmm based on sequences of FIGURE 9.
  misc_feature (250)..(377): Pfam Name: Cyclin_N Pfam Description: Cyclin, N-terminal domain
  misc_feature (379)..(506): Pfam Name: Cyclin_C Pfam Description: Cyclin, C-terminal domain
  misc_feature (1)..(510): Functional Homolog Of SEQ ID NO. 764
MASSRGGIDEILGISLATIQKHNEPRISNKVYMAARKERPLFTAGQATSVRITRSQAAANRTRSGLAPYVPLPLKTEYKHAVKGKMKREASGENADAGASAPQPKRRTVLKNVTNISCAKTSKRCNTVTGLKKVGQSINKQCTNKIPKLLPLAVGGSSLVNDSSSAEETQKVDLLAQKEKQIVLLKGAQPLHNTEQNKAGACNETFVEGRNARNVLETAALKAGVSNGLNIVDIDKNNGDPQMCVTYVAEIYRNLMASELIRRPRSNYMETLQQDITASMRGVLIDWLVEVSEEYKLVADTLYLAVHLIDQFLSQNCIQTRKLQLLGITSMLIASKYEEYSAPSAEEFCNITDSTYAKAEVLELEQHVLNDVGFHLSVPTTNTFLRRFLRAAQASCIAPLVPLTYLANYLAELTLISYGFLKFLPSVVAASSVFLAKWTLDQSDHPWNPTLEHYTSYKSSNLRSCVRALQELQHNTSNCPLNAIREKYGQQKFECVANLRSPELLQSLFS

SEQ ID NO: 4458 - DNA, 2102 bp, Zea mays
  misc_feature (1)..(2102): useful for making plants with increased salt and oxidative stress resistance as described in USSN 12/922,143
  misc_feature (1)..(2102): Ceres Clone ID no. 1396170
  misc_feature (48)..(48): k is g or t/u
gtcccgaaaagggcaacgaaatccagacaccgctccccatctcccctkccttcctttcctactcccacactcgcccaccctccactagtactagtactagtaccacaaccaccccaccgggaaaaaacccaacaaggggtaggggcgccgccgccgccagcgccgccgtgcagatcgcggccggagctacggcgctggggcacgggggtccccggatcgaccacgcctccgccgagggttcggatggctatgcgaaaagaaaaccctgtgcttaatgcttgtcaagcatccaatgggcggatcacgcgagctcaagctgctgcaaatcgtcgaagctttggagctttcccttctggtccattgcctgcaaaaaccgaacgaaaacagactgcacaagggaaggcaaaacgaggttcttcatatgacaacaccagtgcaagcgttgcactttcaggcccccagcctaaaaggcgcacagtactcagggatgtgaccaatttgagcaatgctaactctaacaaaagttttgctgctgcaccgaagcttcagacaaagccctctctaaggactggaagaaccgtgagcaaaagcaagccgtgcgcaaaaaagattcctaaaaaaccaccaccagctggtaatggaagtgcattgactaatgttttgaacattgctgaagaaacacaagcggagaagattttggcagagagagtggaacccgttctgttgcttgagaacagggggccactgtcattgcagaatgttgaaaggaacagggacagtgcttgtcatgaggtattctttgaggaaagaaacctcagggataaatgtgaaccttctgtgtcaaagaatggggactcttatgtgttagacattgtagatatcgacaaagataatggcaatcctcaaatgtgtgcttcctacgttgtggagatatactcaaacctaatggcttcagagcttatgagaagaccaagtccaaattacatggagggtttgcaacgggacatcacaaagggcatgagagaaatactcattgattggcttgtggaggtttctgaagaatacaagcttgttccagacacgctgtacctaactgtatatcttattgaccggtttctttctcggaactacattgaaagacagagactacaacttgtgggaataacaagcatgcttgttgcctcgaaatatgaagagatatgtgctcctcgagtagaagagttctgtttcataaccgacaatacatacacaaaagcagaggtgctgaaaatggagagccagctgctgaatgacctgggatttaacctttctgttccaacaacaaaaacatttctcaggagattccttagagcggcacaagcatctcgtaaaactccttctatgactttaggatttctggccaattatctcgcggagttgactttgaccgaatatgagttcttgaaatttcttccgtcgttggtggcagcatcggccgtgtttctcgctagatggacgcttgaccaatccgaccttccatggaaccagactctagagcactacacctcttacaaatgctctgacattcaattgtgtgtctgtgctctacgggaactccagcataacaccagtaactgccctcttaacgccatccgcgagaagtacaggcatcaaaagtttgaatgcgtagcgaacctaacttcaccggagttccctgggtcgttcttcagctgacacgccaatggcaccgattgatgagcaacgttagcagcagccgtagcgcaggttgtgttaacattattgtagcatccccttttaccccccaatgtctgatttggctgtgtgttgttatcgagctgctgtgtcccggcctggcctttttggagtcgcaagtgagatgaagaaggacagagagatggctccttggcttttcttttgtttgtttgacgtaaaaggttcacccggttttaaacaacactgtgtgtagggctttttgcttgggctgttgttaactgtaaggggagatggtccggctggcttgtatgacgacaaacgacgggatgatgtttgtgttgacacaattcgttcattggtagcttcggtaatggaaattagtttattgc

SEQ ID NO: 4459 - protein, 489 aa, Zea mays
  misc_feature (1)..(489): useful for making plants with increased salt and oxidative stress resistance as described in USSN 12/922,143
  misc_feature (1)..(489): Ceres Clone ID no. 1396170
  misc_feature (1)..(489): Bit score of 1020.8 for hmm based on sequences of FIGURE 9.
  misc_feature (229)..(356): Pfam Name: Cyclin_N Pfam Description: Cyclin, N-terminal domain
  misc_feature (358)..(484): Pfam Name: Cyclin_C Pfam Description: Cyclin, C-terminal domain
  misc_feature (1)..(489): Functional Homolog Of SEQ ID NO. 764
MAMRKENPVLNACQASNGRITRAQAAANRRSFGAFPSGPLPAKTERKQTAQGKAKRGSSYDNTSASVALSGPQPKRRTVLRDVTNLSNANSNKSFAAAPKLQTKPSLRTGRTVSKSKPCAKKIPKKPPPAGNGSALTNVLNIAEETQAEKILAERVEPVLLLENRGPLSLQNVERNRDSACHEVFFEERNLRDKCEPSVSKNGDSYVLDIVDIDKDNGNPQMCASYVVEIYSNLMASELMRRPSPNYMEGLQRDITKGMREILIDWLVEVSEEYKLVPDTLYLTVYLIDRFLSRNYIERQRLQLVGITSMLVASKYEEICAPRVEEFCFITDNTYTKAEVLKMESQLLNDLGFNLSVPTTKTFLRRFLRAAQASRKTPSMTLGFLANYLAELTLTEYEFLKFLPSLVAASAVFLARWTLDQSDLPWNQTLEHYTSYKCSDIQLCVCALRELQHNTSNCPLNAIREKYRHQKFECVANLTSPEFPGSFFS

SEQ ID NO: 4460 - DNA, 1569 bp, Solanum lycopersicum
  misc_feature (1)..(1569): useful for making plants with increased salt and oxidative stress resistance as described in USSN 12/922,143
  misc_feature (1)..(1569): Ceres Annot ID no. 8460774
atggcaactggatcttctaatcttaaagtgcctactatgcgaatcacaagagcacgggcaaaaaccttgggttcatcaggaggactaccacctctacacccatctgtcagacaggataagaaacagggacttgtaacacaaggaacaaaatccaaaagaccagccccagatgagaacaaaccagctaattcttccagtactgcttctcaacagcctaagcgaagggctgttctcagggatgtcactaatgtgctttgtgaaaatccgtacatgaattgcatcaatggaagcaaatttcaggttaagaaattctctgataagaggaattcaaaggtgacacctgctcttttggtgaaaaagcctgagcttgaagatagaaaagagagtgtgattgaagaagcaaaaatggtaaaggttgaggaatcacaagaacactgttcacaagcacacttcaaggaccacccatttactcagccaagtgaatatatcaccgccgctcaaagtggtttagttgatcttatgcctgtgaataggagttcatgtaatgacattaccctccagactacaacaccaaaagatgaaagcaaggtttgcttgaaacaggaaggctccaattcgcttagtattgcagatatagattcaaaacacaaggatccactaatgtgtagtctgtatgctcctgatatatataacaatttgcaagccatggagcttgaccggcggccttcctttaattatatggaaaagcttcagcgggacattaacaagggtatgcgaagtattcttattgattggcttgtggaggtatctgaagaatataggctggttccggacactctttacctgactgtacatcttattgataggttcctttctgagcattacattgaaaaacaaaaactgcagctgcttggagttacctgcatgctaattgcttccaaatatgaagaaatttgtgcacctcgtgtggaagaattttgctttattacagacaacacttactcgaaagaagaggtagtaagaatggaaagtctggttctgaattttttgggctttcaacttgctgctccgaccaccaaaaagttcctgaggagattcgttcaagcatcacaagcttcttatgaggttccctctgttgaactggaattcatggcaaactatttagcagagttaacactagctgaatatagttttctcaagtttcttccatctgttactgctgcatcagctgtatttctagccagatggacacttgatcaatctaaccacccatggaattcaactttggagcactacactacatataaggcgtcagatctgaaaactacagttcttttgctgcaagatttacagatgaacaccagtggaagcactctgaatgccatccgtgaaaagtataaacaaccaaagcttccatttgaattgacagttcaagtccgtggcaactttatcgtctccaaaaccagtccaatcactgttctaggaaatgctgattttaagtctcggtggccaatccatgtttggcagatccagtgtcactttttcaagcgaaggaacattaatctttaa

SEQ ID NO: 4461 - protein, 522 aa, Solanum lycopersicum
  misc_feature (1)..(522): useful for making plants with increased salt and oxidative stress resistance as described in USSN 12/922,143
  misc_feature (1)..(522): Ceres Annot ID no. 8460774
  misc_feature (1)..(522): Bit score of 988.7 for hmm based on sequences of FIGURE 9.
  misc_feature (228)..(355): Pfam Name: Cyclin_N Pfam Description: Cyclin, N-terminal domain
  misc_feature (357)..(483): Pfam Name: Cyclin_C Pfam Description: Cyclin, C-terminal domain
  misc_feature (1)..(522): Functional Homolog Of SEQ ID NO. 764
MATGSSNLKVPTMRITRARAKTLGSSGGLPPLHPSVRQDKKQGLVTQGTKSKRPAPDENKPANSSSTASQQPKRRAVLRDVTNVLCENPYMNCINGSKFQVKKFSDKRNSKVTPALLVKKPELEDRKESVIEEAKMVKVEESQEHCSQAHFKDHPFTQPSEYITAAQSGLVDLMPVNRSSCNDITLQTTTPKDESKVCLKQEGSNSLSIADIDSKHKDPLMCSLYAPDIYNNLQAMELDRRPSFNYMEKLQRDINKGMRSILIDWLVEVSEEYRLVPDTLYLTVHLIDRFLSEHYIEKQKLQLLGVTCMLIASKYEEICAPRVEEFCFITDNTYSKEEVVRMESLVLNFLGFQLAAPTTKKFLRRFVQASQASYEVPSVELEFMANYLAELTLAEYSFLKFLPSVTAASAVFLARWTLDQSNHPWNSTLEHYTTYKASDLKTTVLLLQDLQMNTSGSTLNAIREKYKQPKLPFELTVQVRGNFIVSKTSPITVLGNADFKSRWPIHVWQIQCHFFKRRNINL

SEQ ID NO: 4462 - DNA, 1464 bp, Sorghum bicolor
  misc_feature (1)..(1464): useful for making plants with increased salt and oxidative stress resistance as described in USSN 12/922,143
  misc_feature (1)..(1464): Ceres Annot ID no. 8744641
atggatggaaggtgggagcgggaggagatggatgacacatgggctttgcgcgaggataaaaaggtttggatggctgcacggaaagaaaaccctgagcttattgcttgtcaagcacccaatggtcgaatcacgcgagctcaagccgctgcaaatcgtcgaagctttggtgttctcccttctgttccactgcctgcaaaaactgatcgaaaacagactacacaagggaagatgaaaaggggatcttcatatgacaacactagtgcaagtactgcaatttctggcccccagcctaagaggcgcacagttctcagggatgtgaccaatttgcgtaatgctaactctaacaaaacttttgctgctgcaccgaaggttcagacaaggccctccctaaggactggaagaaccgtgaccagaggcaagcagtgcacaaaaaggattcctaaaataccccaaccagctggtaatggtggttcattcgccaatgattcgagcattgccgaagaaacacaagagaaacttttggcacagaaagaagaacctattcttttgcttgagaacaggggctcactgtcattgcagaatgttgaaaggaacagggacagtgcttgtcatgaggcattctttaaggaaagaaatgtcagggatatatgtgaaccttctgtgtcaaagaatggggactcttctgtgttagacattgtagatatcgacaaagataatggcaatcctcaaatgtgtgcttcctacgttgtagagatatactcaaaccttatggtttcagagcttatgagaagacccagtccgaattacatggagggtttgcaacgggacatcactaagggcatgagaggaatactcattgattggcttgtggaggtttctgaagaatacaagcttgttccagacacgctgtacctaactgtatatgttattgaccgaaagtatgaagagatatgtgctcctcgagttgaagaattctgtttcataaccgacaatacatacacaaaggcagaggtgctgaaaatggagtgccaagtgctgaacgacctgggatttcatctttctgttccaactacaaaaacatttctcaggagattccttagagcggcacaagcatctcgtaaaattccttctatgactttgggatttctggccaattatcttgcggagttgactttgaccgattatgagttcttgaaatttcttccatcattggtggcagcatcggctgtgtttcttgctagatggacacttgaccaatccgacgaaccatggaaccaaactctagagcactacacctcttacaaatgctctgacattcaattatgtgtctgtgctctacgagaactccagcataacaccagtaactgtcctcttaacgccatccgtgagaagtacaaacatcaaaagtttgattgcgtagcaaacctaacctcaccggagctccctcggtcgctcttcagctga

SEQ ID NO: 4463 - protein, 487 aa, Sorghum bicolor
  misc_feature (1)..(487): useful for making plants with increased salt and oxidative stress resistance as described in USSN 12/922,143
  misc_feature (1)..(487): Ceres Annot ID no. 8744641
  misc_feature (1)..(487): Bit score of 931.3 for hmm based on sequences of FIGURE 9.
  misc_feature (356)..(483): Pfam Name: Cyclin_C Pfam Description: Cyclin, C-terminal domain
  misc_feature (251)..(354): Pfam Name: Cyclin_N Pfam Description: Cyclin, N-terminal domain
  misc_feature (1)..(487): Functional Homolog Of SEQ ID NO. 764
MDGRWEREEMDDTWALREDKKVWMAARKENPELIACQAPNGRITRAQAAANRRSFGVLPSVPLPAKTDRKQTTQGKMKRGSSYDNTSASTAISGPQPKRRTVLRDVTNLRNANSNKTFAAAPKVQTRPSLRTGRTVTRGKQCTKRIPKIPQPAGNGGSFANDSSIAEETQEKLLAQKEEPILLLENRGSLSLQNVERNRDSACHEAFFKERNVRDICEPSVSKNGDSSVLDIVDIDKDNGNPQMCASYVVEIYSNLMVSELMRRPSPNYMEGLQRDITKGMRGILIDWLVEVSEEYKLVPDTLYLTVYVIDRKYEEICAPRVEEFCFITDNTYTKAEVLKMECQVLNDLGFHLSVPTTKTFLRRFLRAAQASRKIPSMTLGFLANYLAELTLTDYEFLKFLPSLVAASAVFLARWTLDQSDEPWNQTLEHYTSYKCSDIQLCVCALRELQHNTSNCPLNAIREKYKHQKFDCVANLTSPELPRSLFS

SEQ ID NO: 4464 - protein, 486 aa, Physcomitrella patens subsp. patens
  misc_feature (1)..(486): useful for making plants with increased salt and oxidative stress resistance as described in USSN 12/922,143
  misc_feature (1)..(486): Public GI ID no. 168027686
  misc_feature (1)..(486): Bit score of 574.6 for hmm based on sequences of FIGURE 9.
  misc_feature (222)..(349): Pfam Name: Cyclin_N Pfam Description: Cyclin, N-terminal domain
  misc_feature (351)..(478): Pfam Name: Cyclin_C Pfam Description: Cyclin, C-terminal domain
  misc_feature (1)..(486): Functional Homolog Of SEQ ID NO. 764
MTGVVESARRLRSRSSSSLSVPTADEVRQTRAAAKRSVMEETSSRPGNSTVHPSKRVGAQPVRKRAALSNISNQHYVIPSGRPMVGLADVKSVDLKASQITRGDENLHSVNRAQPTVKGAHLEAALECEIERDSRSDSEAIASLERRTVQNLYISQEAKDRVKQGTIVREIMPLTLVISRHVGNLFSDKSFSVTPELPGIVAYQDIDNDHSDPQMCSTYATDIYSYLRMAEIKRRPSGNFMESMQQDINPTMRGILVDWLVEVAEEYKLVPDTLYLTVSYIDRYLSLHVVTRQRLQLLGVACMLIAAKYEEICAPQVEEFCYITDNTYCREEVLEMERAVLNVLKFELTTPTTKSFLRRFIRAAQASYKTPTLVLEFLGNYLAELTLLEYGFLPFLPSMIAASAVYLAKITLDSSTCPWDATLQHYTGYRPSELGHCVKAIHELQRNTDSCSLPAVREKYRQHKFKCVATLAPPAVLPEEYFLDRD

SEQ ID NO: 4465 - protein, 509 aa, Zea mays
  misc_feature (1)..(509): useful for making plants with increased salt and oxidative stress resistance as described in USSN 12/922,143
  misc_feature (1)..(509): Public GI ID no. 194707250
  misc_feature (1)..(509): Bit score of 472.7 for hmm based on sequences of FIGURE 9.
  misc_feature (244)..(371): Pfam Name: Cyclin_N Pfam Description: Cyclin, N-terminal domain
  misc_feature (373)..(500): Pfam Name: Cyclin_C Pfam Description: Cyclin, C-terminal domain
  misc_feature (1)..(509): Functional Homolog Of SEQ ID NO. 764
MSTIAASRRSSSSSSSATAKRPAIADGPGGPKATAAQAKKRVALGNITNVAARGGRASVGGSLGNVMAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMETIQKDVNPSMRAILIDWLVEVAEEYRLVPDTLYLTVNYIDRYLSGNEISRQRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPTEFFRDTTC

SEQ ID NO: 4466 - protein, 476 aa, Vitis vinifera
  misc_feature (1)..(476): useful for making plants with increased salt and oxidative stress resistance as described in USSN 12/922,143
  misc_feature (1)..(476): Public GI ID no. 157336075
  misc_feature (1)..(476): Bit score of 451.7 for hmm based on sequences of FIGURE 9.
  misc_feature (211)..(338): Pfam Name: Cyclin_N Pfam Description: Cyclin, N-terminal domain
  misc_feature (340)..(467): Pfam Name: Cyclin_C Pfam Description: Cyclin, C-terminal domain
  misc_feature (1)..(476): Functional Homolog Of SEQ ID NO. 764
MKRSSSDNHGKVTTVPSHLAKKRPPLSNITNQKNASLSGLKSSAAVGTMVPCAEKISKAKRGSSKISRSVGITGNTSSASLNVKPTAVIPCKDTSLPKSDGTASTVTALPDPCSLDVSPNRSDGISASMDETMSTCDSFKSPEVEYMDVDDLAVNSIERKTCSKLYISEHVEAEGNICSEDIHVETETNGKIADIDDNFGDPQFCATMACDIYKHLRASEARKRPSTDFMERIQKDVNASMRSILIDWLVEVAEEYRLVPDTLYLTVNFIDRYLSGNVMNRQQLQLLGVACMMIAAKYEEICAPQVEEFCYITDNTYFKEEVLQMESSVLNYLKFEMTAPTAKCFLRRFVRAAQGMNEVPSLQLECLANYIAELSLLEYSMLCYAPSLIAASAIFLANYILLPSKRPWNSTLRHYTLYQPSDLCDCVKALHRLCCNNHNSSLPAIREKYSQHKYKFVAKKYCPPSIPSELFHNLSN

SEQ ID NO: 4467 - protein, 502 aa, Zea mays
  misc_feature (1)..(502): useful for making plants with increased salt and oxidative stress resistance as described in USSN 12/922,143
  misc_feature (1)..(502): Public GI ID no. 194691894
  misc_feature (1)..(502): Bit score of 439.2 for hmm based on sequences of FIGURE 9.
  misc_feature (237)..(364): Pfam Name: Cyclin_N Pfam Description: Cyclin, N-terminal domain
  misc_feature (366)..(493): Pfam Name: Cyclin_C Pfam Description: Cyclin, C-terminal domain
  misc_feature (1)..(502): Functional Homolog Of SEQ ID NO. 764
MSTHAASRRSSSSSAVAKRPAIAEGATKAAGPGPTAAQAKKRTALVNITNVAAPGARVAAVGKVAPPVTGAKLNPATSGAPLKKPSLANARTIRGSAAKSASIKPAPPVSRHDSSSEQKHNVLVPTTVHVPSRAPALVPYSSFVSPGRSRDSVSTDETMSTCDSMKSPDFEYIDNGGCSMLASLQRRADEHLRTSEDRDVEENKWKKNGPAPMEIDSICEVDSNLEDPQLCAALASDIYMHLREAEMKKRPSTDFMKTIQKDVNPSMRAILIDWLVEVAEEYRLAPDTLYLTVNYIDRYLSGNEINRQRLQLLGVACMLIAAKYEEICAPQVEEFCYITDNTYFRDEVLEMEASVLNYLKFEMTAPTAKCFLRRFARSAQACDEDPALHLEFLANYIAELSLLEYSLLSYPPSLIAASAIFLARFVLQPTKYPWNSTLAHYTQYKPSELSECVKTLHRLSSVGPGSNLPAIREKYSQHKYKFVAKKQCPPQIPAEFFRDAAC

SEQ ID NO: 4468 - protein, 365 aa, Vitis vinifera
  misc_feature (1)..(365): useful for making plants with increased salt and oxidative stress resistance as described in USSN 12/922,143
  misc_feature (1)..(365): Public GI ID no. 157335598
  misc_feature (1)..(365): Bit score of 398.5 for hmm based on sequences of FIGURE 9.
  misc_feature (98)..(227): Pfam Name: Cyclin_N Pfam Description: Cyclin, N-terminal domain
  misc_feature (229)..(356): Pfam Name: Cyclin_C Pfam Description: Cyclin, C-terminal domain
  misc_feature (1)..(365): Functional Homolog Of SEQ ID NO. 764
MADQENSVRITRAAKKRAAAAMAASDSLQLPPNKKRVVLGELPNLSNVAATPAAVPASGAQKQKFRPKKKEKVKAAVVAPDVGAKSDDPQMCGPYATDIYEYLHSMEMEPKRRPLHDYIEKVQKDVSHNMRGILVDWLVEVAEEYKLASDTLYLTISYIDRFLSSKALNRQRLQLLGVSSMLIAAKYEEISPPHVEDFCYITDNTYTKEEVVKMEADILKSLNFEMGNPTIKTFLRRFTRIAQENYKTPNLQLEFLVYYLAELSLLDYGCVKFLPSMVAASVIFLSRFTLRPKTHPWCSSLQHHSGYKPSELKECVLIIHDLQLSRRGGSLVAVREKYKQHKFKCVATLSSPSVIPVSYFEDIKE

SEQ ID NO: 4469 - protein, 357 aa, Zea mays
  misc_feature (1)..(357): useful for making plants with increased salt and oxidative stress resistance as described in USSN 12/922,143
  misc_feature (1)..(357): Public GI ID no. 194696044
  misc_feature (1)..(357): Bit score of 232.8 for hmm based on sequences of FIGURE 9.
  misc_feature (89)..(218): Pfam Name: Cyclin_N Pfam Description: Cyclin, N-terminal domain
  misc_feature (220)..(348): Pfam Name: Cyclin_C Pfam Description: Cyclin, C-terminal domain
  misc_feature (1)..(357): Functional Homolog Of SEQ ID NO. 764
MADMQNYAAPPLLTHATAKRKRVALNQLPTLPNAVLGAHDEGGGGDDKPVKKQHLLPAAKPEPNAAPAPAAAASDVEEDPQLRKPYASDIYSYLRSTESQATRRPATDYIAAVQVDVTPNTRAILVDWLVDVSEEYRFVSDTLYLTVSYIDRFLSANALNRQKLQLLGVAAMLIASKHEEISPLNVEDFCYITDNTYTKQEVVKMESDILNVLKFEMGNPTPKTFLRMFTRFSKEDTKKYRSLQLEFLGSYLCELSLLDYSLLRFLPSLVAASVLFVARLTLDPHTHPWSKKMQTLTGYKPFELKDCVAAIHHLQLNRKYSSMMATRDKFKERRFKGVSALLPPVEIPASYFEKLKE

SEQ ID NO: 4470 - DNA, 1427 bp, Zea mays
  misc_feature (1)..(1427): useful for making plants with increased salt and oxidative stress resistance as described in USSN 12/922,143
  misc_feature (1)..(1427): Ceres Clone ID no. 333936
cctccgcttctcttccgtggtctggcgtctatccacctgctcctgcggtcctgcccccgctgctgcctgctgccgtgcagggacagccggagcaggagcaacgccgcccgccttcaccgtcgtcgcccatggccgacatgcaaaactacgccgccccgccgctcctcacccacgctaccgccaagcgcaagcgtgtcaccctcaaccagctgcccacgctccccaacgccgtgctcggcgcgcacgacgaaggcggcggcggcgatgacaagcccgtcaagaagcagcacctcctccccgccgccaagcccgagcccaatgcagctcccgcgcctgccgccgccgcctctgatgtcgaggaggacccgcagctccgcaagccctacgcgtccgacatctactcctacctccgctccacggagtcgcaggccacgcgccgccccgccacggattacatcgcggcggtgcaggtcgacgtcacgcccaacacgcgggccatcctcgtcgactggctcgtcgatgtctccgaggagtacagattcgtctccgacacgctctacctcaccgtctcctacatcgaccgcttcctctccgccaacgcactcaacaggcagaagctgcagctcctcggcgtcgccgccatgctcatcgcatccaagcacgaggagatcagcccgctcaatgtggaggatttctgctacatcaccgataacacctacaccaagcaggaggtagttaagatggagagcgatatactgaatgtcctcaagtttgagatgggaaatcctactccaaaaatgttcctgaggatgttcaccagatttagcaaagaagacaccaagaagtatcgtagcctccagctggagttcctgggtagctacctttgtgagctcagcttgctagactacagcttgcttcgcttcttgccgtcacttgttgcagcctcggtgctgtttgttgcaaggctgacccttgatccacacacccatccctggagcaagaagatgcagacactaactggctacaagccatctgagttgaaggactgtgttgctgccatacatcatttgcagctcaaccggaaatattcatccatgatggcgacccgggataaattcaaggaacgcaggtttaagggtgtatcagctttgctaccacctgttgagatcccagcgccatacttcgagaaactgaaggagtagttgttcctggacaatctagtaagccaaacacacagggctaaggttgttaaggtcctgaggttcttcgatgctgcatctaggctcgagtaggtgcattcagagttgatttgtttgaagttcaagctcaatagaaggctaggcgtgtcaaattttgtacttgtgaatcataactgtacattaaaaccaggttcctttatttgttgggggcacaactccaaaactttc

SEQ ID NO: 4471 - protein, 357 aa, Zea mays
  misc_feature (1)..(357): useful for making plants with increased salt and oxidative stress resistance as described in USSN 12/922,143
  misc_feature (1)..(357): Ceres Clone ID no. 333936
  misc_feature (1)..(357): Bit score of 219.7 for hmm based on sequences of FIGURE 9.
  misc_feature (89)..(218): Pfam Name: Cyclin_N Pfam Description: Cyclin, N-terminal domain
  misc_feature (220)..(348): Pfam Name: Cyclin_C Pfam Description: Cyclin, C-terminal domain
  misc_feature (1)..(357): Functional Homolog Of SEQ ID NO. 764
MADMQNYAAPPLLTHATAKRKRVTLNQLPTLPNAVLGAHDEGGGGDDKPVKKQHLLPAAKPEPNAAPAPAAAASDVEEDPQLRKPYASDIYSYLRSTESQATRRPATDYIAAVQVDVTPNTRAILVDWLVDVSEEYRFVSDTLYLTVSYIDRFLSANALNRQKLQLLGVAAMLIASKHEEISPLNVEDFCYITDNTYTKQEVVKMESDILNVLKFEMGNPTPKMFLRMFTRFSKEDTKKYRSLQLEFLGSYLCELSLLDYSLLRFLPSLVAASVLFVARLTLDPHTHPWSKKMQTLTGYKPSELKDCVAAIHHLQLNRKYSSMMATRDKFKERRFKGVSALLPPVEIPAPYFEKLKE

SEQ ID NO: 4472 - protein, 329 aa, Vitis vinifera
  misc_feature (1)..(329): useful for making plants with increased salt and oxidative stress resistance as described in USSN 12/922,143
  misc_feature (1)..(329): Public GI ID no. 157334844
  misc_feature (1)..(329): Bit score of 186.0 for hmm based on sequences of FIGURE 9.
  misc_feature (69)..(198): Pfam Name: Cyclin_N Pfam Description: Cyclin, N-terminal domain
  misc_feature (200)..(321): Pfam Name: Cyclin_C Pfam Description: Cyclin, C-terminal domain
  misc_feature (1)..(329): Functional Homolog Of SEQ ID NO. 764
MAEQDNCVHTPGAFRKRASDECPQSTTTKKRVVLEDITNSPNNELIQNSDRESQKPKRGIRRTGGCSSIMYQHLHALEMEEKRRARPDYMEKVQNDVTPNMREILVDWLVEVAEEYKLVSDTLFLCISYIDRFLSSHALRRDKLQLLGVSCMLIASKFEEISPPHAEDFCYITDNHYTAEEVVNMERDVLKFLNFEKVAPTTKNTLNVFPLLSMARLLFFEALSWYLAELSLLDYGCLQFLPSMIAASSIFLARFTLEPNKHPWSLALQRYSGYKPSELKECVLLIHSRQLNRRGNSSLRAIRQKYLQPMVSLPQFISNIHVDIANSAS

SEQ ID NO: 4473 - protein, 421 aa, Chlamydomonas reinhardtii
  misc_feature (1)..(421): useful for making plants with increased salt and oxidative stress resistance as described in USSN 12/922,143
  misc_feature (1)..(421): Public GI ID no. 159470039
  misc_feature (1)..(421): Bit score of 199.6 for hmm based on sequences of FIGURE 9.
  misc_feature (146)..(272): Pfam Name: Cyclin_N Pfam Description: Cyclin, N-terminal domain
  misc_feature (274)..(398): Pfam Name: Cyclin_C Pfam Description: Cyclin, C-terminal domain
  misc_feature (1)..(421): Functional Homolog Of SEQ ID NO. 764
MSSRVGSSFGVLPSAINYSQEQLLSHLSKSSASQQHQDVSKGVSSNGRAMLGDLTNNGQQRPVAGERKALSALNAGQASFGFPQPVKAQQQPSFHQPSIPLAAFSDPRIIDGASVRSSGDLRKKAWIDVDSLNHEDPQAVSHYAGAIFEYLREAELMRRAIPDYLDSQPEINSKMRSILVDWLVEVSEEYRMVPDTLYYAVNFLDRVLTLQRVSRSQLQLVGITCMWIAAKYEEIYPPNVSEFSYITDNTYSREQLVAMEEEVLRQLKYELTVPTAKTFLRRLLQVCSPDDQLHFVSNYLTEISLMEATMLHFLPSEIAAAAVYLGNLILARAPWSPTLEHYSYYTPAQIAECVEALATLHIQVNSRAQGGELTALYDKYSHSKFLSVSRVSPLPLPVVNQHLSMIMGGSSASGASGIHRS

SEQ ID NO: 4474 - protein, 68 aa, Populus balsamifera subsp. trichocarpa
  misc_feature (1)..(68): useful for making plants with increased salt and oxidative stress resistance as described in USSN 12/922,143
  misc_feature (1)..(68): Public GI ID no. 118484464
  misc_feature (1)..(68): Bit score of 133.6 for hmm based on sequences of FIGURE 12.
  misc_feature (1)..(68): Functional Homolog Of SEQ ID NO. 200
MGMVVVISLPLIIFCLLLGFGCYYLGRYKGRQDVRTNAQVFGVPIPPPGTASKPPPPPHSKPGNLENV

SEQ ID NO: 4475 - DNA, 632 bp, Zea mays
  misc_feature (1)..(632): useful for making plants with increased salt and oxidative stress resistance as described in USSN 12/922,143
  misc_feature (1)..(632): Ceres Clone ID no. 1614244
tctctgcttggattttagcgagcggcaacgacgagcgacccaatggggttcgagctggtggtctctctgcccttcatcttcctctccatcatcctcggcttcggctgctacttcctcggcaagcacaggggccgggaggagatgcggaccggcgtcggcgcgcagatctacggcacgccgctgccgccgcccggcgtcgtcggagcctcctcgccgccgcctgagccgttccacagcaagaaacaatggtccgaggcagtgtgactgagattcagacgtctctccatccaaccattctactaatactacttatatgtcttggtggtgatgttggatttatattctttcttctttaatttcgccctggctgtcttgagagtgtagattgagagtcaaatatgtgcttgtgtggatgttgagatacgattgcaatcacactttatatcttctgtaatcaagcaaaaaccaatgcgttgcagtagaatggcttgtgtgtgtgactcctgcaggctgtatatgtgtttgaagattgcaactgagcatctccacaagatcttttatacaaaaaaaagtgtggtcccgcagggcgcaccattcacccgtcttccgccgagacaccctgcacggatcgc

SEQ ID NO: 4476 - protein, 73 aa, Zea mays
  misc_feature (1)..(73): useful for making plants with increased salt and oxidative stress resistance as described in USSN 12/922,143
  misc_feature (1)..(73): Ceres Clone ID no. 1614244
  misc_feature (1)..(73): Bit score of 162.5 for hmm based on sequences of FIGURE 12.
  misc_feature (1)..(73): Functional Homolog Of SEQ ID NO. 200
MGFELVVSLPFIFLSIILGFGCYFLGKHRGREEMRTGVGAQIYGTPLPPPGVVGASSPPPEPFHSKKQWSEAV

SEQ ID NO: 4477 - protein, 271 aa, Populus balsamifera subsp. trichocarpa
  misc_feature (1)..(271): useful for making plants with increased salt and oxidative stress resistance as described in USSN 12/922,143
  misc_feature (1)..(271): Public GI ID no. 118482768
  misc_feature (1)..(271): Bit score of 600.1 for hmm based on sequences of FIGURE 15.
  misc_feature (1)..(271): Functional Homolog Of SEQ ID NO. 892
MGSDSNAVPSASASASTSTSTSTPSTPNGKRSRDPEDEVYLDNLHSHKRYLSEIMASSLNGLTVGDPLQDNLMESPARSDTMFFARDEMSLQYSPMSEDFDDSRFCETPINACSPQSESLPGSPVSPYRYQRPLCGFSSAPYSSSFSSHGCSVTSSQPRQRGSDSEGRFPSSPSDICHSADLRRAALLRSVQMRTQPTGSSSFELPFSSGHEPGSNMEAEERPCSYMKSLVEEREYPLEECSSMSISEPEFNEEKACRVLNMNIKGDDSGG

SEQ ID NO: 4478 - protein, 292 aa, Zea mays
  misc_feature (1)..(292): useful for making plants with increased salt and oxidative stress resistance as described in USSN 12/922,143
  misc_feature (1)..(292): Public GI ID no. 194698116
  misc_feature (1)..(292): Bit score of 718.1 for hmm based on sequences of FIGURE 15.
  misc_feature (1)..(292): Functional Homolog Of SEQ ID NO. 892
MAGGSGEAAMSPPSSSASGKRGRDPEEDVYVDNLHSHKRYLSEIMASSLNGLSVGDSLPDNIMESPARSETASCYRDEILSQYSPMSEDSDDYRCYDTQLNPSGNHPDAMISPSTSPMSSPHRHQRPQSSLLPSNPYPLPSCSLSSVVCSHARRGSDNEGRFPSSPNDMCHVADLRRTALLRSVQMRVQGPHSYDLSFGIRQGQDHAHEHEGEHDHEHEHLEDLEGTEGSSCNKSIVNEVTYNQRRDHDFGRSEHEIDYINNSTSDDCVSDLKFKQEDKSHSKFDIPMHKNS

SEQ ID NO: 4479 - protein, 257 aa, Vitis vinifera
  misc_feature (1)..(257): useful for making plants with increased salt and oxidative stress resistance as described in USSN 12/922,143
  misc_feature (1)..(257): Public GI ID no. 157350149
  misc_feature (1)..(257): Bit score of 529.9 for hmm based on sequences of FIGURE 15.
  misc_feature (1)..(257): Functional Homolog Of SEQ ID NO. 892
MGSESNSPSPSSSSSPSGKRSRDPEDEVYLDNLHSHKRYLSEIMASSLNGLTVGDPLHENLMESPARSETMFYLRDDMSLQYSPMSEDSDDNRYCEIPINISSSQTDSLPTSPVSPHRYQRPFSALSSSGTTACPSHGCTLAAVACAQPRQRGSDSEGRFPSSPSDICHSADLRRAALLRSVQMRAQPPGPSVFELPFSAGQEAVRNMETEERPCLVDERDYRIEECSSMGISEHEFNREKSCRVLNMNLKGEEPGD

SEQ ID NO: 4480 - DNA, 1556 bp, Glycine max
  misc_feature (1)..(1556): useful for making plants with increased salt and oxidative stress resistance as described in USSN 12/922,143
  misc_feature (1)..(1556): Ceres Clone ID no. 1611787
tctgaaaccagctctttctgatctctctccccctctctctaacaataaccctcgctgtcgctggttccaattcaccatgaccgtgatgatgcccgctcccattgatcagcaagaggacgaggacgtgctcgtgccggacgcggatttgcctgagaacaatcaccaacccatggaagttgtagctcaacctgaaaatgccaatactgtggagagtcagcccgttgaagatcctccgtcatctagatttacatggagaattgataacttttcaaggctgaatacaaagaagctctattcggaaatatttgttgttggtggctataaatggcgtgtgcttattttcccaaaaggaaacaatgtggactatttgtccatgtatttggatgttgctgattcagccagtttgccctatggttggagtagatatgcacagtttagcttggcagttgttaatcaaatgcataataagtattctgtgagaaaagacacacagcaccagtttaatgcacgtgaaagtgattggggtttcacatccttcatgcctcttggtgaattgtatgatcctagtagagggtatcttgtgcatgatactcttatagtcgaagctgaggttcttgttcgtaggattgttgattactggacttatgattcaaagaaggagactggctatgttgggcttaagaaccaaggagctacgtgttatatgaattctctactccaaaccttgtatcatattccttattttagaaaggctgtgtaccatatgccaacaactgagaatgatatgcccactggtagcatccctttggccttgcaaagtttattctacaagcttcaatacagtgacaccagtgttgcaacaaaggagctgacaaagtcttttggatgggatacatatgattctttcatgcagcatgatgttcaagaactaaatcgggttctttgtgaaaaacttgaagacaaaatgaagggaactgttgttgagggaaccatacaaaaattatttgaagggcaccatatgaattacatagaatgcatcaatgtagactacaaatcaactagaaaggagtcattttatgaccttcagcttgatgttaaaggttgtcgtgatgtttatgcttcctttgataagtatgtcgaagttgaaagtcttgagggggataacaaatatcatgctgaacagtatggtttgcaggatgctaagaaaggtgtcctatttattgattttcctcctgtccttcaactccagctaaaaagatttgaatatgattttatgcgggatactatggttaaggtacaaatttgatgatgagagggtgacaaaagaagataataaaagagcattagaggagcagtatggtggtgaggaagagttaccacagacaaatcccggattcaataacaccccatttaagttcaccaaatactcaaatgcttatatgctggtgtatatacgtgaaagtgacaaggacaaaatcatatgcaatgtggatgagaaagacattgcagcacatttaagggagaggttgaagaaagaacaagaagagaaagagcac

SEQ ID NO: 4481 - protein, 409 aa, Glycine max
  misc_feature (1)..(409): useful for making plants with increased salt and oxidative stress resistance as described in USSN 12/922,143
  misc_feature (1)..(409): Ceres Clone ID no. 1611787
  misc_feature (1)..(409): Bit score of 946.0 for hmm based on sequences of FIGURE 10.
  misc_feature (61)..(181): Pfam Name: MATH Pfam Description: MATH domain
  misc_feature (1)..(409): Functional Homolog Of SEQ ID NO. 389
MTVMMPAPIDQQEDEDVLVPDADLPENNHQPMEVVAQPENANTVESQPVEDPPSSRFTWRIDNFSRLNTKKLYSEIFVVGGYKWRVLIFPKGNNVDYLSMYLDVADSASLPYGWSRYAQFSLAVVNQMHNKYSVRKDTQHQFNARESDWGFTSFMPLGELYDPSRGYLVHDTLIVEAEVLVRRIVDYWTYDSKKETGYVGLKNQGATCYMNSLLQTLYHIPYFRKAVYHMPTTENDMPTGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCRDVYASFDKYVEVESLEGDNKYHAEQYGLQDAKKGVLFIDFPPVLQLQLKRFEYDFMRDTMVKVQI

SEQ ID NO: 4482 - DNA, 426 bp, Sorghum bicolor
  misc_feature (1)..(426): useful for making plants with increased salt and oxidative stress resistance as described in USSN 12/922,143
  misc_feature (1)..(426): Ceres Annot ID no. 8704649
atgccggttccccttgccccgtatccgactcctccggtgccattcacgccgcctaatggggcccaaagccagcttgtctgcaccgggtgccggaatctcctcatgtatccagctggtgcgacgtctgtctgctgtgccgtttgcagcaccgtcactgccgtgccggctccaggaactgagatggcacagttagtttgtggaggatgccacactctcctgatgtacatacgtggtgcgactagtgtacaatgttcttgctgccacaccgttaacctggctatggaagcaaatcaagttgcgcatgtaaactgcgggaactgccgtatgctgctcatgtaccagtatggagctaggtctgtgaaatgcgcagtctgcaattttgtgacatcagttggggtaagtattcatccatcaaactgcacttaa

SEQ ID NO: 4483 - protein, 141 aa, Sorghum bicolor
  misc_feature (1)..(141): useful for making plants with increased salt and oxidative stress resistance as described in USSN 12/922,143
  misc_feature (1)..(141): Ceres Annot ID no. 8704649
  misc_feature (1)..(141): Bit score of 372.6 for hmm based on sequences of FIGURE 14.
  misc_feature (27)..(51): Pfam Name: zf-LSD1 Pfam Description: LSD1 zinc finger
  misc_feature (1)..(141): Functional Homolog Of SEQ ID NO. 239
MPVPLAPYPTPPVPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGVSIHPSNCT

SEQ ID NO: 4484 - DNA, 786 bp, Sorghum bicolor
  misc_feature (1)..(786): useful for making plants with increased salt and oxidative stress resistance as described in USSN 12/922,143
  misc_feature (1)..(786): Ceres Annot ID no. 8633751
atggcatttcgtggcggcaaagaggcaaggccaaagagcgccatcgaatcgtctcgtctcgtcccctccctcccctcctcttcctcgcccaatcccagacaaatccaatccgaaatcatctcccccctcgcctcgcctcgccgaggaagagcagagagaagcgacgccgcgttccttcctcccgcgtcgagctcgatcttcccggagccaccgcgggaggcgcagacgttgggacagcctcgcgcgcgcgtcccacgtatgcagagccagatcgtgtgccatgcttgccggaccgttctactctacccgcgaggcgcgtccagcgtctgctgcgccgtttgccaggccatcaccaccgtgccgccaccaggactggagatggctcagcttatatgtggtggttgtcgaactttgctgatgtatactcgcagtgcagacaccgtaaggtgttcatgttgcaacacagtcaatcttgttagaccagtgaataatatagctcatgtgaactgcggccagtgccggacaactttgatgtatccgtatggcgcaccttcagtaaaatgtgccatatgcaattatgtcacgactaccggagtaaatactgtggcacccactccatctgcgaggccaacatcaaatgagtcttcatatattggctcatctacttctgctcctaaatctcaacctcagaatgtaactgttgttgttgagaaccctatgacagttgacgacaagggaaaacttgtcagcagcgttgtagttggagtcacagctgggaaagtgtga

SEQ ID NO: 4485 - protein, 261 aa, Sorghum bicolor
  misc_feature (1)..(261): useful for making plants with increased salt and oxidative stress resistance as described in USSN 12/922,143
  misc_feature (1)..(261): Ceres Annot ID no. 8633751
  misc_feature (1)..(261): Bit score of 197.3 for hmm based on sequences of FIGURE 14.
  misc_feature (93)..(117): Pfam Name: zf-LSD1 Pfam Description: LSD1 zinc finger
  misc_feature (1)..(261): Functional Homolog Of SEQ ID NO. 239
MAFRGGKEARPKSAIESSRLVPSLPSSSSPNPRQIQSEIISPLASPRRGRAERSDAAFLPPASSSIFPEPPREAQTLGQPRARVPRMQSQIVCHACRTVLLYPRGASSVCCAVCQAITTVPPPGLEMAQLICGGCRTLLMYTRSADTVRCSCCNTVNLVRPVNNIAHVNCGQCRTTLMYPYGAPSVKCAICNYVTTTGVNTVAPTPSARPTSNESSYIGSSTSAPKSQPQNVTVVVENPMTVDDKGKLVSSVVVGVTAGKV

SEQ ID NO: 4486 - DNA, 3261 bp, Sorghum bicolor
  misc_feature (1)..(3261): useful for making plants with increased salt and oxidative stress resistance as described in USSN 12/922,143
  misc_feature (1)..(3261): Ceres Annot ID no. 8668896
atggagattcagccacagcgggagcagccacagcaggaccacgatgaggagatgctggtcccgcatcaggatgccattgaggggccgcagcaggatgttgttgagggtccgcagccgatggaagaatctgcatccgctgttgagaaccaacttgtgccagatacctccacatccagatttacatggtgtattgaaaatttttctaggcgcaatgttagaaagcactactctgacgattttattgttgggggatacaaatggcgagtgcttgtcttccccaggggaaataatggtgaccacctttcaatgtatctggatgttgctgattcaaacttgctgcctcctggttggagtaggaatgcacaattcagccttgctgtggtaaaccaattagacagcaaagcatcattaagaaaagaagcgatacaccaattcaattcccgtgaaagtgattggggttttacatcttttatgcctttgttggatctgtatgattcaagtaaaggatatgttgtgaatgataaatgtatcatagaagctgaggttgctgtgcgtaaaacttttgatttctggaactatgactccaaaaggatgactggttatgttggcctgaagaatcaaggggctacctgttacatgaactctcttcttcagactttataccacattccctactttcgaaaggctgtatatcatatgcctactacagagaatgatacaccttcagggaacattccattggctttgcaaagtcttttttataaacttcagcattgtgataacagcgttgctacaaaagagctcaccaaatcttttggatgggatagctatgattcgttcatgcagcatgatgtccaagagttgaatagggtcctatgcgaaaagctggaaaacaagatgaagggaacccccgtggaaggagcaatacaaaaattgttcgagggtcaccatatgaattatatcgagtgcattaatgttgactcaaaatcgaccaggaaagagtcattctatgatctcgcacttgatgtcaaaggatgttctgatgtctatgcatcatttgataagtatgttgcacaggagaggttagaaggcgataataagtatcaatctgaggaacatggtctacaggatgccaagaaaggaatgctttttattgacttccctccagttttgcaacttcagttgaaacggtttgaatatgattttgtgcgggatacaatgctcaagataaatgaccgttatgagttcccacttcaattggatcttgatagagatgatggaaaatatctttctccagatgcggatagaagtgtgcgtaacctatatactcttcacagcgtgctggttcatagcggcggagttcatggaggacattactatgccttcattcgcccgaagctgtctgatcaatggtacaagtttgaggatgaacgagtgacgaaagaagacatgaagcgggcattggaggaacaatatggtggtgaagaagagcttcctcataccaatgggcttaaaaatgctcctatcagatttacgaagcattcaaatgcttacatgcttgtttacatccgagaaagtgacaaagagaaaatcatctgcgatttagatgatgaagatataccagaccaccttaaggttaggttaagaaaggaacaggaagagaaggaatgcaagaaaaaagagaaggctgaggctcatatgttcactgcattgaaggtggcccgagactctgatttcaaagagcaaattggaagacacatgcattttgatctcgtggactttgacaaagttaatagcttccgtgcacctaagaacatgtcaatcaacgatgtcaaggaggagctttcgaaagaatttggcatcccagtagaatcccaacgattttgggtgtgggcaaaacgacagaactttacctacagacccagtcggccattgaccttcctggaggaaacatctgctgagaatcaaggaattgcttctgggaagaccaaagaagatatattaattttcttcaagctctatgatcctgaaaaggaagacctaagatatgtaggaaatttttttgtgaaagcatcaggaaaaccatctgatatagtagaaaggctgaatgagatcgccggatttccgtctgatgaagatattgagctctatgaggaagtaaaatttgaaccagcggtgatgtgtgtaccaattgagagcaatatttcgttccgttcaagtcagattgacaatggtgatataatatgctaccaaaaacgctgtttgccagattcaatggatcgataccgatatccaagtgtcccttctttctttgaatatattcataatagacaggttgtctacttcagattgcttgataaaccaaaagaagaaggcttctctctggagctttcaaaacgctccacatatgatgatgttgttgagaaggttgctcggcaactacgtctggacgatccttctaaaatccggcttactcaacacaacctatcgtctcagcaacccaaacctcaccacatcaaatacaggagtcttaattatctttcagacatgctacataatcataatcagatgtgtaacattttatattatgacgtcctggatattccgttgcctgaactagaatctacgagatcactgaagatcacttttgaaaacgccacaaaccatgagatgtcgtttcacactatgcggttaccaaaaagtaacactcttcttgatttgattgaagacttaaagtcaaaggttgaactttcttgtaatgatgctgaatttcggttttttggagtccaccttcacaagatatgcaaggtgtatcaacctggagataagatagattcagttaacgaacccttgtatattgaagaggttcctgaggaagaaaaaaatgctgggcctcatgaccgtttggttcatgtctatcacttcgaagataatcgtcatgttcagtattttggagaacctttcttctttctaattcgtgatggtgaagctttgtcggatatcaaagtacggattcagaagagacttcaagttcctgatgagcagtttataaagtggaaatttgctcatgttacattcagtaggccagaatacctccaagattcagatattgtattgaaccgattccataaacagaaacctgtttatggagcttgggaacaacaccttggattggagcatacagccactaccccaagaaggtcgtactttggcagtcagaaccgccattcttttgagaggcctgtgaagatttacaactaa

SEQ ID NO: 4487 - protein, 1086 aa, Sorghum bicolor
  misc_feature (1)..(1086): useful for making plants with increased salt and oxidative stress resistance as described in USSN 12/922,143
  misc_feature (1)..(1086): Ceres Annot ID no. 8668896
  misc_feature (1)..(1086): Bit score of 951.5 for hmm based on sequences of FIGURE 10.
  misc_feature (64)..(184): Pfam Name: MATH Pfam Description: MATH domain
  misc_feature (1)..(1086): Functional Homolog Of SEQ ID NO. 389
MEIQPQREQPQQDHDEEMLVPHQDAIEGPQQDVVEGPQPMEESASAVENQLVPDTSTSRFTWCIENFSRRNVRKHYSDDFIVGGYKWRVLVFPRGNNGDHLSMYLDVADSNLLPPGWSRNAQFSLAVVNQLDSKASLRKEAIHQFNSRESDWGFTSFMPLLDLYDSSKGYVVNDKCIIEAEVAVRKTFDFWNYDSKRMTGYVGLKNQGATCYMNSLLQTLYHIPYFRKAVYHMPTTENDTPSGNIPLALQSLFYKLQHCDNSVATKELTKSFGWDSYDSFMQHDVQELNRVLCEKLENKMKGTPVEGAIQKLFEGHHMNYIECINVDSKSTRKESFYDLALDVKGCSDVYASFDKYVAQERLEGDNKYQSEEHGLQDAKKGMLFIDFPPVLQLQLKRFEYDFVRDTMLKINDRYEFPLQLDLDRDDGKYLSPDADRSVRNLYTLHSVLVHSGGVHGGHYYAFIRPKLSDQWYKFEDERVTKEDMKRALEEQYGGEEELPHTNGLKNAPIRFTKHSNAYMLVYIRESDKEKIICDLDDEDIPDHLKVRLRKEQEEKECKKKEKAEAHMFTALKVARDSDFKEQIGRHMHFDLVDFDKVNSFRAPKNMSINDVKEELSKEFGIPVESQRFWVWAKRQNFTYRPSRPLTFLEETSAENQGIASGKTKEDILIFFKLYDPEKEDLRYVGNFFVKASGKPSDIVERLNEIAGFPSDEDIELYEEVKFEPAVMCVPIESNISFRSSQIDNGDIICYQKRCLPDSMDRYRYPSVPSFFEYIHNRQVVYFRLLDKPKEEGFSLELSKRSTYDDVVEKVARQLRLDDPSKIRLTQHNLSSQQPKPHHIKYRSLNYLSDMLHNHNQMCNILYYDVLDIPLPELESTRSLKITFENATNHEMSFHTMRLPKSNTLLDLIEDLKSKVELSCNDAEFRFFGVHLHKICKVYQPGDKIDSVNEPLYIEEVPEEEKNAGPHDRLVHVYHFEDNRHVQYFGEPFFFLIRDGEALSDIKVRIQKRLQVPDEQFIKWKFAHVTFSRPEYLQDSDIVLNRFHKQKPVYGAWEQHLGLEHTATTPRRSYFGSQNRHSFERPVKIYN

SEQ ID NO: 4488 - protein, 278 aa, Vitis vinifera
  misc_feature (1)..(278): useful for making plants with increased salt and oxidative stress resistance as described in USSN 12/922,143
  misc_feature (1)..(278): Public GI ID no. 157357468
  misc_feature (1)..(278): Bit score of 167.7 for hmm based on sequences of FIGURE 10.
  misc_feature (32)..(162): Pfam Name: MATH Pfam Description: MATH domain
  misc_feature (1)..(278): Functional Homolog Of SEQ ID NO. 389
MRFSKFFIYFLKLESISRTLRSIQPAHYLFRVESMSVLLDTSIEKYESGSFEVGGYKWRLCLYPNGNKKSDGDGHISLYLVISDTQNLPLGWEVTVSFKLFVFNHIHEEYLTVQDTDGKVRHFNVMKTQCGFAQFLPLDVLTDPCNGYLMDDSCIFGAEVFVIKYSGKGECLSMIKEPDDGTFTWMIENFSRLKQEAIYSEIFTVKDFKWHLVVYPKGNYKAKNKSLSLFLELANRGTLHHQRKLYTEFELLVKEQCNGGHVKPSHVKLNGTLHILFC

SEQ ID NO: 4489 - protein, 475 aa, Vitis vinifera
  misc_feature (1)..(475): useful for making plants with increased salt and oxidative stress resistance as described in USSN 12/922,143
  misc_feature (1)..(475): Public GI ID no. 157337147
  misc_feature (1)..(475): Bit score of 1147.2 for hmm based on sequences of FIGURE 5.
  misc_feature (67)..(156): Pfam Name: PIGA Pfam Description: PIGA (GPI anchor biosynthesis)
  misc_feature (208)..(384): Pfam Name: Glycos_transf_1 Pfam Description: Glycosyl transferases group 1
  misc_feature (1)..(475): Functional Homolog Of SEQ ID NO. 138
MVSFHLKQNFISIAVVETPGVMGDQKRHKILMVSDFFYPNFGGVENHIYYLSQCLLKLGHKVVVLTHAYGNRSGVRYMTGGLKVYYIPWKPFLMQNTLPTFYGTLPIMRTILIREKISLVHGHQAFSTLCHEALMHARTMGYKVVFTDHSLYGFADVGSIHMNKVLQFTLADVSQAICVSHTSKENTVLRSGLPPEKVFVIPNAVDTAMFTPAPEKLSHNEIVIIVISRLVYRKGADLLVEVIPEICRLFSNVRFIVGGDGPKRVRLEEMREKNSLQDRVEMLGAVPHARVRSVLISGHIFLNSSLTEAFCIAILEAASCGLLTVSTRVGGVPEACIFRYFVLPDDMIVLAEPDPSDMVRAITKAISILPKIDPQVMHLRMKKLYNWHDVAKRTEIVYDRALGCSNQNLVDRLSRYLPCGGWAGKLFCLVMIIDFLLWRLLQLWQPPEEIEEVPDFSLPNSECPEFKEDGSLSLR

SEQ ID NO: 4490 - DNA, 1000 bp, Panicum virgatum
  misc_feature (1)..(1000): useful for making plants with increased salt and oxidative stress resistance as described in USSN 12/922,143
  misc_feature (1)..(1000): Ceres Clone ID no. 1781991
agccgcaccgcaagaagcgtcctcggggggcacgtccttgatcggtggcgcctgcctctcgccgccgctgctggtgcctctcccccaccacgccgcagatttttttttcttattttttcctcccgtcggttctcggaggtttctcgccgtctcctccccacgcggttcctgaggcatgcggagccagatcgtctgccacgggtgcaggagccttttactctacccgagaggtgctcccagcgtgtgctgcgcggtatgccacgcagtcaccaccgtgccacctccaggaatggagatggctcgacttatttgtggtggctgccaaacattattgatgtatactcgcaatgcaacaactgtaagatgctcatgttgtgacacagttaatcttgtcagaccagtgagtagcatagctcatgtgaactgtggccagtgccaaacagtgttgatgtatccatacggagcaccatctgtcaaatgtgctatctgcaactttattacaaacgttggtgggcatcaggtaccaaccgtgagacctttgccacctgcgctgcctgcatcaagtggaaattcatataacatcccgtcaacttctgcgccaacgagtcaatcacagaacataactgttgttgttgaaaatccaatgacagtagatgacaagggaaaattggtgagcaatgttgtagttggggttacaactggtgggaaaaagtaacatatcagaacccaatgtaactttgttaatgcttaatatctggagaagttgaaaataccttgtattatactgctgttcggtgattggttggtcgacaaaaggacccctgaagagcatcggggcaaagctcgcctttgcccctgcgatcatgccagaacgaatgaaaacgaagtgcgggtgtggatactcagaaactgtagcttgttacccttgattcttttgtatgtaatatgggctctgttagacttcactgtgtgatcaaactcctctcccgtgggtgcttgc

SEQ ID NO: 4491 - protein, 179 aa, Panicum virgatum
  misc_feature (1)..(179): useful for making plants with increased salt and oxidative stress resistance as described in USSN 12/922,143
  misc_feature (1)..(179): Ceres Clone ID no. 1781991
  misc_feature (1)..(179): Bit score of 179.2 for hmm based on sequences of FIGURE 14.
  misc_feature (7)..(31): Pfam Name: zf-LSD1 Pfam Description: LSD1 zinc finger
  misc_feature (1)..(179): Functional Homolog Of SEQ ID NO. 239
MRSQIVCHGCRSLLLYPRGAPSVCCAVCHAVTTVPPPGMEMARLICGGCQTLLMYTRNATTVRCSCCDTVNLVRPVSSIAHVNCGQCQTVLMYPYGAPSVKCAICNFITNVGGHQVPTVRPLPPALPASSGNSYNIPSTSAPTSQSQNITVVVENPMTVDDKGKLVSNVVVGVTTGGKK

SEQ ID NO: 4492 - protein, 1098 aa, Physcomitrella patens subsp. patens
  misc_feature (1)..(1098): useful for making plants with increased salt and oxidative stress resistance as described in USSN 12/922,143
  misc_feature (1)..(1098): Public GI ID no. 168032240
  misc_feature (1)..(1098): Bit score of 879.3 for hmm based on sequences of FIGURE 10.
  misc_feature (41)..(161): Pfam Name: MATH Pfam Description: MATH domain
  misc_feature (1)..(1098): Functional Homolog Of SEQ ID NO. 389
MVVPPQDLNDGIEPMEGHGESVATVENQPVDDHIGKFTWTLTNFGKLSVRKHYSDPFVVGGYKWRVLLFPRGNNVDQLSIYLDVADSNQLPSGWTRFAHFNLAVLNQYEPKMSVRKDTQHQFNARESDWGFTSFMPLHELYDLSKGFLVNDTLVIEADVNAPKMVDYWSHDSKKETGFVGLKNQGATCYMNSLLQTLYHIPYFRKAVYHMPTTENDAPSSSIPLALQSLFYKMQYSDTCVATKDLTKSFGWDTYESFMQHDVQELNRVLCEKLENKMKGTAVEGTIQNLFEGHHMNYIECINVDFKSTRKESYYDLQLDVKGCKNIYDSFDKYVEIEKMEGENKYQADQFGLQDAKKGVLFIDFPPVLQLQLKRFEYDYMRDSMVKVNDRYEFPLQLDLDKYDGKYLSPDADRSVRNLYSLHSVLVHSGGVQGGHYYAFIRPTLTNQWYKFDDEHVTKEETKRALEDQYGGEEELPAQNPAYNQPAFKFTKYSNAYMLVYIRDSDKDKVICNVDEKDIAEHLQIRLKKEQGEKERKRKDKAEAHLYTVLKVIARDEDLSNQIGKQQFFDLVDHDSVKSYRINQEVPFKQFKEDVAKEIGIPASCQRYWLWARRQNHTYRPNKPLTEQEEMETVGKLKDASNKTHNAELRLWLEVNYQEGIPAPVPERTKEDVLLFFKLYSPEREELRFVGRLFVKANGRPVDILEKLNQMAGFAANEEIRLYEEIKFDPTVMCEHIDKKSTFRGSQLENGDIICYQKARTKEEEAKFNYPDVPSFLEYVCNRQIVHFRRLEKPKEDEFCLELSKQHTYDDVVEKVAKKLGLEDPSKLRLTSHNCYSQQPKPQPIKYRGVERLSDMLGHYNQISDILYFETLDLPLPELQGLKTLKITFHNSKTEEVSTHNVRLPKQSTVGDVINELKTKVELSSPKAELRILEVFYHKIYKVFPLNEKIENINDQYWKLRAEEIPDEEKELGPQERVIHVYHFLRDAAQNQMQVENFGEPFFLKVKESETLASIKARIQNKLQIPDDEFSKYKFAFLSLGRPDYLRDDDVVASRFQKKDSYGAWEYYLGLEHIDSAPKRAHQTNQGRHSFEKPVKIYN

SEQ ID NO: 4493 - protein, 331 aa, Vitis vinifera
  misc_feature (1)..(331): useful for making plants with increased salt and oxidative stress resistance as described in USSN 12/922,143
  misc_feature (1)..(331): Public GI ID no. 157357464
  misc_feature (1)..(331): Bit score of 266.4 for hmm based on sequences of FIGURE 10.
  misc_feature (42)..(172): Pfam Name: MATH Pfam Description: MATH domain
  misc_feature (1)..(331): Functional Homolog Of SEQ ID NO. 389
MADEKPPVVAEKTLHPTSICNSTTSISRTLRSIKPAHYLFRVESVSVLLNTDIEKYESGSFKVGGYRWRLCLYPNGNKKSGGEDHISLYLEISDAQKLPVGWEVTVNFKLFVFNHIHEKYLTVQDADGKVRDFNVMKSRCGFAQFLSLDVLKDPCNGYLMDDSCIFGAEVFVIKYSGKGECLSMIKDPDDGTFTWVIENFSTLNEEVLYSETFTIKEIKWHLSLYPKGNGKVKNKSLCLFLELADCETLHHQRKLYMEFELLIKDQCNDENVEPSHVKSNAKVWFCDSNKEWGFADMVSLSDLNDKSKDFLLNDSLIVEAKILLMMHSKNI

SEQ ID NO: 4494 - protein, 142 aa, Bambusa oldhamii
  misc_feature (1)..(142): useful for making plants with increased salt and oxidative stress resistance as described in USSN 12/922,143
  misc_feature (1)..(142): Public GI ID no. 158516901
  misc_feature (1)..(142): Bit score of 366.7 for hmm based on sequences of FIGURE 14.
  misc_feature (26)..(50): Pfam Name: zf-LSD1 Pfam Description: LSD1 zinc finger
  misc_feature (1)..(142): Functional Homolog Of SEQ ID NO. 239
MPVPLAPHPTPVPFTPPNGAQSQLICSGCRNLLMYSAGATSVCCAVCSTMTAVPAPGTEMAQLVCGGCHTLLMYIRGATSVQCSCCHTVNLAMEANQVAHVNCGNCRILLMYQYGARSVKCAVCNFVTSVGAPPGADQKPSN

SEQ ID NO: 4495 - protein, 146 aa, Hordeum vulgare subsp. vulgare
  misc_feature (1)..(146): useful for making plants with increased salt and oxidative stress resistance as described in USSN 12/922,143
  misc_feature (1)..(146): Public GI ID no. 170780160
  misc_feature (1)..(146): Bit score of 395.0 for hmm based on sequences of FIGURE 14.
  misc_feature (30)..(54): Pfam Name: zf-LSD1 Pfam Description: LSD1 zinc finger
  misc_feature (1)..(146): Functional Homolog Of SEQ ID NO. 239
MPVPLAPYPTPPAPFTPPAPNAGAQSQLVCSGCRNLLMYPAGATSVCCAVCSTVTAVPAPGTEMAQLVCGGCHTLLMYIRGATSVQCSCCHTVNLAMEANQVAHVNCGSCRMLLMYQYGARSVKCAVCSFVTSVGASSGAEQKPSN

SEQ ID NO: 4496 - DNA, 624 bp, Miscanthus x giganteus
  misc_feature (1)..(624): useful for making plants with increased salt and oxidative stress resistance as described in USSN 12/922,143
  misc_feature (1)..(624): Ceres Clone ID no. 2055374
agagagagagggagggagggagacaggagagaggaagacagagagagatgcggtaacccaagaactgctcttgtgcatgaagcagccataagcattgctattagggtttcatgcagggcaaagcagctggtttctgccgcctgaacgccgccggaatctgcgaggccttcccgagcagcgtcatcgaataaggcagccggcacggcaatgccggttccccttgccccgtatccgactcctccggtgccattcacgccgcccaatggggggcaaagccagcttgtctgcaccggatgccggaatctcctcatgtatccagctggtgcgacgtcggtctgctgtgcagtttgcagcaccgtcacctccgtgccggctccaggaactgagatggcacagttagtttgcggaggatgccacactctcctgatgtacatacgtggtgctactagtgtacaatgttcttgctgccacactgttaacctggctatggaagcaaatcaagttgcgcatgtaaactgcgggaactgccgtatgctgctcatgtaccagtatggtgctaagtccgtgaaatgcgcagtctgcaattttgtgacatcagttggggcttcacctggtgcagagcag

SEQ ID NO: 4497 - protein, 139 aa, Miscanthus x giganteus
  misc_feature (1)..(139): useful for making plants with increased salt and oxidative stress resistance as described in USSN 12/922,143
  misc_feature (1)..(139): Ceres Clone ID no. 2055374
  misc_feature (1)..(139): Bit score of 370.1 for hmm based on sequences of FIGURE 14.
  misc_feature (27)..(51): Pfam Name: zf-LSD1 Pfam Description: LSD1 zinc finger
  misc_feature (1)..(139): Functional Homolog Of SEQ ID NO. 239
MPVPLAPYPTPPVPFTPPNGGQSQLVCTGCRNLLMYPAGATSVCCAVCSTVTSVPAPGTEMAQLVCGGCHTLLMYIRGATSVQCSCCHTVNLAMEANQVAHVNCGNCRMLLMYQYGAKSVKCAVCNFVTSVGASPGAEQ

SEQ ID NO: 4498 - DNA, 1227 bp, Solanum lycopersicum
  misc_feature (1)..(1227): useful for making plants with increased salt and oxidative stress resistance as described in USSN 12/922,143
  misc_feature (1)..(1227): Ceres Annot ID no. 8461848
atggctttcctcttccacaaatttcaagagggagtgaaaattcttgctaaaagccccacttttgctagagaatcgaggcttcttcagttcgaagctgacataaatctactattcctttacaccagccttacccttataccttgtgaaggtgaagggaatgttcccgatagaccctctgtcaattacaaccgtttaggaaggaatgccgaagaagctgatgcagaggagattattgatatggctaacaaagcctcattagacgatcaacagaagcaagttcatgagaatgtgcattctcaggttacaaacttttgcagctatatggatgacatattactcctggatcaaaaggtcaaagacaatcaggccacatcaccagcaacactacatttttctcctcgtagtagtggccttggtcttgctgttgatgggaattctctagcacaagaccgcattgccgtacctgaaaccaagacactgcaccgcacagaagtttcacagaggttaaaagatcttatgggctacactctcgaggtcaaaccatctcaaattcctcatgaggatgctggaaagggtttattcttacaaggtgaagccaatattggttctgtcatagcattctatcctggagtagtctaccctccagcatattaccgctatattcctgggtaccctagagttgatgcccaaaatccacatctgatcacacggtatgatgggactatgatcaatgctcagccctggggtgctggtggtgaatgtcgtgaattatgggattggaccagttctcctgaacctaagtgcactatgcaagctggtgaaaaaggttctgacctagatggaacagacgttggaggcaaccttgaagtgtttgagaggagaaaccctctagcctttgctcatttcgccaaccacccagccaaaggcatggtccccaatgtaatggtatacccttatgatttccccctgcttgaggaggacatgagaccctatatacctaatgtttcatttggaaacgatgaagaaacagagactagtaaatttggcagctttaggttcatcaaaatgtggaagtccaacaacaatgaatcaaaagtccccgttctgaagacacttcttcttgtggctactagggcaatttgtgatgaagaggttatgttgaactacagactgagcaattcagagcacataccgtcatggtatactccagtagatgaagaggactaa

SEQ ID NO: 4499 - protein, 408 aa, Solanum lycopersicum
  misc_feature (1)..(408): useful for making plants with increased salt and oxidative stress resistance as described in USSN 12/922,143
  misc_feature (1)..(408): Ceres Annot ID no. 8461848
  misc_feature (1)..(408): Bit score of 679.8 for hmm based on sequences of FIGURE 8.
  misc_feature (1)..(408): Functional Homolog Of SEQ ID NO. 172
MAFLFHKFQEGVKILAKSPTFARESRLLQFEADINLLFLYTSLTLIPCEGEGNVPDRPSVNYNRLGRNAEEADAEEIIDMANKASLDDQQKQVHENVHSQVTNFCSYMDDILLLDQKVKDNQATSPATLHFSPRSSGLGLAVDGNSLAQDRIAVPETKTLHRTEVSQRLKDLMGYTLEVKPSQIPHEDAGKGLFLQGEANIGSVIAFYPGVVYPPAYYRYIPGYPRVDAQNPHLITRYDGTMINAQPWGAGGECRELWDWTSSPEPKCTMQAGEKGSDLDGTDVGGNLEVFERRNPLAFAHFANHPAKGMVPNVMVYPYDFPLLEEDMRPYIPNVSFGNDEETETSKFGSFRFIKMWKSNNNESKVPVLKTLLLVATRAICDEEVMLNYRLSNSEHIPSWYTPVDEED

SEQ ID NO: 4500 - protein, 403 aa, Zea mays
  misc_feature (1)..(403): useful for making plants with increased salt and oxidative stress resistance as described in USSN 12/922,143
  misc_feature (1)..(403): Public GI ID no. 212723622
  misc_feature (1)..(403): Bit score of 973.9 for hmm based on sequences of FIGURE 8.
  misc_feature (1)..(403): Functional Homolog Of SEQ ID NO. 172
MAFLFNKFQEAIRTIAKSPMFARDPRHLQFEADVNRLFLYTSYYRLGENADEKDAEEIIDLASKASIADQQKQVQDNVHYELTHMCQAMDSILCPDTINDPSKGPSEAHNHSQRSGLSFAVGGAASANKQSAIIPATRPLTRAELSKKFRDHFGYTLDIGPSGIPHKDAGQGLFLSGQANAGAVLAIYPGVIYSPAYYRYIPGYPRIDVCNNYLITRYDGTIIDAKPWCFGGETRALWDGSDLVDYNAMAPKGSENNSDRVWRMLSKPLEKGVRENFGEVLERRNPLAFGHFANHPPKGSSPNVMICPYDFPLTEKDMRVYIPNITFGGQETIRMKRFGSFYFKSGGSDNQAGDSLVLKTLVLVSTRSICDEELFLNYRYSNSKRRPEWYSPVDEEEDKRRWS

SEQ ID NO: 4501 - protein, 1123 aa, Physcomitrella patens subsp. patens
  misc_feature (1)..(1123): useful for making plants with increased salt and oxidative stress resistance as described in USSN 12/922,143
  misc_feature (1)..(1123): Public GI ID no. 168035595
  misc_feature (1)..(1123): Bit score of 1002.3 for hmm based on sequences of FIGURE 10.
  misc_feature (57)..(177): Pfam Name: MATH Pfam Description: MATH domain
  misc_feature (1)..(1123): Functional Homolog Of SEQ ID NO. 389
MTVIAAPPEEDDDMLVPPQDFNDVIEPMEVVGQGEGVATVENQHVDDPQTGKFTWNIENFSKLSLRKHYSETFTVGGYKWRVLLFPKGNNVDHLSVYLDVADSAQLPYGWSRFAHFTLAVVNPYDPKLTVKKDTQHHFNVRESDWGFTSFMPLPDLYDPSRGFLMNDTLIVEADVNVRKVVDYWAYDSKKETGYVGLKNQGATCYMNSLLQTLYHLPYFRKAVYHMPTTENDVPSNSIPLALQSLFYKIQYSDTSIATKDLTKSFGWDTYDSFMQHDVQELNRVLCEKLEDKMKGTAVEGTIQQLFEGHHMNYIECINVDYKSTRKESFYDLQLDVKGCKDVYESFDKYVEVERLEGENKYHAEQFGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERVTKEEPKRALEEQYGGEEELPQTNPGFNNTPFKFTKYSNAYMLVYIREADKDKIVCNVDEKDIAEHLQVRLKKEQEEKERKRKEKAEAHLYTIIKASLHLIFLHLVGRDEDLQNQIGKDIHFDLVDHEKVRSFRIQKQTLFTQFKASKELGVPVECQRFWLWAKRQNHTYRPNRPLTEQEEAQTVGHLKEASNKAHNAELKLFLEVQRTPGAESVPMPPPIKTKEDVLLFFKLYDPLKEELRYVGRSYVKASGRPADILERLNEMAGFPPNEEIQLYEEIKFEPNVMCEHIEKKSTFKASQLEDGDIICYQRALTREQELASRYPDVPSFLEYVRNRQIVHFRRLDKPKDDEFCLELSKQHTYDDVVEKVAEEIKLEDASKIRLTSHNCYSQQPKPQPIKYRGVERLSDMLVHYNQTSDILYFETLDLPLPELQGLKTLKVAFHNAKTEEVSVHNIRLPKQSTVGDVVNELKGKVELSSPKAELRILEVFYHKIYKIFPLSEKIENINDQYWTLRAEEVPDEEKELGPQDRLIHVYHFTRDASQNYMVQNFGEPFFLVVRENETLTEVKQRIQKKLVISDEEFSKWKFAFLSLGRPEYLQDGDVVAARFQKRDTYGAWEHYLGLEHADCAPKRSHTTNQNRHNFEKPVKIYN

SEQ ID NO: 4502 - protein, 1115 aa, Physcomitrella patens subsp. patens
  misc_feature (1)..(1115): useful for making plants with increased salt and oxidative stress resistance as described in USSN 12/922,143
  misc_feature (1)..(1115): Public GI ID no. 168015828
  misc_feature (1)..(1115): Bit score of 1005.3 for hmm based on sequences of FIGURE 10.
  misc_feature (57)..(177): Pfam Name: MATH Pfam Description: MATH domain
  misc_feature (1)..(1115): Functional Homolog Of SEQ ID NO. 389
MTVIAAPPEEDDDMLVPPQDFNDVIEPMEVVGQGEGVVTVENQLVDDPQTGKFTWPIENLSKINLRKHYSETFTVGGYKWRVLLFPKGNNVDHLSIYLDVADSAQLPYGWSRFAHFTLAVVNQIDPKLTVKKDTQHQFNVRESDWGFTSFMPLHDLNDPSRGFVVNDTLIVEADVNVRKVVDYWAYDSKKETGFVGLKNQGATCYMNSLLQTLYHLPYFRKAVYHMPTTENDVPSNSIPLALQSLFYKIQYSDTSVATKDLTKSFGWDTYDSFMQHDVQELNRVLCEKLEDKMKGTAVEGTIQQLFEGHHMNYIECINVDYKSTRKESFYDLQLDVKGCKDVYESFDKYVEVERLEGENKYHAEQFGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERVTKEELKRALEEQYGGDEELPQTNPCFNNTPFKFTKYSNAYMLVYIREADKDKVVCNVDEKDIAEHLQIRLKKEQEEKERKRKEKAEAHLYTIIKVGRDEDLQNQIGKDIHFDLVDHEKVRSFRIQKQTPFTQFKEEIAKQLGVPVECQRFWLWAKRQNHTYRPNRPLTDQEEAQTVGHLKEASNKAHNAELKLFLEVQRLPGADSVPIPPPIKTKEDVLLFFKLYNPEKEELRYVGRSYVKASGRPADILERLNEMAGFPPNEEIQLYEEIKFEPNVMCEHIDKKSTFRASQLEDGDIICYQRALTRGEEDVCRYPDVPSFLEYVRNRQNVHFRRLEKPKDDEFCLELSKQHTYDDVVERVAEKIGLEDASKIRLTSHNCYSQQPKPQPIKYRGVERLSDMLVHYNQTSDILYFETLDLPLPELQGLKTLKVAFHNAKTEELSVHNIRLPKQSTVGDVVNELKGKVELSSPRAELRILEVFYHKIYKIFPLNEKIENINDQYWTLRAEEVPDEEKELGPQDRLIHVYHFTRDASQNHMVQNFGEPFFLVVRESETLVEVKGRIQKKLLISDEEFSKWKFAFLSLGRPEYLQDGDVVAARFQKRDTYGAWEHYLGLEHTDSAPKRSHTTNQNRHNFEKPVKIYN

SEQ ID NO: 4503 - DNA, 679 bp, Zea mays
  misc_feature (1)..(679): useful for making plants with increased salt and oxidative stress resistance as described in USSN 12/922,143
  misc_feature (1)..(679): Ceres Clone ID no. 328046
attagtagattccacaacgtacatcttagatagtttaattttgataatgggtccaatatatatcaccctatgcatcttcctagtacttgtcttacatggagatacaactttggcagaaacttgcaggcagtttgttaaatgggatccattctgctttagtgcaatgtgcaaggtggtggacttccggatcgtacttagtaccattccaaatttccggtgaaggcaagtaaatacagtggtggttgctaccgtttggtttgcatcctattccctgtcattgagtacttgatacctgttgggaatgaggggagtagcagcacgtccactttcactctcacaataacgctgcccagacgcaaccatgatttaattagaaacttattgtccaaggaagtttgtttttttatatagtcgtgcgcactggttaattcagttcaggtcgtatgtttatcttcccttgctagccgattaataatacttagtatgttattgtcatgatatatgtttatacactattgccccctcatttatgtaatcttgtaaggggatgttgctgaaattttatatatggacgtcggaagtgtagttcagtagcattccgggttgtttgtggaacccggggtgttacaaatttaactgaacacttcaaaatatcaaataataagtaaaagacgggatc

SEQ ID NO: 4504 - protein, 57 aa, Zea mays
  misc_feature (1)..(57): useful for making plants with increased salt and oxidative stress resistance as described in USSN 12/922,143
  misc_feature (1)..(57): Ceres Clone ID no. 328046
  misc_feature (1)..(57): Bit score of 66.9 for hmm based on sequences of FIGURE 1.
  misc_feature (1)..(57): Functional Homolog Of SEQ ID NO. 2
MGPIYITLCIFLVLVLHGDTTLAETCRQFVKWDPFCFSAMCKVVDFRIVLSTIPNFR

SEQ ID NO: 4505 - protein, 135 aa, Chlamydomonas reinhardtii
  misc_feature (1)..(135): useful for making plants with increased salt and oxidative stress resistance as described in USSN 12/922,143
  misc_feature (1)..(135): Public GI ID no. 159467152
  misc_feature (1)..(135): Bit score of 272.6 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPGKVVILLSGRYAGKKAVIVANKDDGSSVRPYGHATVVGLAKEPRKVIKKISQKKQARRSSIKTFVKTVNYQHIMPTRYTLDVDLKAVVAPEAIESAAKKTDARKECKKLLEEKFKSGKNRWFFSKLRF

SEQ ID NO: 4506 - protein, 135 aa, Picea sitchensis
  misc_feature (1)..(135): useful for making plants with increased salt and oxidative stress resistance as described in USSN 12/922,143
  misc_feature (1)..(135): Public GI ID no. 116783106
  misc_feature (1)..(135): Bit score of 308.2 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKQNKVVVLLQGRFAGRKAVIIKTFDDGTAGRAYGHCLVAGIAKYPKKVIRKDSAKKTAKKSRLKAFIKVVNYNHIMPTRYSLDVDLKNVVSFDKLETRDKKVAALKGVKASFEERFKAGKNRWFFTKLRF

SEQ ID NO: 4507 - protein, 135 aa, Populus balsamifera subsp. trichocarpa
  misc_feature (1)..(135): useful for making plants with increased salt and oxidative stress resistance as described in USSN 12/922,143
  misc_feature (1)..(135): Public GI ID no. 118483156
  misc_feature (1)..(135): Bit score of 329.9 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKTNKAVIILQGKYAGRKGVIVRSFDDGTRDRPYGHCLVAGIKKYPSKVIKKDSAKKTAKKSRVKCFIKLVNYQHLMPTRYTLDVDLKDVVTADYLSTKDKKITACKETKARFEERFKTGKNRWFFTKLRF

SEQ ID NO: 4508 - protein, 135 aa, Populus balsamifera subsp. trichocarpa
  misc_feature (1)..(135): useful for making plants with increased salt and oxidative stress resistance as described in USSN 12/922,143
  misc_feature (1)..(135): Public GI ID no. 118483485
  misc_feature (1)..(135): Bit score of 325.8 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLRPNKAVIVLQGRYAGRKAVIVKHFDDGTRDRPYGHCLVAGIKKYPSKVIKKDSAKKTAKKSRVKCFVKVVNYQHLMPTRYTLDVDLKDLVTPDCLATKDKKVVACKETKTRFGERFKTGKNRWFFTKLRF

SEQ ID NO: 4509 - DNA, 661 bp, Arabidopsis thaliana
  misc_feature (1)..(661): useful for making plants with increased salt and oxidative stress resistance as described in USSN 12/922,143
  misc_feature (1)..(661): Ceres Clone ID no. 42277
  misc_feature (79)..(79): y is t/u or c
aacttagggttcatagcagccagagaaagagagacaagtgagagggatctaccaaacgaagcaacaatggtgaagttcytgaagcagaacaaggccgtgatccttcttcaaggacgttacgccggaaagaaagccgtcatcatcaaatccttcgacgacggtaaccgtgatcgtccttacggacactgcctcgtcgccggactgaagaagtacccgagcaaagtcatccgcaaagactcagctaagaagacagctaagaaatctagggttaagtgtttcatcaagcttgttaattaccagcatctgatgcctactcgttacacactcgacgtggatctcaaggaagtggcgactcttgatgctcttcagagtaaggataagaaggttgctgctcttaaggaagctaaggctaagcttgaggagaggttcaagactggtaagaacagatggttctttaccaagctcaggttctgaagaaattttctatttcgtgaggaattcattttgagcttttttttatcgtgttttttagtttctagggttcatttcccatggtgaaaaatgtggatcctgttttggattgtggaagatgttttgttgaagtttggattatggatttgatcttttattttgattctctaatgcattcttatttactctc

SEQ ID NO: 4510 - protein, 135 aa, Arabidopsis thaliana
  misc_feature (1)..(135): useful for making plants with increased salt and oxidative stress resistance as described in USSN 12/922,143
  misc_feature (1)..(135): Ceres Clone ID no. 42277
  misc_feature (1)..(135): Bit score of 328.5 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
  misc_feature (5)..(5): Xaa is any aa, unknown or other
MVKFXKQNKAVILLQGRYAGKKAVIIKSFDDGNRDRPYGHCLVAGLKKYPSKVIRKDSAKKTAKKSRVKCFIKLVNYQHLMPTRYTLDVDLKEVATLDALQSKDKKVAALKEAKAKLEERFKTGKNRWFFTKLRF

SEQ ID NO: 4511 - DNA, 523 bp, Arabidopsis thaliana
  misc_feature (1)..(523): useful for making plants with increased salt and oxidative stress resistance as described in USSN 12/922,143
  misc_feature (1)..(523): Ceres Clone ID no. 93699
acttagggttcatagcagccagagagagagagacaagtgagagggatctaccaaacgaagcaacaatggtgaagttcttgaagcagaacaaggccgtgatccttcttcaaggacgttacgccggaaagaaagccgtcatcatcaaatccttcgacgacggtaaccgtgatcgtccttacggacactgcctcgtcgccggactgaagaagtacccgagcaaagtcatccgcaaagactcagctaagaagacagctaagaaatctagggttaagtgtttcatcaagcttgttaattaccagcatctgatgcctactcgttacacactcgacgtggatctcaaggaagtggcgactcttgatgctcttcagagtaaggataagaaggttgctgctcttaaggaagctaaggctaagcttgaggagaggttcaagactggtaagaacagatggttctttaccagctcaggttctgaagaaattttctatttcgtgaggaattcgcacgagaccagtacgtgaactat

SEQ ID NO: 4512 - protein, 150 aa, Arabidopsis thaliana
  misc_feature (1)..(150): useful for making plants with increased salt and oxidative stress resistance as described in USSN 12/922,143
  misc_feature (1)..(150): Ceres Clone ID no. 93699
  misc_feature (1)..(150): Bit score of 316.0 for hmm based on sequences of FIGURE 4.
  misc_feature (52)..(131): Pfam Name: Ribosomal_L27e Pfam Description: Ribosomal L27e protein family
  misc_feature (7)..(40): Pfam Name: KOW Pfam Description: KOW motif
  misc_feature (1)..(150): Functional Homolog Of SEQ ID NO. 32
MVKFLKQNKAVILLQGRYAGKKAVIIKSFDDGNRDRPYGHCLVAGLKKYPSKVIRKDSAKKTAKKSRVKCFIKLVNYQHLMPTRYTLDVDLKEVATLDALQSKDKKVAALKEAKAKLEERFKTGKNRWFFTSSGSEEIFYFVRNSHETST

SEQ ID NO: 4513 - DNA, 591 bp, Brassica napus
  misc_feature (1)..(591): useful for making plants with increased salt and oxidative stress resistance as described in USSN 12/922,143
  misc_feature (1)..(591): Ceres Clone ID no. 1417093
acctagagtttctagcggcgataggagagagagagagagagagagatctagacaagtgaagcaaaatggtgaagttcttgaagcagaacaaggccgtgatcctccttcaaggccgatacgccggtaagaaggccgtcatcatccgctccttcgacgacggaaaccgtgagcgtccttacggccactgcctcgtcgccggactcaaaaagtacccgagcaaggtcatccgcaaggactcggccaagaagactgcaaagaaatctagggtcaagtgtttcatcaaggtagttaactaccagcatctgatgcctacgcgttacaccctcgacgtggatctcaaggaagtggcgaccctcgaggccctttcttcaaaggacaagaaggtggcggctctcaaggaggctaagggtaagctcgaggagaggttcaagaccgggaagaacaggtggttcttcaccaagctcaggttctgaagacgttttgatctttttttttttacttgttgttgcttttcgcattgaatttttcagcgtcattttagtttctactgttgaacaatgttggtcttgttttggaagatgaatgatcttt

SEQ ID NO: 4514 - protein, 135 aa, Brassica napus
  misc_feature (1)..(135): useful for making plants with increased salt and oxidative stress resistance as described in USSN 12/922,143
  misc_feature (1)..(135): Ceres Clone ID no. 1417093
  misc_feature (1)..(135): Bit score of 327.9 for hmm based on sequences of FIGURE 4.
  misc_feature (52)..(135): Pfam Name: Ribosomal_L27e Pfam Description: Ribosomal L27e protein family
  misc_feature (1)..(135): Functional Homolog Of SEQ ID NO. 32
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALSSKDKKVAALKEAKGKLEERFKTGKNRWFFTKLRF

SEQ ID NO: 4515 - DNA, 457 bp, Brassica napus
  misc_feature (1)..(457): useful for making plants with increased salt and oxidative stress resistance as described in USSN 12/922,143
  misc_feature (1)..(457): Ceres Clone ID no. 960737
aaaagtagagacgaagccatggttaagtttctgaagcagaacaaagctgtgatcctccttcaaggtcgttatgccggcaagaaggctgtgatcatccgttccttcgacgacggcaaccgcgagcgtccttacggacactgcctcgtcgccgggctcaagaagtaccccagcaaggtcatccgcaaggactcagccaagaagacggcgaagaagtcgagggtcaagtgtttcatcaaggtcgttaactaccagcatctgatgcctactcgttacacgttggacgtggatctgaaggaggttgcgactctcgaggctctggcttcgaaggacaagaaggtggcggctcttaaggaggctaaggctaagctcgaggagaggttcaagtctggaaagaacaggtggttcttcaccaagctaaggttctgagaaccgagtttctttttatcttttgtaatgg

SEQ ID NO: 4516 - protein, 135 aa, Brassica napus
  misc_feature (1)..(135): useful for making plants with increased salt and oxidative stress resistance as described in USSN 12/922,143
  misc_feature (1)..(135): Ceres Clone ID no. 960737
  misc_feature (1)..(135): Bit score of 326.3 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALASKDKKVAALKEAKAKLEERFKSGKNRWFFTKLRF

SEQ ID NO: 4517 - DNA, 483 bp, Brassica napus
  misc_feature (1)..(483): useful for making plants with increased salt and oxidative stress resistance as described in USSN 12/922,143
  misc_feature (1)..(483): Ceres Clone ID no. 1033945
  misc_feature (92)..(92): n is a, c, t, g, unknown, or other
agcaactaatcgtttcgccggaagaggagccatggttaagtttctaaagcagaacaaagcggtgatcctccttcaaggccgttacgccggcnagaaggcggtgatcatccgatccttcgacgacggaaaccgcgagcgtccctacggacactgcctcgtagccggactcaagaagtacccgagcaaggtcatccgcaaggactcggccaagaagacggcgaagaagtcgagggtcaagtgtttcatcaaggtggtgaattaccagcatctgatgcctactcgttacacgcttgacgtggatctgaaggaagtggccactctcgaagcactgtcttcgaaggataagaaggtggcggctcttaaggaggccaaggctaagctcgaggagaggttcaagactggaaagaacaggtggttcttcaccaagctcaggttctgagaaccttttatcctctttttttgtaatggaatctacagtatgct

SEQ ID NO: 4518 - protein, 135 aa, Brassica napus
  misc_feature (1)..(135): useful for making plants with increased salt and oxidative stress resistance as described in USSN 12/922,143
  misc_feature (1)..(135): Ceres Clone ID no. 1033945
  misc_feature (1)..(135): Bit score of 328.3 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
  misc_feature (21)..(21): Xaa is any aa, unknown or other
MVKFLKQNKAVILLQGRYAGXKAVIIRSFDDGNRERPYGHCLVAGLKKYPSKVIRKDSAKKTAKKSRVKCFIKVVNYQHLMPTRYTLDVDLKEVATLEALSSKDKKVAALKEAKAKLEERFKTGKNRWFFTKLRF

SEQ ID NO: 4519 - DNA, 456 bp, Brassica napus
  misc_feature (1)..(456): useful for making plants with increased salt and oxidative stress resistance as described in USSN 12/922,143
  misc_feature (1)..(456): Ceres Clone ID no. 949504
  misc_feature (415)..(415): n is a, c, t, g, unknown, or other
  misc_feature (453)..(453): y is t/u or c
gtttttgtctctgcaagtaaccttttcgccggaagggagaagcagccatggttaagttcctgaagcagaacaaagcggttatcctcctccaaggccgttacgccgggaagaaggcagtgatcatccgctccttcgacgacggaaaccgcgagcgtccttacggacactgcctcgtcgcgggactgaagaagtatccgagcaaggtcatccgcaaggactcagccaagaagacggccaagaaatctcgagtcaagtgcttcatcaaggtggtgaactaccagcatctgatgcctactcgttacacattggacgtggatctgaaggaggttgcgactctggaagctctggcttcgaaggacaagaaggtggcggctcttaaggaggctaaggctaagctcgaggagaggttcaagancggaaaaaacaggtggttctttaccaagcttaggttcygag

SEQ ID NO: 4520 - protein, 136 aa, Brassica napus
  misc_feature (1)..(136): useful for making plants with increased salt and oxidative stress resistance as described in USSN 12/922,143
  misc_feature (1)..(136): Ceres Clone ID no. 949504
  misc_feature (1)..(136): Bit score of 325.5 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(136): Functional Homolog Of SEQ ID NO. 32
  misc_feature (123)..(123): Xaa is any aa, unknown or other
  misc_feature (136)..(136): Xaa is any aa, unknown or other
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALASKDKKVAALKEAKAKLEERFKXGKNRWFFTKLRFX

SEQ ID NO: 4521 - DNA, 475 bp, Brassica napus
  misc_feature (1)..(475): useful for making plants with increased salt and oxidative stress resistance as described in USSN 12/922,143
  misc_feature (1)..(475): Ceres Clone ID no. 1061233
  misc_feature (207)..(207): m is a or c
agcttttttttcagcggcgatacgaagacgaaggagagggatctatctacacaagtgaagcaacaatggtgaagttcttgaagcagaacaaggcagtgatcctcctccaaggccgatacgccgggaagaaggcggtgatcatccgatccttcgacgacggaaaccgtgagcgtccttacggacactgcctcgtcgccggactcaagmagtacccgagcaaggtcatccgcaaggactcggcgaagaagacggccaagaaatctagggttaagtgtttcatcaaggtcgtcaactaccagcatttgatgcctacgcgttacaccctcgacgtggatctcaaggaagtcgcgaccctcgaggctctggcttcaaaggacaagaaggtcgctgctctcaaggaggcgaaggctaagctcgaggaacgtttcaagaccgggaagaacagatggttctttaccaaactcaggttctgaag

SEQ ID NO: 4522 - protein, 135 aa, Brassica napus
  misc_feature (1)..(135): useful for making plants with increased salt and oxidative stress resistance as described in USSN 12/922,143
  misc_feature (1)..(135): Ceres Clone ID no. 1061233
  misc_feature (1)..(135): Bit score of 326.8 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
  misc_feature (48)..(48): Xaa is any aa, unknown or other
MVKFLKQNKAVILLQGRYAGKKAVIIRSFDDGNRERPYGHCLVAGLKXYPSKVIRKDSAKKTAKKSRVKCFIKVVNYQHLMPTRYTLDVDLKEVATLEALASKDKKVAALKEAKAKLEERFKTGKNRWFFTKLRF

SEQ ID NO: 4523 - DNA, 549 bp, Brassica napus
  misc_feature (1)..(549): useful for making plants with increased salt and oxidative stress resistance as described in USSN 12/922,143
  misc_feature (1)..(549): Ceres Clone ID no. 972930
gccggaaaaaaagtagagacgaagccatggttaagtttctgaagcagaacaaagctgtgatcctccttcaaggccgttatgccggtaagaaggctgtcatcatccgttccttcgacgacggcaaccgcgagcgtccttacggacactgcctcgtcgccggactcaagaagtacccgagcaaggtcatccgcaaggactccgccaagaagactgcgaagaagtcgagagtcaagtgtttcatcaaagtcgttaactaccagcatctgatgcctactcgttacacgttggatgtagatctgaaggaagtggcgactctcgaggctctggcttctaagggcaagaaggtggcggctcttaaggaggctaaggctaagctcgagaagaggttcaagactgggaagaacaggtggttcttcaccaagctcaggttctgagaaccgagtctctttacagtctacttttgtagttctagaaatgaatgtggatcgtgttttggatggtttaagacttttggtttgaaattgactctggggtctcgtctttattact

SEQ ID NO: 4524 - protein, 135 aa, Brassica napus
  misc_feature (1)..(135): useful for making plants with increased salt and oxidative stress resistance as described in USSN 12/922,143
  misc_feature (1)..(135): Ceres Clone ID no. 972930
  misc_feature (1)..(135): Bit score of 321.5 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKQNKAVILLQGRYAGKKAVIIRSFDDGNRERPYGHCLVAGLKKYPSKVIRKDSAKKTAKKSRVKCFIKVVNYQHLMPTRYTLDVDLKEVATLEALASKGKKVAALKEAKAKLEKRFKTGKNRWFFTKLRF

SEQ ID NO: 4525 - DNA, 480 bp, Brassica napus
  misc_feature (1)..(480): useful for making plants with increased salt and oxidative stress resistance as described in USSN 12/922,143
  misc_feature (1)..(480): Ceres Clone ID no. 871412
  misc_feature (42)..(42): r is g or a
  misc_feature (76)..(76): k is g or t/u
  misc_feature (88)..(88): r is g or a
  misc_feature (93)..(93): r is g or a
  misc_feature (247)..(247): r is g or a
  misc_feature (250)..(250): r is g or a
  misc_feature (259)..(259): r is g or a
acttggttttttttttcagcggcgataaacaagacgaaggaragggatctacacaagtgaagcaacaatggtgaakttcttgaagcaraacarggcagtgatcctcctccaaggccgatacgccgggaagaaggcggtgatcatccgttccttcgacgacggaaaccgcgagcgtccttacgggcactgcctcgttgccgggctcaagaagtaccccagcaaggtcatccgcaaggactcagcgaaraaracggcgaaraaatctagggttaagtgtttcatcaaggtcgtcaactaccagcatctgatgcctacgcgttacaccctcgatgtggatctcaaggaagtcgcgaccctcgaggctctgtcttcaaaggacaagaaggtcgctgctctcaaggaggctaaggctaagctcgaggaacgtttcaagaccgggaagaacagatggttctttaccaaactcaggttctgaaggat

SEQ ID NO: 4526 - protein, 135 aa, Brassica napus
  misc_feature (1)..(135): useful for making plants with increased salt and oxidative stress resistance as described in USSN 12/922,143
  misc_feature (1)..(135): Ceres Clone ID no. 871412
  misc_feature (1)..(135): Bit score of 313.5 for hmm based on sequences of FIGURE 4.
  misc_feature (7)..(40): Pfam Name: KOW Pfam Description: KOW motif
  misc_feature (52)..(135): Pfam Name: Ribosomal_L27e Pfam Description: Ribosomal L27e protein family
  misc_feature (1)..(135): Functional Homolog Of SEQ ID NO. 32
  misc_feature (3)..(3): Xaa is any aa, unknown or other
  misc_feature (7)..(7): Xaa is any aa, unknown or other
  misc_feature (9)..(9): Xaa is any aa, unknown or other
  misc_feature (60)..(60): Xaa is any aa, unknown or other
  misc_feature (61)..(61): Xaa is any aa, unknown or other
  misc_feature (64)..(64): Xaa is any aa, unknown or other
MVXFLKXNXAVILLQGRYAGKKAVIIRSFDDGNRERPYGHCLVAGLKKYPSKVIRKDSAXXTAXKSRVKCFIKVVNYQHLMPTRYTLDVDLKEVATLEALSSKDKKVAALKEAKAKLEERFKTGKNRWFFTKLRF

SEQ ID NO: 4527 - DNA, 461 bp, Brassica napus
  misc_feature (1)..(461): useful for making plants with increased salt and oxidative stress resistance as described in USSN 12/922,143
  misc_feature (1)..(461): Ceres Clone ID no. 1094338
  misc_feature (126)..(126): n is a, c, t, g, unknown, or other
acctagagtttctagcggcgataggagagagagagagagagagagatctagacaagtgaagcaaaatggtgaagttcttgaagcagaacaaggccgtgatcctccttcaaggccgatacgccggtnagaaggccgtcatcatccgctccttcgacgacggaaaccgtgagcgtccttacggccactgcctcgtcgccggactcaaaaagtacccgagcaaggtcatccgcaaggactcggccaagaagactgcaaagaaatctagggtcaagtgtttcatcaaggtagttaactaccagcatctgatgcctacgcgttacaccctcgacgtggatctcaaggaagtggcgaccctcgaggccctttcttcaaaggacaagaaggtggcggctctcaaggaggctaagggtaagctcgaggagaggttcaagaccgggaagaacaggtggtgagggtgtgtc

SEQ ID NO: 4528 - protein, 128 aa, Brassica napus
  misc_feature (1)..(128): useful for making plants with increased salt and oxidative stress resistance as described in USSN 12/922,143
  misc_feature (1)..(128): Ceres Clone ID no. 1094338
  misc_feature (1)..(128): Bit score of 289.7 for hmm based on sequences of FIGURE 4.
  misc_feature (52)..(128): Pfam Name: Ribosomal_L27e Pfam Description: Ribosomal L27e protein family
  misc_feature (7)..(40): Pfam Name: KOW Pfam Description: KOW motif
  misc_feature (1)..(128): Functional Homolog Of SEQ ID NO. 32
  misc_feature (21)..(21): Xaa is any aa, unknown or other
MVKFLKQNKAVILLQGRYAGXKAVIIRSFDDGNRERPYGHCLVAGLKKYPSKVIRKDSAKKTAKKSRVKCFIKVVNYQHLMPTRYTLDVDLKEVATLEALSSKDKKVAALKEAKGKLEERFKTGKNRW

SEQ ID NO: 4529 - DNA, 546 bp, Glycine max
  misc_feature (1)..(546): useful for making plants with increased salt and oxidative stress resistance as described in USSN 12/922,143
  misc_feature (1)..(546): Ceres Clone ID no. 1365899
agcttcaggtcagagagagtgagagacggcaaagacggaggagaggtcgcaaacgcaaaaatggtgaagtttctgaaaccaaacaaggccgtcattgtccttcagggacgctacgccggcaagaaagccgtgatcgttcgaaccttcgacgaaggaactcgcgagcgcccctacggccactgtttggtggcggggataaagaagtaccctgcgaaggtgatcaagaaggactcggcgaagaagacggcgaagaagtcgcgcgtgaaggcgttcgtgaagctcgtcaactaccagcacctcatgcccacgcgctacacgcttgacgtggacttgaaggacgcggttaaccccgacgttctcaacgcgaaggataagaaggtcactgctctcaaggagaccaagaagcgcctcgaggagaggttcaaaaccgggaagaaccggtggttcttcaccaagctcaggttctgagcggtaatcttatcgagttttgttattcgaatgcttttggatcttgctttaattgatactttataatgctgtgttgag

SEQ ID NO: 4530 - protein, 135 aa, Glycine max
  misc_feature (1)..(135): useful for making plants with increased salt and oxidative stress resistance as described in USSN 12/922,143
  misc_feature (1)..(135): Ceres Clone ID no. 1365899
  misc_feature (1)..(135): Bit score of 330.0 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPNKAVIVLQGRYAGKKAVIVRTFDEGTRERPYGHCLVAGIKKYPAKVIKKDSAKKTAKKSRVKAFVKLVNYQHLMPTRYTLDVDLKDAVNPDVLNAKDKKVTALKETKKRLEERFKTGKNRWFFTKLRF

SEQ ID NO: 4531 - DNA, 597 bp, Solanum lycopersicum
  misc_feature (1)..(597): useful for making plants with increased salt and oxidative stress resistance as described in USSN 12/922,143
  misc_feature (1)..(597): Ceres Annot ID no. 8460444
atggtgaagtttttgaagccaaacaaagctgttatccttcttcaaggcaagtatgccggccggaaagctgtgatcgtaagggcatttgatgaaggaacaagggacaggccatatggccattgtttggtcgcaggtatctccaagtacccgaagaaggtgatccgcaaggattcagcaaagaagcaggcgaagaaatctcgtgttaaggctttcatcaagctcgtgaactacaaccacatcatgcctactcgttacacactcgatgtggatctgaaggatgttgtcaatgctgatgttcttcaggcacgtgacaagaaggtgaccgctgcaaaggagaccaaggctaggcttgaggagaggttcaagaccgggaaaaatcgctggttctttaccaagcttagacgctgcagtagccaatttactgctctcatgtctatgttctgtgttgccttcttcggaaacccccacaacaacatcaataataacatagctagtgtgattgccatgaggaattgccaccggtgtagtgcaatagactctggtagtaattattccggaccaattcagcataatgcttccttatgggatggaatttga

SEQ ID NO: 4532 - protein, 198 aa, Solanum lycopersicum
  misc_feature (1)..(198): useful for making plants with increased salt and oxidative stress resistance as described in USSN 12/922,143
  misc_feature (1)..(198): Ceres Annot ID no. 8460444
  misc_feature (1)..(198): Bit score of 328.8 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(198): Functional Homolog Of SEQ ID NO. 32
MVKFLKPNKAVILLQGKYAGRKAVIVRAFDEGTRDRPYGHCLVAGISKYPKKVIRKDSAKKQAKKSRVKAFIKLVNYNHIMPTRYTLDVDLKDVVNADVLQARDKKVTAAKETKARLEERFKTGKNRWFFTKLRRCSSQFTALMSMFCVAFFGNPHNNINNNIASVIAMRNCHRCSAIDSGSNYSGPIQHNASLWDGI

SEQ ID NO: 4533 - DNA, 414 bp, Sorghum bicolor
  misc_feature (1)..(414): useful for making plants with increased salt and oxidative stress resistance as described in USSN 12/922,143
  misc_feature (1)..(414): Ceres Annot ID no. 8744162
atggtgaagttcctcaagcccggcaaggccgtgatcctactccagggccggttcgccggcaggaaggcggtgatcgtgcgcgtgttcgaggagggcacccgcgaccgcccctacggccactgcctcgtcgccgggctcgccaagtaccccaagaaggtgatccgcaaggactccgccaagaagacggccaagaagtcgcgcgtcaagtgcttcatcaagctcgtcaacttcacccacctcatgcccacccgctacaccctcgacgtcgacttcaaggacgtcgccaccggcgggcccgacgcgctctccacccgcgacaagaaggtcgccgcctgcaagaccgccaaggctcgcctcgaggagaggttcaagacaggcaagaacaggtggttctttaccaagctccgcttctag

SEQ ID NO: 4534 - protein, 137 aa, Sorghum bicolor
  misc_feature (1)..(137): useful for making plants with increased salt and oxidative stress resistance as described in USSN 12/922,143
  misc_feature (1)..(137): Ceres Annot ID no. 8744162
  misc_feature (1)..(137): Bit score of 325.0 for hmm based on sequences of FIGURE 4.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of SEQ ID NO. 32
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVATGGPDALSTRDKKVAACKTAKARLEERFKTGKNRWFFTKLRF

SEQ ID NO: 4535 - DNA, 414 bp, Sorghum bicolor
  misc_feature (1)..(414): useful for making plants with increased salt and oxidative stress resistance as described in USSN 12/922,143
  misc_feature (1)..(414): Ceres Annot ID no. 8702928
atggtgaagttcctcaagcccggcaaggccgtgatcctcctccagggccggttcgccggccggaaggcggtgatcgtgcgcgtgttcgaggagggcacccgcgaccgcccctacggtcactgcctcgtcgccggcctcgccaagtaccccaagaaggtgatccgcaaggactccgccaagaagacggccaagaagtcccgcgtcaagtgcttcatcaagctcgtcaacttcacccacctcatgcccacccgctacaccctcgacgtcgacttgaaggacgtcgcctcgggcgggcccgacgcgctctccacccgcgacaagaaggtcgaggcctgcaagaccgccaagtaccgtctcgaggagaggttcaagagcggcaagaacaggtggttctttaccaagctccgcttctag

SEQ ID NO: 4536 - protein, 137 aa, Sorghum bicolor
  misc_feature (1)..(137): useful for making plants with increased salt and oxidative stress resistance as described in USSN 12/922,143
  misc_feature (1)..(137): Ceres Annot ID no. 8702928
  misc_feature (1)..(137): Bit score of 320.9 for hmm based on sequences of FIGURE 4.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of SEQ ID NO. 32
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDLKDVASGGPDALSTRDKKVEACKTAKYRLEERFKSGKNRWFFTKLRF

SEQ ID NO: 4537 - DNA, 717 bp, Triticum aestivum
  misc_feature (1)..(717): useful for making plants with increased salt and oxidative stress resistance as described in USSN 12/922,143
  misc_feature (1)..(717): Ceres Clone ID no. 1018374
  misc_feature (467)..(467): y is t/u or c
  misc_feature (485)..(485): y is t/u or c
cccccgcacacaacccacaacccctccccaacccaccaccggcggcggcgcagcgcgaggaagaggaagcgaagatggtgaagttcctgaagccgggcaaggcggtgatcctgctgcagggcaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaagaagacggccaagaagtcccgcgtcaaggtgttcctcaagctcgtcaacttcacccacctcatgcccacccgctacaccctcgacgtcgacctcaaggaggtggcctccggcgcgcccgactccctcacctccaaggacaagaaggtgggcgccgccaaggccgccaaggccaagctcgaggagcggttcaagaccggcaagaacaggtggttyttcaccaagctccgcttytaggccagccgtttgaccggtcgcgcagggttgtctctgccgttactactacccgaaccctttacatttttagttgcttgttatcggtgactgttgctgcgcttaagatgtcctgttttggtattgcccatgaagaagactctgtttagtgtggatcttatgagatatgatgatgtttcatgtgttgaatcatgtgaagaatagatcttttgttggaattttgttgagcgtt

SEQ ID NO: 4538 - protein, 137 aa, Triticum aestivum
  misc_feature (1)..(137): useful for making plants with increased salt and oxidative stress resistance as described in USSN 12/922,143
  misc_feature (1)..(137): Ceres Clone ID no. 1018374
  misc_feature (1)..(137): Bit score of 307.1 for hmm based on sequences of FIGURE 4.
  misc_feature (52)..(137): Pfam Name: Ribosomal_L27e Pfam Description: Ribosomal L27e protein family
  misc_feature (7)..(40): Pfam Name: KOW Pfam Description: KOW motif
  misc_feature (1)..(137): Functional Homolog Of SEQ ID NO. 32
  misc_feature (131)..(131): Xaa is any aa, unknown or other
  misc_feature (137)..(137): Xaa is any aa, unknown or other
MVKFLKPGKAVILLQGRYAGKKAVIVRVFEEGTRDRPYGHCLVAGLAKYPKKVIRKDSAKKTAKKSRVKVFLKLVNFTHLMPTRYTLDVDLKEVASGAPDSLTSKDKKVGAAKAAKAKLEERFKTGKNRWXFTKLRX

SEQ ID NO: 4539 - protein, 135 aa, Vitis vinifera
  misc_feature (1)..(135): useful for making plants with increased salt and oxidative stress resistance as described in USSN 12/922,143
  misc_feature (1)..(135): Public GI ID no. 157348811
  misc_feature (1)..(135): Bit score of 335.0 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPNKAVVLLQGRFAGRKAVIVRSFDDGTRDRPYGHCLVAGIAKYPKKVIRKDSAKKTAKKSRVKAFIKLVNYNHIMPTRYTLDVDLKDVVSPDVLQSRDKKVTAAKETKKKLEERFKTGKNRWFFSKLRF

SEQ ID NO: 4540 - protein, 135 aa, Vitis vinifera
  misc_feature (1)..(135): useful for making plants with increased salt and oxidative stress resistance as described in USSN 12/922,143
  misc_feature (1)..(135): Public GI ID no. 147855215
  misc_feature (1)..(135): Bit score of 331.5 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPNKAVVLLQGRFAGRKAVIVRSFDDGTRDRPYGHCLVAGIAKYPKKVIRKDSAKKTAKKSRVKAFIKLVNYNHIMPTRYTLDVNLKDVVSPDVLQSRDKKVTAAKETKKKLEERFKTGKNRWFFSKLRF

SEQ ID NO: 4541 - protein, 135 aa, Vitis vinifera
  misc_feature (1)..(135): useful for making plants with increased salt and oxidative stress resistance as described in USSN 12/922,143
  misc_feature (1)..(135): Public GI ID no. 157338639
  misc_feature (1)..(135): Bit score of 335.4 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKQNKAVVVLQGRFAGRKAVIVRSFDDGTRDRPYGHCLVAGIAKYPKKVIRKDSAKKTAKKSRVKAFIKLVNYNHLMPTRYTLDVDLKDVVTVDALQSRDKKVTAAKETKARFEERFKTGKNRWFFTKLRF

SEQ ID NO: 4542 - protein, 135 aa, Elaeis guineensis
  misc_feature (1)..(135): useful for making plants with increased salt and oxidative stress resistance as described in USSN 12/922,143
  misc_feature (1)..(135): Public GI ID no. 192910854
  misc_feature (1)..(135): Bit score of 328.7 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPGKAVIVLQGRFAGRKAVIVRCFDEGTRDRPYGHCLVAGILKYPKKVIRKDSAKKTAKKSRVKAFLKMVNYSHIMPTRYTLDVDLKDVVTLDVLQSRDKKVAACKETKARFEERFKTGKNRWFFTKLRF

SEQ ID NO: 4543 - protein, 135 aa, Physcomitrella patens subsp. patens
  misc_feature (1)..(135): useful for making plants with increased salt and oxidative stress resistance as described in USSN 12/922,143
  misc_feature (1)..(135): Public GI ID no. 168027593
  misc_feature (1)..(135): Bit score of 295.2 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPNKVVVLLQGRYAGRKAVIVKNFDDGTKERPYGHAIVCGIAKYPRKVIKKASQKTIAKRSRVKAFTKVVNYNHIMPTRYSLDVDLKSTVTADKLESTASRVEARKGAKAVLEERFKTGKNRWFFTKLRF

SEQ ID NO: 4544 - protein, 135 aa, Physcomitrella patens subsp. patens
  misc_feature (1)..(135): useful for making plants with increased salt and oxidative stress resistance as described in USSN 12/922,143
  misc_feature (1)..(135): Public GI ID no. 168031587
  misc_feature (1)..(135): Bit score of 292.7 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPNKVVVLLQGRYAGRKAVIVKNFDDGTKERPYGHAIVCGIAKYPRKVIKKASQKTIAKRSRLKAFTKVVNYNHIMPTRYSLDVDLKNIVTADKLESTASRVEARKASKTVLEERFKTGKNRWFFSKLRF

SEQ ID NO: 4545 - protein, 135 aa, Physcomitrella patens subsp. patens
  misc_feature (1)..(135): useful for making plants with increased salt and oxidative stress resistance as described in USSN 12/922,143
  misc_feature (1)..(135): Public GI ID no. 168049977
  misc_feature (1)..(135): Bit score of 292.8 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPNKVVVLLQGRYAGRKAVIVKNFDDGTKERPYGHAIVCGIAKYPRKVIKKASQKTIAKRSRLKAFTKVVNYNHIMPTRYSLDVDLKNTVTADKLESTASRVESRKAAKAVLEERFKTGKNRWFFSKLRF

SEQ ID NO: 4546 - protein, 135 aa, Physcomitrella patens subsp. patens
  misc_feature (1)..(135): useful for making plants with increased salt and oxidative stress resistance as described in USSN 12/922,143
  misc_feature (1)..(135): Public GI ID no. 168061210
  misc_feature (1)..(135): Bit score of 288.8 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPNKVVVLLQGRYAGRKAVIVKNFDDGTKERPYGHAIICGIAKYPRKVIKKASQKTIAKRSRLKAFTKVVNYNHIMPTRYSLDVDLKSTLTADKLESTAGRVEARKGAKAVLEERFKTGKNRWFFSKLRF

SEQ ID NO: 4547 - protein, 135 aa, Ostreococcus lucimarinus CCE9901
  misc_feature (1)..(135): useful for making plants with increased salt and oxidative stress resistance as described in USSN 12/922,143
  misc_feature (1)..(135): Public GI ID no. 145346330
  misc_feature (1)..(135): Bit score of 272.3 for hmm based on sequences of FIGURE 4.
  misc_feature (52)..(135): Pfam Name: Ribosomal_L27e Pfam Description: Ribosomal L27e protein family
  misc_feature (7)..(40): Pfam Name: KOW Pfam Description: KOW motif
  misc_feature (1)..(135): Functional Homolog Of SEQ ID NO. 32
MVKFLKPGKVVVVLQGRYAGKKAVIVKNVDDGSSAHPYGHALVCGLSTIPRKVTKKMDEKKQAKRSRCKTFIKNVNYSHLMPTRYTLDVDLKNVVTSDALDNATKKVAAQKEAKKLLEERFKTGKSRWFFTRLAF

SEQ ID NO: 4548 - protein, 476 aa, Zea mays
  misc_feature (1)..(476): useful for making plants with increased salt and oxidative stress resistance as described in USSN 12/922,143
  misc_feature (1)..(476): Public GI ID no. 194696788
  misc_feature (1)..(476): Bit score of 1192.3 for hmm based on sequences of FIGURE 16.
  misc_feature (108)..(128): Pfam Name: IQ Pfam Description: IQ calmodulin-binding motif
  misc_feature (1)..(476): Functional Homolog Of SEQ ID NO. 922
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQAPVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 4549 - protein, 1109 aa, Vitis vinifera
  misc_feature (1)..(1109): useful for making plants with increased salt and oxidative stress resistance as described in USSN 12/922,143
  misc_feature (1)..(1109): Public GI ID no. 157358362
  misc_feature (1)..(1109): Bit score of 1115.3 for hmm based on sequences of FIGURE 10.
  misc_feature (58)..(178): Pfam Name: MATH Pfam Description: MATH domain
  misc_feature (1)..(1109): Functional Homolog Of SEQ ID NO. 389
MTLMTPPPLDQEDDEMLVPHTDFADGPQPMEVAQPDTASAVDAQTVEDPPSARFTWTIENFSRLNTKKLYSDVFYVGGYKWRVLIFPKGNNVDHLSMYLDVADSATLPYGWSRYAQFSLAVINQIHNKFTIRKDTQHQFNARESDWGFTSFMPLGELYDPARGYLVNDTCIVEADVAVRRVIDYWTHDSKKETGYVGLKNQGATCYMNSLLQTLYHIPYFRKAVYHMPTTENDMPSGSIPLALQSLFYKLQYSDTSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNKYHAEIHGLQDARKGVLFIDFPPVLQLQLKRFEYDFMRDTMVKINDRYEFPLQLDLDRENGKYLSPDADRSVRNLYTLHSVLVHSGGVHGGHYYAYIRPTLSDQWFKFDDERVTKEDIKRALEEQYGGEEELPQTNPGFNNSPFKFTKYSNAYMLVYIRESDKEKIICNVDEKDIAEHLRIRLKKEQEEKEQKRKEKAEAHLYTIIKVARNEDLIEQIGRDIYFDLVDHDKVRSFRIQKQTPFNLFKEEVAKEFGIPVQFQRFWLWAKRQNHTYRPNRPLTLQEEAQSVGQLREVSNKANHAELKLFLEVELGQDLRPVPPPEKTKEEILLFFKLYDPLKEELRYVGRLFVKGSGKPIEILSKLNELAGFSPNEEIELFEEIKFEPNVMCEHIDKRLTFRASQLEDGDIICYQRLLQIDSSQQCRYPDVPSFLEYVHNRQVVRFRSLEKPKEDEFCLELSKLFNYDDVVERVAAHLGLDDSSKIRLTSHNCYSQQPKPQPIKYRGVEHLSDMLLHYNQTSDILYYEVLDIPLPELQGLKTLKVAFHHATKEEVVIHTIRLPKQSTVGDVINDLKSKVELSHPNAELRLLEVFYHKIYKIFPLNEKIENINDQYWTLRAEEIPEEEKNLGPHDRLIHVYHFMKDTTQNQVQVQNFGEPFFLVIHEGETLAEVKVRIQKKLQVPDEEFSKWKFAFLSLGRPEYLQDSDIRRDVYGAWEQYLGLEHSDNAPKRSYAANQNRHTFEKPVKIYN

SEQ ID NO: 4550 - protein, 1101 aa, Vitis vinifera
  misc_feature (1)..(1101): useful for making plants with increased salt and oxidative stress resistance as described in USSN 12/922,143
  misc_feature (1)..(1101): Public GI ID no. 157343371
  misc_feature (1)..(1101): Bit score of 1095.3 for hmm based on sequences of FIGURE 10.
  misc_feature (44)..(164): Pfam Name: MATH Pfam Description: MATH domain
  misc_feature (1)..(1101): Functional Homolog Of SEQ ID NO. 389
MLVPHTDLADGHQPMEVVAQEETTSTVENQPVEDPPTSRFTWRIENFSRLNTKKHYSENFIVGGYKWRVLIFPKGNNVEHLSMYLDVADSSSLPYGWSRYAQFSLAVVNQIHNKYTVRKDTQHQFNARESDWGFTSFMPLSELYDPGRGFLVSDTCIVEAEVAVRRVVDYWTYDSKKETGYVGLKNQGATCYMNSLLQTLYHIPYFRKAVYHMPTTENDMPSGSIPLALQSLFYKLQYSDSSVATKELTKSFGWDTYDSFLQHDVQELNRVLCEKLEDKMKGTVVEGTIQQLFEGHHMNYIECINVDYKSTRKESFYDLQLDVKGCHDVYASFDKYVEVERLEGDNKYHAEHHGLQDARKGVLFIDFPPVLQLQLKRFEYDFMRDTMVKINDRYEFPLQLDLDRENGKYLSPDANRTVRNLYALHSVLVHSGGVHGGHYYAFIRPTLSDQWYKFDDERVTKEDVKRALEEQYGGEEELPQTNPGLNNTPFKFTKYSNAYMLVYIRESDKDKIICNVDEKDIAEHLRERLKKEQEEKEHKKKEKAESHLYTIIKVARDDDLVEHIGRDIYFDLVDHDKVRSFRIQKQMPFNFFKEEVAKEFGIPIQFQRFWLWAKRQNHTYRPNRPLTHLEEQQSVGQLREISNKVQNAELKLFLEVNLGPDLHPNPPPEKTKDDILLFFKLYDPEKEELNYVGRLFVKSTGKPVEILSKLNEMVGYAPDEEIELYEEIKFDPSVMCEPIDKKFTFRASQLEDGDIICFQKTPPIESGESFRYPDVPSFLEYVHNRQVVHFRSLEKPKEDDFCLEMSKLFTYDDVVERVARQLGLDDPSKIRLTSHNCYSQQPKPQPIKYRGVDHLSDMLVHYNLISDVLYYEVLDIPLPELQGLKTLKVAFHHAEKEEVVSHSIRLPKQSTVGDVINALKTKVELSHPNAEVRLLEVFYHKIYKVFPSNEKIENINDQYWTLRAEEIPEEEKNLGPQDRLIHVYHFTKDTAQNQMQIQNFGEPFFLVIHEGETLAEVKVRIQKKLLVPEEEFAKWRFAFLSLGRPEYLQDSDIVSSRFQRRDVYGAWEQYLGLEHSDTAPKRAYAANQNRHTFEKPVKIYN

SEQ ID NO: 4551 - DNA, 2024 bp, Panicum virgatum
  misc_feature (1)..(2024): useful for making plants with increased salt and oxidative stress resistance as described in USSN 12/922,143
  misc_feature (1)..(2024): Ceres Clone ID no. 1727738
gttctctctccctcgtcactctcgccactgctcccagctgttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactaacccgtccagcctccaggcaatccccttcgacgccctctgctaaagtagcgccaatacctgctaggagaaaatccgccacgccagagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccagagaaaggaagctctgctggaccggtcaagaaaaggttgtcatttcaaggtggaacagcggctgcctcaccaatgcgacggcattctggtcctcccaaggtggacagtgcggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttctg

SEQ ID NO: 4552 - protein, 471 aa, Panicum virgatum
  misc_feature (1)..(471): useful for making plants with increased salt and oxidative stress resistance as described in USSN 12/922,143
  misc_feature (1)..(471): Ceres Clone ID no. 1727738
  misc_feature (1)..(471): Bit score of 1128.5 for hmm based on sequences of FIGURE 16.
  misc_feature (104)..(124): Pfam Name: IQ Pfam Description: IQ calmodulin-binding motif
  misc_feature (1)..(471): Functional Homolog Of SEQ ID NO. 922
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPENGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSAVKDIVAPPQPEALVINGGSK

SEQ ID NO: 4553 - DNA, 2015 bp, Panicum virgatum
  misc_feature (1)..(2015): useful for making plants with increased salt and oxidative stress resistance as described in USSN 12/922,143
  misc_feature (1)..(2015): Ceres Clone ID no. 1859266
tcactctcgccactgctcccagctgttgcgacttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttggtgattgtttcgaggagtgtggagtgaagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttgaagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactgacccgtccagcctccaggcaatccccttcgacgccctctgctaaagtagcgccaatacctgctaggagaaaatccgccacgccaaagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaggggcgaagtctcgtctccagggatcagcattgactaatggtgcagagacaccggagaaaggaagctctgctggaccggtcaagaaaaggttgtcatttcaaggtggaacagcggctgcctcaccaatgcgacggcattctggtcctcccaaggtggacagtgtggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttct

SEQ ID NO: 4554 - protein, 471 aa, Panicum virgatum
  misc_feature (1)..(471): useful for making plants with increased salt and oxidative stress resistance as described in USSN 12/922,143
  misc_feature (1)..(471): Ceres Clone ID no. 1859266
  misc_feature (1)..(471): Bit score of 1119.4 for hmm based on sequences of FIGURE 16.
  misc_feature (104)..(124): Pfam Name: IQ Pfam Description: IQ calmodulin-binding motif
  misc_feature (1)..(471): Functional Homolog Of SEQ ID NO. 922
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLKRWMAAKPWEGCNGADKESNIDRGSVKSMSLNLGEGEITKAFNRRDSKPEKPSPPTPKLTRPASRQSPSTPSAKVAPIPARRKSATPKNGLSHVDDDARSVFSVQSERPRRHSIATSTVQDNESLASSPSLPSYMVPTESAGAKSRLQGSALTNGAETPEKGSSAGPVKKRLSFQGGTAAASPMRRHSGPPKVDSVVKDIVAPPQPEALVINGGSK

SEQ ID NO: 4555 - protein, 466 aa, Vitis vinifera
  misc_feature (1)..(466): useful for making plants with increased salt and oxidative stress resistance as described in USSN 12/922,143
  misc_feature (1)..(466): Public GI ID no. 157347478
  misc_feature (1)..(466): Bit score of 983.8 for hmm based on sequences of FIGURE 16.
  misc_feature (112)..(132): Pfam Name: IQ Pfam Description: IQ calmodulin-binding motif
  misc_feature (1)..(466): Functional Homolog Of SEQ ID NO. 922
MGRKGNWLSSVKKALSPEPKEKKDQRADKSKKKWFGKHKYPDPNPSSLETVPGPSLAPPEEVKTIEPDNEHHKHVYSVAATTTMASLDVPETDVEVVEITTLTQSTGKAKEEAAAIKIQTAFRGYLARRALRALRGLVRLQSLIQGTAVKRQAANTLRCMQTLARVQSQICYRRIRMSEENQALQRQLLQKQAKEFEQLKMGEEWDDSLQSKEQIEAGLLNKQGAAMRRERALAYAFSHQQAWKNSSKSTNLLFMDPSNPHWGWSWLERWMAARPWESRSTTDKELNNDQLSIKSGSRSITGGEITKAYARHLLDSSKPSPTASQKPYHPPARQSPSTPPSKALENLSLQQAQGGICGSMVSIQSERFRRHSIAGSSVGDDESLASSPAVPSYMAPTKSAKAKSRLQSPLGLENNGTPEKGSSGIAKKRLSFPASPARPRRHSGPPRVESSSLTEGIVSNGGGTVS

SEQ ID NO: 4556 - protein, 1118 aa, Lotus japonicus
  misc_feature (1)..(1118): useful for making plants with increased salt and oxidative stress resistance as described in USSN 12/922,143
  misc_feature (1)..(1118): Public GI ID no. 164605535
  misc_feature (1)..(1118): Bit score of 1176.6 for hmm based on sequences of FIGURE 10.
  misc_feature (61)..(181): Pfam Name: MATH Pfam Description: MATH domain
  misc_feature (1)..(1118): Functional Homolog Of SEQ ID NO. 389
MTVMTPAPIDQQEDEEMLVPHTDLPENNHQPMEVVAQPEAAPTVESQPVEEPPQSRFTWRIDNFSRMNVKKLYSEVFVVGGYKWRVLIFPKGNNVDYLSMYLDVADSTNLPYGWSRYAQFSLAVVNQIQNKYTVRKDTQHQFNARESDWGFTSFMPLGELYDPSRGYLLNDTLVVEAEVLVRRIVDYWTYDSKKETGYVGLKNQGATCYMNSLLQTLYHIPYFRKAVYHMPTTENDMPAGSIPLALQSLFYKLQYSDTSVATKELTKSFGWDTYDSFMQHDVQELNRVLCEKLEDKMKGTVVEGTIQKLFEGHHMNYIECINVDYKSTRKESFYDLQLDVKGCHDVYASFDKYVEVEPLEGDNKYHAEQYGLQDAKKGVLFIDFPPVLQLQLKRFEYDFMRDTMVKINDRYEFPLELDLDRDDGKYLSPDADRNVRNLYTLHSVLVHSGGVHGGHYYAFIRPTLSDQWYKFDDERVTKEDTKRALEEQYGGEEELPQTNPGFNNTPFKFTKYSNAYMLVYIREADKDKVICNVDEKDIAEHLRERLKKEQEEKEHKKKEKAEAHLYTIIKVARNEDLKEQIGKDIYFDLVDHDKVRSFRVQKQMSFNLFKEEVAKEFGIPVQFQRFWLWAKRQNHTYRPNRPLTPAEEAQSVGQVREVSNKVHNAELKLFLEVELGPDLRPIAPSDKTKDDILLFFKLYDPEKEELRYVGRLFVKSTGKPSEILTRLNEMAGYDPDEEIGLYEEIKFEPNVMCEPIDKKLTFRASQLEDGDIICFQKAPAMDSEEHVRYPDVPSYLEYVHNRQVVHFRSLDKPKEDDFCLEMSRLYTYDDVVEKVAQQLNLDDPSKIRLTPHNCYSQQPKPQPIKYRGVDHLSDMLVHYNQTSDILYYEILDIPLPELQGLKTLKVAFYHATKDEVVSHTIRLPKQSTVGDVLDDLKTKVELSHPNAELRLLEVFYHKIYKVFPPNEKIETINDQYWTLRAEEVPEEEKNLGPHDRLIHVYHFTKDTSQNQMQIQNFGEPFFLVIREGETLTEIKVRIQKKLQVPDDEFEKWKFAFFALGRPEYLQDSDIVSNRFQRRDVYGAWEQYLGLEHTDNAPKRSYAVNQNRHTFEKPVKIYN

SEQ ID NO: 4557 - protein, 1114 aa, Vitis vinifera
  misc_feature (1)..(1114): useful for making plants with increased salt and oxidative stress resistance as described in USSN 12/922,143
  misc_feature (1)..(1114): Public GI ID no. 157349974
  misc_feature (1)..(1114): Bit score of 1139.2 for hmm based on sequences of FIGURE 10.
  misc_feature (60)..(180): Pfam Name: MATH Pfam Description: MATH domain
  misc_feature (1)..(1114): Functional Homolog Of SEQ ID NO. 389
MTLMTPAPLDQQEDEEMLVPHSDLVEGPQPMEVVAQADASSAVENQPVEDPQTSRFTWTIENFSRLNTKKHYSEIFVVGGFKWRVLIFPKGNNVDHLSMYLDVADSATLPYGWSRYAQFSLSVVNQIHNKYSIRKDTQHQFNARESDWGFTSFMPLSDLYDPGRGYLVNDTCIIEAEVAVRKILDYWTYDSKKETGFVGLKNQGATCYMNSLLQTLYHIPYFRKAVYHMPTTENDMPSGSIPLALQSLFYKLQYNDNSVATKELTKSFGWDTYDSFMQHDVQELNRVLCEKLEDKMKGTVVEGTIQQLFEGHHMNYIECINVDYKSTRKESFYDLQLDVKGCRDVYASFDKYVEVERLEGDNRYQAENHGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERKILGGHWRNSMVARKRHLPQTNPGFNNTPFKFTKYSNAYMLVYIRESDKEKIICNVDEKDIAEHLRIRLKKEQEEKEDKRKYKAQAHLFTIIKVARDEDLAEQIGKDIYFDLVDHDKVRSFRIQKQWPFTLFKEEVAKEFGIPVQYQRFWIWAKRQNHTYRPNRPLTPQEEAQSVGQLREVSTKVNNAELKLFLEVELGPDLRPIPPPEKTKEDILLFFKLYDPEKEELRYVGRLFVKSSGKPIEILTKLNEMAGFAPDEEIELYEEIKFEPCVMCEHLAKRTSFRFSQIEDGDIICFQKSAPPESEEQCRYSDVTSFLEYVQNRQVVHFRALERPKEDDFCLELSKLHNYDDVVERVARRLGLDDPSKIRLTSHNCYSQQPKPQPIKYRGVEHLSDMLVHYNQSSDILYYEVLDIPLPELQGLKNLKVAFHHATKDDVIIHNIRLPKQSTVGDVINELKTKVELSHPNAELRLLEVFYHKIYKIFPPSEKIENINDQYWTLRAEEAKEEKNLGPHDRLIHVYHFTKETVQNQMQVQNFGEPFFLIIHEGETLAEVKERIQKKLQVPDEEFSKWKFAFLSLGRPEYLQDSDIVSSRFQRRDVYGAWEQYLGLEHSDTAPKRAYAANQNRHTFEKPVKIYN

SEQ ID NO: 4558 - DNA, 1818 bp, Panicum virgatum
  misc_feature (1)..(1818): useful for making plants with increased salt and oxidative stress resistance as described in USSN 12/922,143
  misc_feature (1)..(1818): Ceres Clone ID no. 1901601
gaggaaaatgtcgggctgcttgcccttccttgccttttggcttgcagccgagacattgaagacacagtaatagaacacaaaagaatgggtaagaagggaaagtggtttagtgctgtgaagaaagtcttcggctcctccgatcctgatggaaagcaagcaaaggctgagaaggcggacaagtcaaaatccaggaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttgagaaaatgaagattgatgaagactgggatcacagccatcaatccaaagaacaaattgaggccagcctagttatgaaacaagaagctgcgctaagacgagaaagagcactcgcatatgctttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccgtccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcagagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaagaagcgcctctccttcccagtcattgacaaaccgagcggtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtaccatataacggtttttgacagactttcttaacgtgtg

SEQ ID NO: 4559 - protein, 498 aa, Panicum virgatum
  misc_feature (1)..(498): useful for making plants with increased salt and oxidative stress resistance as described in USSN 12/922,143
  misc_feature (1)..(498): Ceres Clone ID no. 1901601
  misc_feature (1)..(498): Bit score of 576.9 for hmm based on sequences of FIGURE 16.
  misc_feature (139)..(159): Pfam Name: IQ Pfam Description: IQ calmodulin-binding motif
  misc_feature (1)..(498): Functional Homolog Of SEQ ID NO. 922
MGKKGKWFSAVKKVFGSSDPDGKQAKAEKADKSKSRRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELEKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVKKRLSFPVIDKPSGPPADKPKERVRRHSDPPKVDPATLKDAPVA

SEQ ID NO: 4560 - DNA, 2087 bp, Panicum virgatum
  misc_feature (1)..(2087): useful for making plants with increased salt and oxidative stress resistance as described in USSN 12/922,143
  misc_feature (1)..(2087): Ceres Clone ID no. 1998974
ggcaccgggagcgtgaccgtcacgagggggcgaagccccggggaagagccggagaggagatcgagagcggcccatcgcccccacaccacgccccacctccggctgcccgcctcccccgccgccgtggtccgcggctgcgggcggggccacgcgcccggctgggggtgaacagcgcgggacggggtcaccgtcgggcggtggggtgggcgaatcgatcctgcgtgcggggttgggctggccgataaaagggggcgcctttggactggcgaggcttgccgccgagacattgaagacacagtaatagaacacaaaaaatgggtaaaaagggaaagtggtttagtgctgtcaagaaagtcttcggctcctctgatccagatggaaaggaagcaaaggttgagaaggcggataagtcaaaatccaggaggagatggccatttggaaagtcgaggcactctgatccttctacctcaatggtgtcagggactgctccagtagctccgttgcctccgccaccaccaatacaacttactcagccacactcccaggagattaaagatgtcaagccagttgaaacagacagtgagcagaacaagcatgcatactctgttgcccttgcatccgctgttgctgctgaagctgctgcagttgctgcccaggccgctgctgaggttgtgcgcctcacagcagttaccacggcagcaccaaaaatgcctgttacttcaagggaagaacttgccgccatcaagattcagactgccttcaggggttatctggcaaggagagcattgcgggcactaagagggctagttagattgaagtcacttgtcgatggaaatgctgtcaagcgccaaacttctcacactttgcattgcacacaaacgatgacaagagttcaaactcaaatctactctagaagggtgaagttggaggaggaaaaacaagctcttcaaaggcagctccaattgaaacatcaaagggaacttgagaaaatgaagattgaagaagactgggatcacagccatcaatccaaagaacaaattgaggccagcctagttatgaaacaagaagctgcactaaaacgagaaagagcacttgcatatgcattttctcaccagtggagaaattctggtcgaactataaccccaactttcacagaacctgggaatcctaactggggctggagctggatggaacgctggatgacagcaagaccttgggagagccgattggcagcatcagacaaggataataaagagcgttctctgacaaagaattccagcagcagtgctgttcgaatgtctgtaccccgtgccatctcaatccagaggccagcaacaccaaacaagtcaagccgtccaccaagccggcagtcaccttcaacaccgccatcgaaggcaccatctacctcaggaaagaccaggccggcaagtccaaggggcagctggctgtacaaggaagatgacctgaggagcatcacaagcatacgctctgaacgcccaaggaggcaaagcataggcggaggctcggtccgggatgatgcaagcctgactagcacaccacctctccccagttatatgcagtcgacagagtctgcgagggcaaagtctcgataccgcagcttgttgactgaaaagcttgaggtttcagagagggcacctctggcccattcggttgttaagaagcgcctctccttccctgtcatcgacaaaccgagcagtccaccggcagataagacaaaggaaagagcgaggcgccattcagaccctccgaaggttgatcctgcaatgatgaaggatgcccctgttgcctgatcaggcccttgtgattgttaggtttcgtgctgttttaactccatgatgtattttctaagttagattgttttctctgcgtaatgtctaatctgtccgggttgatttgagaattgaggcaattctaactgtatttgctgtcatggttttctccctgtagattgatacgtgtgattctaatagtgtatgcccttggctttcaatgtacgatataacggtttttgacagactttcttaacgtgcgaaattgcaatatatatatatatatatatccattcc

SEQ ID NO: 4561 - protein, 498 aa, Panicum virgatum
  misc_feature (1)..(498): useful for making plants with increased salt and oxidative stress resistance as described in USSN 12/922,143
  misc_feature (1)..(498): Ceres Clone ID no. 1998974
  misc_feature (1)..(498): Bit score of 576.8 for hmm based on sequences of FIGURE 16.
  misc_feature (139)..(159): Pfam Name: IQ Pfam Description: IQ calmodulin-binding motif
  misc_feature (1)..(498): Functional Homolog Of SEQ ID NO. 922
MGKKGKWFSAVKKVFGSSDPDGKEAKVEKADKSKSRRRWPFGKSRHSDPSTSMVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGNAVKRQTSHTLHCTQTMTRVQTQIYSRRVKLEEEKQALQRQLQLKHQRELEKMKIEEDWDHSHQSKEQIEASLVMKQEAALKRERALAYAFSHQWRNSGRTITPTFTEPGNPNWGWSWMERWMTARPWESRLAASDKDNKERSLTKNSSSSAVRMSVPRAISIQRPATPNKSSRPPSRQSPSTPPSKAPSTSGKTRPASPRGSWLYKEDDLRSITSIRSERPRRQSIGGGSVRDDASLTSTPPLPSYMQSTESARAKSRYRSLLTEKLEVSERAPLAHSVVKKRLSFPVIDKPSSPPADKTKERARRHSDPPKVDPAMMKDAPVA

SEQ ID NO: 4562 - DNA, 1812 bp, Panicum virgatum
  misc_feature (1)..(1812): useful for making plants with increased salt and oxidative stress resistance as described in USSN 12/922,143
  misc_feature (1)..(1812): Ceres Clone ID no. 1747444
agaggtccgtgcggtgggcggtggcttaccagagttaggtccttggcgccttcagtcgggtgaggaaggcttgcagccgagacattgaagacacagtaatagaacacaaaagaatgggtaagaagggaaagtggtttagtgctgtgaagaaagtcttcggctcctccgatcctgatggaaagcaagcaaaggctgagaaggcggacaagtcaaaatccagtaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttaagaaaatgaagattgatgaagactgggatcacagccatcaatccaaagaacaaattgaggccagcctagttatgaaacaagaagctgcgctaagacgagaaagagcactcgcatatgctttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccgtccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcaaagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaagaagcgcctctccttcccagtcattgacaaaccgagcggtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtacc

SEQ ID NO: 4563 - protein, 498 aa, Panicum virgatum
  misc_feature (1)..(498): useful for making plants with increased salt and oxidative stress resistance as described in USSN 12/922,143
  misc_feature (1)..(498): Ceres Clone ID no. 1747444
  misc_feature (1)..(498): Bit score of 572.6 for hmm based on sequences of FIGURE 16.
  misc_feature (139)..(159): Pfam Name: IQ Pfam Description: IQ calmodulin-binding motif
  misc_feature (1)..(498): Functional Homolog Of SEQ ID NO. 922
MGKKGKWFSAVKKVFGSSDPDGKQAKAEKADKSKSSRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELKKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVKKRLSFPVIDKPSGPPADKPKERVRRHSDPPKVDPATLKDAPVA

SEQ ID NO: 4564 - protein, 498 aa, Zea mays; identical to SEQ ID NO: 3386
  misc_feature (1)..(498): useful for making plants with increased salt and oxidative stress resistance as described in USSN 12/922,143
  misc_feature (1)..(498): Public GI ID no. 194702278
  misc_feature (1)..(498): Bit score of 556.4 for hmm based on sequences of FIGURE 16.
  misc_feature (137)..(157): Pfam Name: IQ Pfam Description: IQ calmodulin-binding motif
  misc_feature (1)..(498): Functional Homolog Of SEQ ID NO. 922

SEQ ID NO: 4565 - protein, 499 aa, Picea sitchensis
  misc_feature (1)..(499): useful for making plants with increased salt and oxidative stress resistance as described in USSN 12/922,143
  misc_feature (1)..(499): Public GI ID no. 116787496
  misc_feature (1)..(499): Bit score of 318.9 for hmm based on sequences of FIGURE 16.
  misc_feature (120)..(140): Pfam Name: IQ Pfam Description: IQ calmodulin-binding motif
  misc_feature (1)..(499): Functional Homolog Of SEQ ID NO. 922
MDKKGSCFSVLKWAFCAKQKSHATKQGKKKGGCCFGSFRHHEPAAPKEDTRVKKTLGEGQEIRNEHEKPLVEVKEEQNSHASAVAVATAAAAEAAAAAAHAVAKVVRLTESYYSTNSPEECAAIKIQTAFRGYLVRRNFHTLRGLMRLQALVQGQSVRRQATNTMRCMQALVRVHSQICSRRIRMFEENQALQHHLQQKYEKELENRTSNSEADHQQDWESSLLTKEEIEARLQSKIEAAIKRERALAYAFSHHLWKNPPKSVQTMLMEIDPDKPHWGWSWLERWMATRPWDNHRMTMKENSTRKLQTIGEIGQKTSHIGLKQHNAEVTNIGTIKSDPFTPLSKPSIPNKMPLTGTDIKSDVNVLRSERPRYSSRYGVAGTSSLRDDESLMSSPRIPNYMASTESAKAKVRSQSTPKQRPGTPDTEPTSYRRKRLSFPLSEASSGPYRSTKGSMFPHTSPSLKGISGTSKSKKSVSSLRDLSIESDNSSLNWGHRKPFR

SEQ ID NO: 4566 - DNA, 609 bp, Sorghum bicolor
  misc_feature (1)..(609): useful for making plants with increased salt and oxidative stress resistance as described in USSN 12/922,143
  misc_feature (1)..(609): Ceres Annot ID no. 8680317
atggcagagacggtgttcaccccatctttggaagggatgaagcatgtcaaggcagagaacggagtcattctcaccaagcccttccttgatgtctgcaagcaaatcttgcctgtcctcgataaatttggagctgctatggcaattgtaaagactgatatcggtggcaatatcacaagactggaaaacaagtattgttcagatccatcaaagtatgaacatttgtacaccatggctcaggaagaagttcaaaacaagaccgcaaaaggttcctcaagctgcacaaatgggcttctgtggctcacgagggccatggatttccttgtcgagttgtttcgtaacctgcttgagcatccagattggaccatgagtcaagcttgcactgattcatacaccaagactctgaagaaatttcatggctggcttgccagttctagttttacggtggccatgaagcttgctcccaatagagataaatttatggaggtcattagtggaactggtgacatcaatgcagatattgagaaattttgcacaaccttctcacctttcctcaaagaaaatcacaactttctggcgagcgtcggtcttgatgatatgaaggcttcatag

SEQ ID NO: 4567 - protein, 202 aa, Sorghum bicolor
  misc_feature (1)..(202): useful for making plants with increased salt and oxidative stress resistance as described in USSN 12/922,143
  misc_feature (1)..(202): Ceres Annot ID no. 8680317
  misc_feature (1)..(202): Bit score of 553.8 for hmm based on sequences of FIGURE 13.
  misc_feature (10)..(198): Pfam Name: GLTP Pfam Description: Glycolipid transfer protein (GLTP)
  misc_feature (1)..(202): Functional Homolog Of SEQ ID NO. 697
MAETVFTPSLEGMKHVKAENGVILTKPFLDVCKQILPVLDKFGAAMAIVKTDIGGNITRLENKYCSDPSKYEHLYTMAQEEVQNKTAKGSSSCTNGLLWLTRAMDFLVELFRNLLEHPDWTMSQACTDSYTKTLKKFHGWLASSSFTVAMKLAPNRDKFMEVISGTGDINADIEKFCTTFSPFLKENHNFLASVGLDDMKAS

SEQ ID NO: 4568 - DNA, 609 bp, Sorghum bicolor
  misc_feature (1)..(609): useful for making plants with increased salt and oxidative stress resistance as described in USSN 12/922,143
  misc_feature (1)..(609): Ceres Annot ID no. 8735098
atggcagagacggtgttcaccccctctctggaagggatgaagcatgtcaaggcagagaacggagtcattctcaccaagcccttccttgatgtctgcaagcaaatcctgcctgtcctggataaatttggagctgctatggcacttgtaaaaactgatatcggtggcaatatcacaagactggaaacaaagtattcttcagatccatcaaagtatgaacacttgtacagcatggttcaggaagaagttcaaaacaagacagcaaaaggttcctcaagctgcacaaatgggcttctgtggctcacgagggccatggatttccttgttgagttgtttcgtaaccttcttgagcatgcagactggaccatgactcaagcttgcactgattcatacaccaagactctgaagaaatttcatggctggcttgccagttctagttttacggtggccatgcggctcgctcctaatagagataaatttatggaggtcattagtggaactggtgacatcaatgcagatattgagaaattttgcacaaccttctctcctttcctcaaagaaaatcatgaatttctggcgagcgttggtcttgatgacatgaaggcttcatag

SEQ ID NO: 4569 - protein, 202 aa, Sorghum bicolor
  misc_feature (1)..(202): useful for making plants with increased salt and oxidative stress resistance as described in USSN 12/922,143
  misc_feature (1)..(202): Ceres Annot ID no. 8735098
  misc_feature (1)..(202): Bit score of 554.2 for hmm based on sequences of FIGURE 13.
  misc_feature (10)..(198): Pfam Name: GLTP Pfam Description: Glycolipid transfer protein (GLTP)
  misc_feature (1)..(202): Functional Homolog Of SEQ ID NO. 697
MAETVFTPSLEGMKHVKAENGVILTKPFLDVCKQILPVLDKFGAAMALVKTDIGGNITRLETKYSSDPSKYEHLYSMVQEEVQNKTAKGSSSCTNGLLWLTRAMDFLVELFRNLLEHADWTMTQACTDSYTKTLKKFHGWLASSSFTVAMRLAPNRDKFMEVISGTGDINADIEKFCTTFSPFLKENHEFLASVGLDDMKAS

SEQ ID NO: 4570 - protein, 202 aa, Vitis vinifera
  misc_feature (1)..(202): useful for making plants with increased salt and oxidative stress resistance as described in USSN 12/922,143
  misc_feature (1)..(202): Public GI ID no. 157336747
  misc_feature (1)..(202): Bit score of 512.6 for hmm based on sequences of FIGURE 13.
  misc_feature (10)..(198): Pfam Name: GLTP Pfam Description: Glycolipid transfer protein (GLTP)
  misc_feature (1)..(202): Functional Homolog Of SEQ ID NO. 697
MEGSVFTPSLEGMKHVKSETGEMLTKPFLDVCKLILPVIDKFGAAMALVKSDIGGNISRLEDKYSSNPTEFNLLYSMVEVEVAAKTAKGSSSCTNGLLWLTRAMEFLVELFHNLLQHPDWTMSQVCTDSYGKTLKQWHGWLASSSFSLAMKLAPDRKKFMDVISGTGDVNADMEAFCTSFSPFLEENHKFLASKGLDNLKAS

SEQ ID NO: 4571 - protein, 244 aa, Vitis vinifera
  misc_feature (1)..(244): useful for making plants with increased salt and oxidative stress resistance as described in USSN 12/922,143
  misc_feature (1)..(244): Public GI ID no. 157335039
  misc_feature (1)..(244): Bit score of 156.2 for hmm based on sequences of FIGURE 13.
  misc_feature (26)..(216): Pfam Name: GLTP Pfam Description: Glycolipid transfer protein (GLTP)
  misc_feature (1)..(244): Functional Homolog Of SEQ ID NO. 697
MEKGSEIRSAIEELSMVVKVKTGEDHDAAVHVPHDTAHIPTGPFLSVCNSIRLVLDKIGPTMAVLRQDVHQNIQRLEMAHESNPSKYSNFVEMLKKEVNEGNARKGASCCKAFVWLTRSMDFMAALLQRLAKDPRQSMEQAVEESYSIALKPWHGWISSAAFKVALKLVPDDKTFITLLLAKDENLDTLQEEMQALTSLLVPFLEEIHSILVSLHSCCLTTCLTWYITHLFLLLSNSAGIIRLG

SEQ ID NO: 4572 - protein, 204 aa, Physcomitrella patens subsp. patens
  misc_feature (1)..(204): useful for making plants with increased salt and oxidative stress resistance as described in USSN 12/922,143
  misc_feature (1)..(204): Public GI ID no. 168030784
  misc_feature (1)..(204): Bit score of 397.0 for hmm based on sequences of FIGURE 13.
  misc_feature (13)..(200): Pfam Name: GLTP Pfam Description: Glycolipid transfer protein (GLTP)
  misc_feature (1)..(204): Functional Homolog Of SEQ ID NO. 697
MAEQTVTVFGPALELMKSVKSPEGEMLTKPFLDVCRNVLPVIDKFGSSMALVKSDVGGNISRLDAKYDSDPSANSLLYDIVRAEVAAKTAKGSSSCSNGMLWLTRAMDFLVELFRNLNDHSDWTMSQCATAAYTSTLKKYHGWIASTAFTVAMKLVPERSKFYETLALGNSTADMERFVTEFSPILAENHEFLKSVNLDDLKAS

SEQ ID NO: 4573 - DNA, 704 bp, Brassica napus
  misc_feature (1)..(704): useful for making plants with increased drought tolerance as described in USSN 11/241,685
  misc_feature (1)..(704): Ceres Seq. ID no. 12475607
  misc_feature (485)..(485): n is a, c, t, g, unknown, or other
  misc_feature (511)..(511): n is a, c, t, g, unknown, or other
accaaaaacatcaccggagaatctgacggcggcttagcagcgactgctactgcaaaaagattgtttatcttcttggggtattttacttacctttggaagaaacataacgtcttttgcggtagctaaaagctaagctcggtcgttatatatacatattttataagtactgcactatttaaaataacacaatggcagctgctcgttcactctccggcgccgttaaatctctttgctccgccgcatcccacaacatttctggttccattgtcttgaggaggagttacgttgcgacagtaccaggatttggtaagggaggttccacaagagttacggtggggaagatggaacaaagagcaaatcaagaggcagagtctgcgtgggccccggatccagttacgggatactacaggccatctaatcgtgcggatgagattgatccagcggagctgcgtgagatgcttttgaaaaacaaagccaagcctttntgaggatttcaatttggttggttccnctagactatgttgtaagggattcctgtttgttatgttcgtcttaaatatctatcttttggagtttaaagtaaaataaagatactatatatttcagttcgtatgagttcacgtttcttgtagttaaatctcgacagcatgaaaaacaacaaagatcccatactgccacgattagcttggtggcttttcctacct

SEQ ID NO: 4574 - protein, 99 aa, Brassica napus
  misc_feature (1)..(99): useful for making plants with increased drought tolerance as described in USSN 11/241,685
  misc_feature (1)..(99): Ceres Seq. ID no. 12475608
  misc_feature (3)..(93): PFAM Description: Late embryogenesis abundant protein
  misc_feature (4)..(96): GI NO: 1370589 NR DESCRIPTION: protein induced upon tuberization
  misc_feature (4)..(96): GI NO: 7489029 NR DESCRIPTION: late-embryogenesis protein homolog
  misc_feature (29)..(95): GI NO: 25044821 NR DESCRIPTION: late-embryogenesis abundant protein-like protein
  misc_feature (29)..(97): GI NO: 34894580 NR DESCRIPTION: zinc-induced protein-like
  misc_feature (99)..(99): Xaa is any aa, unknown or other
MAAARSLSGAVKSLCSAASHNISGSIVLRRSYVATVPGFGKGGSTRVTVGKMEQRANQEAESAWAPDPVTGYYRPSNRADEIDPAELREMLLKNKAKPX

SEQ ID NO: 4575 - DNA, 438 bp, Brassica napus
  misc_feature (1)..(438): useful for making plants with increased drought tolerance as described in USSN 11/241,685
  misc_feature (1)..(438): Ceres Seq. ID no. 6421618
attgttcttttggaaaataaactgaagaactagtaacagaaggctgacgcgctgacgtatcggcatttagagagagagaaaatctctttatatatgttgtgtggtgtcggtctgtgaggagtaggaaataatatacaaaatcaaaggttaagaaaaaaaatgggtgaggagaagaatcagcagcacttcgtgctagtacatggtgcatgccacggcgcgtggtgctggaacaaggttaagccgcttctcgaggcctccggccaccgcgtaaccgccttagacctagctgcttcgggtatagacacaaccaggtctatcactgagatctccacatgcgaacaatactctgagccattgatacagctaatcgcctcattaccaagtgatgagaaggttgtgctcgttggtcatagctttggagggttcagcttagccatg

SEQ ID NO: 4576 - protein, 93 aa, Brassica napus
  misc_feature (1)..(93): useful for making plants with increased drought tolerance as described in USSN 11/241,685
  misc_feature (1)..(93): Ceres Seq. ID no. 6421619
  misc_feature (35)..(92): PFAM Description: alpha/beta hydrolase fold
  misc_feature (1)..(92): GI NO: 21554666 NR DESCRIPTION: putative acetone-cyanohydrin lyase
  misc_feature (1)..(92): GI NO: 7488034 NR DESCRIPTION: probable (S)-acetone-cyanohydrin lyase
  misc_feature (1)..(92): GI NO: 27754457 NR DESCRIPTION: putative acetone-cyanohydrin lyase
  misc_feature (5)..(92): GI NO: 40549303 NR DESCRIPTION: salicylic acid-binding protein 2
  misc_feature (2)..(92): GI NO: 34907174 NR DESCRIPTION: putative pir7b (Pseudomonas inducible protein)
  misc_feature (7)..(92): GI NO: 14279437 NR DESCRIPTION: ethylene-induced esterase
  misc_feature (5)..(92): GI NO: 15028131 NR DESCRIPTION: putative alpha-hydroxynitrile lyase
  misc_feature (1)..(92): GI NO: 28393451 NR DESCRIPTION: putative acetone-cyanohydrin lyase
  misc_feature (10)..(92): GI NO: 2780225 NR DESCRIPTION: alpha-hydroxynitrile lyase
  misc_feature (5)..(92): GI NO: 16648679 NR DESCRIPTION: AT5g10300/F18D22_70
MGEEKNQQHFVLVHGACHGAWCWNKVKPLLEASGHRVTALDLAASGIDTTRSITEISTCEQYSEPLIQLIASLPSDEKVVLVGHSFGGFSLAM

SEQ ID NO: 4577 - DNA, 457 bp, Brassica napus
  misc_feature (1)..(457): useful for making plants with increased drought tolerance as described in USSN 11/241,685
  misc_feature (1)..(457): Ceres Seq. ID no. 6424418
aagaacatctcaaacacttctattcttcattcattcaatattttgaccaacacacacacatataatcatttgtcctcataaaccctaaaccctacctagttccaacaactctctagttccaaactcaagaaaaaaaaagaggttagtttcataagcaatggccaaagttgggaagctgacaaagctcaagtcggccataaagaaatggccttccttcgccaagaatcaccaccactcgtcctcctccgctgccgtctccgatgagctctcagaggacaacaatctccatgttgtttatgttggtcagactcgaagaccttacatgcttagaccggacatcatctctcacccactttttcaagaactggtggatcggtcttctagatccgtggaacatgatcgtgagattgttgtatcttgtgaagttgttttgttcgagcatttgttgtggatgctc

SEQ ID NO: 4578 - protein, 100 aa, Brassica napus
  misc_feature (1)..(100): useful for making plants with increased drought tolerance as described in USSN 11/241,685
  misc_feature (1)..(100): Ceres Seq. ID no. 6424419
  misc_feature (10)..(99): PFAM Description: Auxin responsive protein
  misc_feature (1)..(99): GI NO: 21554070 NR DESCRIPTION: unknown
  misc_feature (1)..(99): GI NO: 15242071 NR DESCRIPTION: putative protein; protein id: At5g20820.1
  misc_feature (1)..(99): GI NO: 50946385 NR DESCRIPTION: auxin-induced protein-related-like protein
  misc_feature (35)..(99): GI NO: 21536952 NR DESCRIPTION: unknown
MAKVGKLTKLKSAIKKWPSFAKNHHHSSSSAAVSDELSEDNNLHVVYVGQTRRPYMLRPDIISHPLFQELVDRSSRSVEHDREIVVSCEVVLFEHLLWML

SEQ ID NO: 4579 - protein, 65 aa, Brassica napus
  misc_feature (1)..(65): useful for making plants with increased drought tolerance as described in USSN 11/241,685
  misc_feature (1)..(65): Ceres Seq. ID no. 6424420
MSSQRTTISMLFMLVRLEDLTCLDRTSSLTHFFKNWWIGLLDPWNMIVRLLYLVKLFCSSICCGC

SEQ ID NO: 4580 - protein, 56 aa, Brassica napus
  misc_feature (1)..(56): useful for making plants with increased drought tolerance as described in USSN 11/241,685
  misc_feature (1)..(56): Ceres Seq. ID no. 6424421
MLFMLVRLEDLTCLDRTSSLTHFFKNWWIGLLDPWNMIVRLLYLVKLFCSSICCGC

SEQ ID NO: 4581 - DNA, 503 bp, Brassica napus
  misc_feature (1)..(503): useful for making plants with increased drought tolerance as described in USSN 11/241,685
  misc_feature (1)..(503): Ceres Seq. ID no. 6422420
aagaacatctcaaacacttctattcttcattcattgaaatattttgaccaacacacacacatataatcatttgtcctcataaaccctaaaccttacctagttccaacaactctctagttccaaatccaagaaaaagaggttagtttcataagcaatggccaaagttgggaagctgacaaagctcaagtcggccataaagaaatggccttccttcgccaagaaccaccaccactcatcctcctccgccgctgtatccgacgagctctcagaggacaacaatctccatgttgtttatgttggtcagactcgaagaccttacatgcttagaccagacatcatctctcacccactttttcaagaactggtcaagaaggaggatccgttggaacatgatcgtgagattgttgtagcttgtgaagttgttttgttcgagcacttgttgtggatgctcaagactggtcaagaaggaggatccgttgaagaattggctgagttctatactt

SEQ ID NO: 4582 - protein, 116 aa, Brassica napus
  misc_feature (1)..(116): useful for making plants with increased drought tolerance as described in USSN 11/241,685
  misc_feature (1)..(116): Ceres Seq. ID no. 6422421
  misc_feature (10)..(100): PFAM Description: Auxin responsive protein
  misc_feature (1)..(115): GI NO: 21554070 NR DESCRIPTION: unknown
  misc_feature (1)..(115): GI NO: 15242071 NR DESCRIPTION: putative protein; protein id: At5g20820.1
  misc_feature (1)..(115): GI NO: 50946385 NR DESCRIPTION: auxin-induced protein-related-like protein
  misc_feature (35)..(114): GI NO: 21536952 NR DESCRIPTION: unknown
MAKVGKLTKLKSAIKKWPSFAKNHHHSSSSAAVSDELSEDNNLHVVYVGQTRRPYMLRPDIISHPLFQELVKKEDPLEHDREIVVACEVVLFEHLLWMLKTGQEGGSVEELAEFYT

SEQ ID NO: 4583 - protein, 61 aa, Brassica napus
  misc_feature (1)..(61): useful for making plants with increased drought tolerance as described in USSN 11/241,685
  misc_feature (1)..(61): Ceres Seq. ID no. 6422422
  misc_feature (1)..(60): GI NO: 21554070 NR DESCRIPTION: unknown
  misc_feature (1)..(60): GI NO: 15242071 NR DESCRIPTION: putative protein; protein id: At5g20820.1
  misc_feature (1)..(60): GI NO: 50946385 NR DESCRIPTION: auxin-induced protein-related-like protein
  misc_feature (1)..(59): GI NO: 21536952 NR DESCRIPTION: unknown
MLRPDIISHPLFQELVKKEDPLEHDREIVVACEVVLFEHLLWMLKTGQEGGSVEELAEFYT

SEQ ID NO: 4584 - DNA, 939 bp, Arabidopsis thaliana
  misc_feature (1)..(939): useful for making plants with increased drought tolerance as described in USSN 11/241,685
  misc_feature (1)..(939): Ceres Seq. ID no. 12333678
  misc_feature (1)..(939): Phenotype: Soil drought tolerant Useful for making plants with increased tolerance to drought
aaaaagtacgaaaggaaaatatgagtgaggagaagaggaagcaacacttcgtgctagtacatggtgcgtgccacggcgcatggtgctggtacaaggttaagcctcttctcgaggctttgggccatcgtgtaaccgccttagacctagctgcttccggtatagacacaaccaggtcaatcactgacatttctacatgtgaacaatattctgagccattgatgcagctaatgacttcattgccgaatgatgagaaggttgtactcgttggtcatagctttggaggtttgagtttagccttagccatggataagtttcccgataaaatctctgtctctgtcttcgtgactgcattcatgcccgacaccaaacactcaccatcgttcgtcgaggaaaagtttgcaagcagcatgacaccagaaggatggatgggctctgagctcgagacatatggttcagataattccggcttgtctgtgttcttcagcaccgacttcatgaagcaccgtctctaccaactttctcctgtggaggatcttgagcttggattgcttctaaagaggcctagttcattgtttattaatgaattatcgaagatggagaacttttctgagaaagggtatggatctgttcctcgagcttacattgtgtgcaaagaggacaacattatctcggaagaccatcaacgatggatgatccataattatccggcgaatttagtgattgagatggaagagactgatcatatgccaatgttttgcaaacctcaactactaagtgaccatctattggcaatcgctgacaatttctgttaaataatattttgatgaaaatgtatttggagtggatacaatcaaacgtgttctaaaatggatcttcataaaggttcaaacttatttcttagttcttactatggttgaaatgagaaacctaagtcaatcg

SEQ ID NO: 4585 - protein, 269 aa, Arabidopsis thaliana
  misc_feature (1)..(269): useful for making plants with increased drought tolerance as described in USSN 11/241,685
  misc_feature (1)..(269): Ceres Seq. ID no. 12333679
  misc_feature (41)..(263): PFAM Description: alpha/beta hydrolase fold
  misc_feature (7)..(268): GI NO: 21554666 NR DESCRIPTION: putative acetone-cyanohydrin lyase
  misc_feature (7)..(268): GI NO: 27754457 NR DESCRIPTION: putative acetone-cyanohydrin lyase
  misc_feature (13)..(265): GI NO: 14279437 NR DESCRIPTION: ethylene-induced esterase
  misc_feature (11)..(268): GI NO: 40549303 NR DESCRIPTION: salicylic acid-binding protein 2
  misc_feature (6)..(265): GI NO: 21595837 NR DESCRIPTION: polyneuridine aldehyde esterase
  misc_feature (9)..(265): GI NO: 25404802 NR DESCRIPTION: probable alpha/beta hydrolase F23O10.18
  misc_feature (49)..(249): GI NO: 25518436 NR DESCRIPTION: hypothetical protein T1K7.26
  misc_feature (16)..(124): GI NO: 21222782 NR DESCRIPTION: putative esterase
  misc_feature (63)..(265): GI NO: 46324511 NR DESCRIPTION: COG0596: Predicted hydrolases or acyltransferases
  misc_feature (6)..(54): GI NO: 46324511 NR DESCRIPTION: COG0596: Predicted hydrolases or acyltransferases
KVRKENMSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQLLSDHLLAIADNFC

SEQ ID NO: 4586 - protein, 263 aa, Arabidopsis thaliana
  misc_feature (1)..(263): useful for making plants with increased drought tolerance as described in USSN 11/241,685
  misc_feature (1)..(263): Ceres Seq. ID no. 12333680
  misc_feature (35)..(257): PFAM Description: alpha/beta hydrolase fold
  misc_feature (1)..(262): GI NO: 21554666 NR DESCRIPTION: putative acetone-cyanohydrin lyase
  misc_feature (1)..(262): GI NO: 27754457 NR DESCRIPTION: putative acetone-cyanohydrin lyase
  misc_feature (7)..(259): GI NO: 14279437 NR DESCRIPTION: ethylene-induced esterase
  misc_feature (5)..(262): GI NO: 40549303 NR DESCRIPTION: salicylic acid-binding protein 2
  misc_feature (1)..(259): GI NO: 21595837 NR DESCRIPTION: polyneuridine aldehyde esterase
  misc_feature (3)..(259): GI NO: 25404802 NR DESCRIPTION: probable alpha/beta hydrolase F23O10.18
  misc_feature (43)..(243): GI NO: 25518436 NR DESCRIPTION: hypothetical protein T1K7.26
  misc_feature (10)..(118): GI NO: 21222782 NR DESCRIPTION: putative esterase
  misc_feature (57)..(259): GI NO: 46324511 NR DESCRIPTION: COG0596: Predicted hydrolases or acyltransferases
  misc_feature (1)..(48): GI NO: 46324511 NR DESCRIPTION: COG0596: Predicted hydrolases or acyltransferases
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQLLSDHLLAIADNFC

SEQ ID NO: 4587 - protein, 197 aa, Arabidopsis thaliana
  misc_feature (1)..(197): useful for making plants with increased drought tolerance as described in USSN 11/241,685
  misc_feature (1)..(197): Ceres Seq. ID no. 12333681
  misc_feature (1)..(191): PFAM Description: alpha/beta hydrolase fold
  misc_feature (1)..(196): GI NO: 21554666 NR DESCRIPTION: putative acetone-cyanohydrin lyase
  misc_feature (1)..(196): GI NO: 27754457 NR DESCRIPTION: putative acetone-cyanohydrin lyase
  misc_feature (1)..(193): GI NO: 14279437 NR DESCRIPTION: ethylene-induced esterase
  misc_feature (1)..(196): GI NO: 40549303 NR DESCRIPTION: salicylic acid-binding protein 2
  misc_feature (1)..(193): GI NO: 21595837 NR DESCRIPTION: polyneuridine aldehyde esterase
  misc_feature (1)..(193): GI NO: 25404802 NR DESCRIPTION: probable alpha/beta hydrolase F23O10.18
  misc_feature (1)..(177): GI NO: 25518436 NR DESCRIPTION: hypothetical protein T1K7.26
  misc_feature (1)..(52): GI NO: 21222782 NR DESCRIPTION: putative esterase
  misc_feature (1)..(193): GI NO: 46324511 NR DESCRIPTION: COG0596: Predicted hydrolases or acyltransferases
  misc_feature (12)..(47): GI NO: 7672985 NR DESCRIPTION: EstC
MQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQLLSDHLLAIADNFC

SEQ ID NO: 4588 - DNA, 586 bp, Arabidopsis thaliana
  misc_feature (1)..(586): useful for making plants with increased drought tolerance as described in USSN 11/241,685
  misc_feature (1)..(586): Ceres Seq. ID no. 12393104
  misc_feature (1)..(586): Phenotype: Soil drought tolerant Useful for making plants with increased tolerance to drought
agtttcaacaactctcttgttccaaccccaagaaaaaagttcaatttcgttagcaatggccaaagttgggaagctgacaaagcttaagtcggctatgaagaaatggccttctttcgccaagaaccaccaccactcaacctcctcagccgctgtttccgacgaactctcagaagacaacaatctccatgtggtttacgttggtcaaactcgaagaccttacatgcttagaccagacatcatctctcacccactctttcaagaactcgtggatcggtcttcttctagatccatcgaacaagatcgtgagattgttgtagcttgtgaagtcgttttgttcgagcacttgctgtggatgctcaagtctggtcaagaaggaggatccgttgaagaattggctgagttctatacttattgacatcgaccgattgattttatacacttatttcgtataatatataccttttttgttattgtttgttgttgctgatttgtattttcattcgatgcggtgtgtgatcaaaacgtgatctcgtaaaccatgtcatttgcttccgtttttctgagcaattttatgatgatgatgagc

SEQ ID NO: 4589 - protein, 137 aa, Arabidopsis thaliana
  misc_feature (1)..(137): useful for making plants with increased drought tolerance as described in USSN 11/241,685
  misc_feature (1)..(137): Ceres Seq. ID no. 12393105
  misc_feature (28)..(120): PFAM Description: Auxin responsive protein
  misc_feature (19)..(135): GI NO: 21554070 NR DESCRIPTION: unknown
  misc_feature (19)..(135): GI NO: 15242071 NR DESCRIPTION: putative protein; protein id: At5g20820.1
  misc_feature (19)..(135): GI NO: 50946385 NR DESCRIPTION: auxin-induced protein-related-like protein
  misc_feature (53)..(134): GI NO: 21536952 NR DESCRIPTION: unknown
VSTTLLFQPQEKSSISLAMAKVGKLTKLKSAMKKWPSFAKNHHHSTSSAAVSDELSEDNNLHVVYVGQTRRPYMLRPDIISHPLFQELVDRSSSRSIEQDREIVVACEVVLFEHLLWMLKSGQEGGSVEELAEFYTY

SEQ ID NO: 4590 - protein, 119 aa, Arabidopsis thaliana; identical to SEQ ID NO: 2080
  misc_feature (1)..(119): useful for making plants with increased drought tolerance as described in USSN 11/241,685
  misc_feature (1)..(119): Ceres Seq. ID no. 12393106
  misc_feature (10)..(102): PFAM Description: Auxin responsive protein
  misc_feature (1)..(117): GI NO: 21554070 NR DESCRIPTION: unknown
  misc_feature (1)..(117): GI NO: 15242071 NR DESCRIPTION: putative protein; protein id: At5g20820.1
  misc_feature (1)..(117): GI NO: 50946385 NR DESCRIPTION: auxin-induced protein-related-like protein
  misc_feature (35)..(116): GI NO: 21536952 NR DESCRIPTION: unknown

SEQ ID NO: 4591 - protein, 106 aa, Arabidopsis thaliana
  misc_feature (1)..(106): useful for making plants with increased drought tolerance as described in USSN 11/241,685
  misc_feature (1)..(106): Ceres Seq. ID no. 12393107
  misc_feature (1)..(89): PFAM Description: Auxin responsive protein
  misc_feature (1)..(104): GI NO: 21554070 NR DESCRIPTION: unknown
  misc_feature (1)..(104): GI NO: 15242071 NR DESCRIPTION: putative protein; protein id: At5g20820.1
  misc_feature (1)..(104): GI NO: 50946385 NR DESCRIPTION: auxin-induced protein-related-like protein
  misc_feature (22)..(103): GI NO: 21536952 NR DESCRIPTION: unknown
MKKWPSFAKNHHHSTSSAAVSDELSEDNNLHVVYVGQTRRPYMLRPDIISHPLFQELVDRSSSRSIEQDREIVVACEVVLFEHLLWMLKSGQEGGSVEELAEFYTY

SEQ ID NO: 4592 - DNA, 633 bp, Arabidopsis thaliana
  misc_feature (1)..(633): useful for making plants with increased drought tolerance as described in USSN 11/241,685
  misc_feature (1)..(633): Ceres Seq. ID no. 12420738
  misc_feature (1)..(633): Phenotype: Soil drought tolerant Useful for making plants with increased tolerance to drought
tcgaaaaaccatcaccggggaatctgacggcggcttagtaccggcggctactgcaaaaaggattgtgttcttcttaggcttgatacttgccttgggaagaatataacaatcatttttgcggtagctaaaacgctaagctctatcgtcatatctttatcattaatacttatttgatatctaaatatcataaaaatggccgctcgttcactctccggtgccgttaaatctctttgctccgccgcatccggaagtctgtcttgttccattgtcttaaggaggagttacgttgctacatcgcagaatgtaacagcagcaggattgagtaagggaggttccaccagagttatggtggggaagatggaacagagaggtttagatcaagaggcagagtctgcttggggaccagatccagttactggatactatagaccttccaatcgtgcggctgaaattgatccagctgagctcagagaattgcttttgaaaaacaaagcaaagtctttctgaggattttgattggttggttgacttggttccagtggaaggttgtcgtaggcgactattatgattatgtgtgtttatgtttgtcttgtatcaactattaagtaaaaataaagatcacattaactagtc

SEQ ID NO: 4593 - protein, 104 aa, Arabidopsis thaliana
  misc_feature (1)..(104): useful for making plants with increased drought tolerance as described in USSN 11/241,685
  misc_feature (1)..(104): Ceres Seq. ID no. 12420739
  misc_feature (2)..(98): PFAM Description: Late embryogenesis abundant protein
  misc_feature (3)..(103): GI NO: 1370589 NR DESCRIPTION: protein induced upon tuberization
  misc_feature (3)..(103): GI NO: 7489029 NR DESCRIPTION: late-embryogenesis protein homolog
  misc_feature (3)..(99): GI NO: 7488660 NR DESCRIPTION: desiccation protective protein LEA5
  misc_feature (17)..(102): GI NO: 34894580 NR DESCRIPTION: zinc-induced protein-like
MAARSLSGAVKSLCSAASGSLSCSIVLRRSYVATSQNVTAAGLSKGGSTRVMVGKMEQRGLDQEAESAWGPDPVTGYYRPSNRAAEIDPAELRELLLKNKAKSF

SEQ ID NO: 4594 - protein, 53 aa, Arabidopsis thaliana
  misc_feature (1)..(53): useful for making plants with increased drought tolerance as described in USSN 11/241,685
  misc_feature (1)..(53): Ceres Seq. ID no. 12420740
  misc_feature (1)..(52): GI NO: 1370589 NR DESCRIPTION: protein induced upon tuberization
  misc_feature (1)..(52): GI NO: 7489029 NR DESCRIPTION: late-embryogenesis protein homolog
  misc_feature (1)..(48): GI NO: 7488660 NR DESCRIPTION: desiccation protective protein LEA5
  misc_feature (1)..(51): GI NO: 34894580 NR DESCRIPTION: zinc-induced protein-like
MVGKMEQRGLDQEAESAWGPDPVTGYYRPSNRAAEIDPAELRELLLKNKAKSF

SEQ ID NO: 4595 - DNA, 1325 bp, Arabidopsis thaliana
  misc_feature (1)..(1325): useful for making plants with increased drought tolerance as described in USSN 11/241,685
  misc_feature (1)..(1325): Ceres Seq. ID no. 12562714
acgaaaggaaaatatgagtgaggagaagaggaagcaacacttcgtgctagtacatggtgcgtgccacggcgcatggtgctggtacaaggttaagcctcttctcgaggctttgggccatcgtgtaaccgccttagacctagctgcttccggtatagacacaaccaggtcaatcactgacatttctacatgtgaacaatattctgagccattgatgcagctaatgacttcattgccgaatgatgagaaggttgtactcgttggtcatagctttggaggtttgagtttagccttagccatggataagtttcccgataaaatctctgtctctgtcttcgtgactgcattcatgcccgacaccaaacactcaccatcgttcgtcgaggaaaaggtatatatctctttttaaagcagccaaattttgtgttctgttcttaaatccaccacctggaagtctagacggtcaaaacaacgtggtcgtccatttttagccaaaaccgttacaagattgtagccaaaattattacaaaaattgatcaacataacggttccttttggtctatatgtccgattgttcagtctagtcggacaaaatcgagatttccatttcgcagtcttttataacttgtggcttatatactataaccaattaaccatagatcatgtgttagacaatctaatgtccaagtagtgtcactttcgtggtgatgagttagtaatttgttttaacatgtttcattttcatggttgttacttcgttagaatttttaaaggtagttaattgtaataaacgtgaaaataaatatgattttttcgtaattactatgaaaaagtttgcaagcagcatgacaccagaaggatggatgggctctgagctcgagacatatggttcagataattccggcttgtctgtgttcttcagcaccgacttcatgaagcaccgtctctaccaactttctcctgtggaggatcttgagcttggattgcttctaaagaggcctagttcattgtttattaatgaattatcgaagatggagaacttttcttagaaagggtatggatctgttcctcgagcttacattgtgtgcaaagaggacaacattatctcggaagaccatcaacgatggatgatccataattatccggcgaatttagtgattgagatggaagagacggatcatatgccaatgttttgcaaacctcaagtactaagtgaccatctattggcaatcgctgacaatttctcttaaataatattttgatgaaaatgtatttggagtggatacaataaaaatgtgttctaaattaatggatctttatgaaggtcc

SEQ ID NO: 4596 - protein, 134 aa, Arabidopsis thaliana
  misc_feature (1)..(134): useful for making plants with increased drought tolerance as described in USSN 11/241,685
  misc_feature (1)..(134): Ceres Seq. ID no. 12562715
  misc_feature (39)..(129): PFAM Description: alpha/beta hydrolase fold
  misc_feature (5)..(129): GI NO: 21554666 NR DESCRIPTION: putative acetone-cyanohydrin lyase
  misc_feature (5)..(129): GI NO: 27754457 NR DESCRIPTION: putative acetone-cyanohydrin lyase
  misc_feature (11)..(129): GI NO: 14279437 NR DESCRIPTION: ethylene-induced esterase
  misc_feature (9)..(129): GI NO: 40549303 NR DESCRIPTION: salicylic acid-binding protein 2
  misc_feature (4)..(128): GI NO: 21595837 NR DESCRIPTION: polyneuridine aldehyde esterase
  misc_feature (7)..(116): GI NO: 25404802 NR DESCRIPTION: probable alpha/beta hydrolase F23O10.18
  misc_feature (47)..(116): GI NO: 25518436 NR DESCRIPTION: hypothetical protein T1K7.26
  misc_feature (14)..(122): GI NO: 21222782 NR DESCRIPTION: putative esterase
  misc_feature (61)..(117): GI NO: 46324511 NR DESCRIPTION: COG0596: Predicted hydrolases or acyltransferases
  misc_feature (4)..(52): GI NO: 46324511 NR DESCRIPTION: COG0596: Predicted hydrolases or acyltransferases
RKENMSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKVYISF

SEQ ID NO: 4597 - protein, 130 aa, Arabidopsis thaliana
  misc_feature (1)..(130): useful for making plants with increased drought tolerance as described in USSN 11/241,685
  misc_feature (1)..(130): Ceres Seq. ID no. 12562716
  misc_feature (35)..(125): PFAM Description: alpha/beta hydrolase fold
  misc_feature (1)..(125): GI NO: 21554666 NR DESCRIPTION: putative acetone-cyanohydrin lyase
  misc_feature (1)..(125): GI NO: 27754457 NR DESCRIPTION: putative acetone-cyanohydrin lyase
  misc_feature (7)..(125): GI NO: 14279437 NR DESCRIPTION: ethylene-induced esterase
  misc_feature (5)..(125): GI NO: 40549303 NR DESCRIPTION: salicylic acid-binding protein 2
  misc_feature (1)..(124): GI NO: 21595837 NR DESCRIPTION: polyneuridine aldehyde esterase
  misc_feature (3)..(112): GI NO: 25404802 NR DESCRIPTION: probable alpha/beta hydrolase F23O10.18
  misc_feature (43)..(112): GI NO: 25518436 NR DESCRIPTION: hypothetical protein T1K7.26
  misc_feature (10)..(118): GI NO: 21222782 NR DESCRIPTION: putative esterase
  misc_feature (57)..(113): GI NO: 46324511 NR DESCRIPTION: COG0596: Predicted hydrolases or acyltransferases
  misc_feature (1)..(48): GI NO: 46324511 NR DESCRIPTION: COG0596: Predicted hydrolases or acyltransferases
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKVYISF

SEQ ID NO: 4598 - protein, 101 aa, Arabidopsis thaliana
  misc_feature (1)..(101): useful for making plants with increased drought tolerance as described in USSN 11/241,685
  misc_feature (1)..(101): Ceres Seq. ID no. 12562717
  misc_feature (29)..(101): PFAM Description: alpha/beta hydrolase fold
  misc_feature (29)..(101): GI NO: 21554666 NR DESCRIPTION: putative acetone-cyanohydrin lyase
  misc_feature (28)..(101): GI NO: 27754457 NR DESCRIPTION: putative acetone-cyanohydrin lyase
  misc_feature (28)..(101): GI NO: 14279437 NR DESCRIPTION: ethylene-induced esterase
  misc_feature (36)..(101): GI NO: 40549303 NR DESCRIPTION: salicylic acid-binding protein 2
  misc_feature (49)..(101): GI NO: 21595837 NR DESCRIPTION: polyneuridine aldehyde esterase
  misc_feature (49)..(101): GI NO: 25518436 NR DESCRIPTION: hypothetical protein T1K7.26
MVVTSLEFLKVVNCNKRENKYDFFVITMKKFASSMTPEGWMGSELETYGSDNSGLSVFFSTDFMKHRLYQLSPVEDLELGLLLKRPSSLFINELSKMENFS

SEQ ID NO: 4599 - DNA, 913 bp, Arabidopsis thaliana
  misc_feature (1)..(913): useful for making plants with increased drought tolerance as described in USSN 11/241,685
  misc_feature (1)..(913): Ceres Seq. ID no. 13503070
gtgtgacttttaggagagtaagaaaatatcgaaggtcagaagaatgagtgaggaaaagaggaaacaacattttgtactagtacatggttcgtgccatggcgcgtggtgctggtacaaggttaagccgctgctagaggcggtgggccaccgcgtaactgctgtggacttagctgcctccggaatagacacaacgaggtcgatcactgacatccccacatgcgaacaatactcggagccattgacgaagctcctgacctcattgccaaatgatgaaaaggttgtgctcgttggtcacagctttggtggcttgaacttagccatagccatggaaaagtttcccgaaaaaatctctgtcgctgtattcttgactgctttcatgccggacaccgaacactcaccatccttcgtcttggacaagtttggaagcaacatgcctcaagaagcatggatgggcaccgaattcgaaccttatggttcagacaattccggactgagtatgttttttagccctgacttcatgaagttgggtctctaccagctttctccagttgaggatcttgaactgggattacttttaatgaggccaggatcgttatttattaacgatttatcgaagatgaaaaacttctcggatgaaggatatgggtctgttcctcgagttttcatagtgtgtaaagaggacaaagcaattccagaagaacgccagagatggatgattgataattttccggtgaatttagtgatggagatggaggagacagatcatatgccaatgttctgcaagcctcagcaactcagtgattacttcctgaaaatcgcggacaaattcgtttaatcaaatcttcatgaaactgtattggatttgatataataaaggtttgttgcaaatgaattaataatgatgaatattttt

SEQ ID NO: 4600 - protein, 263 aa, Arabidopsis thaliana; identical to SEQ ID NO: 2997
  misc_feature (1)..(263): useful for making plants with increased drought tolerance as described in USSN 11/241,685
  misc_feature (1)..(263): Ceres Seq. ID no. 13503071
  misc_feature (35)..(257): PFAM Description: alpha/beta hydrolase fold
  misc_feature (1)..(263): GI NO: 27754457 NR DESCRIPTION: putative acetone-cyanohydrin lyase
  misc_feature (1)..(262): GI NO: 21554666 NR DESCRIPTION: putative acetone-cyanohydrin lyase
  misc_feature (5)..(262): GI NO: 40549303 NR DESCRIPTION: salicylic acid-binding protein 2
  misc_feature (7)..(262): GI NO: 14279437 NR DESCRIPTION: ethylene-induced esterase
  misc_feature (132)..(263): GI NO: 34914024 NR DESCRIPTION: OJ1014_G12.27
  misc_feature (11)..(124): GI NO: 34914024 NR DESCRIPTION: OJ1014_G12.27
  misc_feature (1)..(259): GI NO: 21595837 NR DESCRIPTION: polyneuridine aldehyde esterase
  misc_feature (1)..(259): GI NO: 42562323 NR DESCRIPTION: hydrolase
  misc_feature (3)..(259): GI NO: 25404802 NR DESCRIPTION: probable alpha/beta hydrolase F23O10.18
  misc_feature (40)..(243): GI NO: 25518436 NR DESCRIPTION: hypothetical protein T1K7.26

SEQ ID NO: 4601 - protein, 169 aa, Arabidopsis thaliana
  misc_feature (1)..(169): useful for making plants with increased drought tolerance as described in USSN 11/241,685
  misc_feature (1)..(169): Ceres Seq. ID no. 13503072
  misc_feature (1)..(163): PFAM Description: alpha/beta hydrolase fold
  misc_feature (1)..(169): GI NO: 27754457 NR DESCRIPTION: putative acetone-cyanohydrin lyase
  misc_feature (1)..(168): GI NO: 21554666 NR DESCRIPTION: putative acetone-cyanohydrin lyase
  misc_feature (1)..(168): GI NO: 40549303 NR DESCRIPTION: salicylic acid-binding protein 2
  misc_feature (1)..(168): GI NO: 14279437 NR DESCRIPTION: ethylene-induced esterase
  misc_feature (38)..(169): GI NO: 34914024 NR DESCRIPTION: OJ1014_G12.27
  misc_feature (1)..(30): GI NO: 34914024 NR DESCRIPTION: OJ1014_G12.27
  misc_feature (1)..(165): GI NO: 21595837 NR DESCRIPTION: polyneuridine aldehyde esterase
  misc_feature (1)..(165): GI NO: 42562323 NR DESCRIPTION: hydrolase
  misc_feature (1)..(165): GI NO: 25404802 NR DESCRIPTION: probable alpha/beta hydrolase F23O10.18
  misc_feature (1)..(149): GI NO: 25518436 NR DESCRIPTION: hypothetical protein T1K7.26
MEKFPEKISVAVFLTAFMPDTEHSPSFVLDKFGSNMPQEAWMGTEFEPYGSDNSGLSMFFSPDFMKLGLYQLSPVEDLELGLLLMRPGSLFINDLSKMKNFSDEGYGSVPRVFIVCKEDKAIPEERQRWMIDNFPVNLVMEMEETDHMPMFCKPQQLSDYFLKIADKFV

SEQ ID NO: 4602 - protein, 152 aa, Arabidopsis thaliana
  misc_feature (1)..(152): useful for making plants with increased drought tolerance as described in USSN 11/241,685
  misc_feature (1)..(152): Ceres Seq. ID no. 13503073
  misc_feature (1)..(146): PFAM Description: alpha/beta hydrolase fold
  misc_feature (1)..(152): GI NO: 27754457 NR DESCRIPTION: putative acetone-cyanohydrin lyase
  misc_feature (1)..(151): GI NO: 21554666 NR DESCRIPTION: putative acetone-cyanohydrin lyase
  misc_feature (1)..(151): GI NO: 40549303 NR DESCRIPTION: salicylic acid-binding protein 2
  misc_feature (1)..(151): GI NO: 14279437 NR DESCRIPTION: ethylene-induced esterase
  misc_feature (21)..(152): GI NO: 34914024 NR DESCRIPTION: OJ1014_G12.27
  misc_feature (1)..(13): GI NO: 34914024 NR DESCRIPTION: OJ1014_G12.27
  misc_feature (1)..(148): GI NO: 21595837 NR DESCRIPTION: polyneuridine aldehyde esterase
  misc_feature (1)..(148): GI NO: 42562323 NR DESCRIPTION: hydrolase
  misc_feature (1)..(148): GI NO: 25404802 NR DESCRIPTION: probable alpha/beta hydrolase F23O10.18
  misc_feature (1)..(132): GI NO: 25518436 NR DESCRIPTION: hypothetical protein T1K7.26
MPDTEHSPSFVLDKFGSNMPQEAWMGTEFEPYGSDNSGLSMFFSPDFMKLGLYQLSPVEDLELGLLLMRPGSLFINDLSKMKNFSDEGYGSVPRVFIVCKEDKAIPEERQRWMIDNFPVNLVMEMEETDHMPMFCKPQQLSDYFLKIADKFV

SEQ ID NO: 4603 - DNA, 569 bp, Glycine max
  misc_feature (1)..(569): useful for making plants with increased drought tolerance as described in USSN 11/241,685
  misc_feature (1)..(569): Ceres Seq. ID no. 12432354
cgtgtggtgcgcctcctcacaaatacacacagaaagttgagaggtggtagtagctgctgcggaagcgttcagcagccaatagctttcgcagcagcatcaacaacaaaccaacgattcaaattcaacctcctcattcagatggcacaatctttctcaccagccaaacgcgcccttgccttttcccttcaccggcgagggtacgcagtggcgtctgatgcttctccttcggtgagagggggattggatagcattggaagcaggagtgcaatcgagaagggtgtgacaaaaaacaattcgggcccatcgggggcctcatcagcttgggccccggacccagtgacgggttactacaggcccatcaatcacaccaatgagattgacccggtggagcttcgaaggatgctgttgaaacacaaagtcagatcatcatcctcctcctagagtggcaaggggcaccaacacccacaccttattccatcaaatcaagtttattttgcttttcttgtgtggttttatctatctatttttattttatttttctgaatctatctatcttttcatatctatct

SEQ ID NO: 4604 - protein, 146 aa, Glycine max
  misc_feature (1)..(146): useful for making plants with increased drought tolerance as described in USSN 11/241,685
  misc_feature (1)..(146): Ceres Seq. ID no. 12432355
  misc_feature (47)..(137): PFAM Description: Late embryogenesis abundant protein
  misc_feature (47)..(137): GI NO: 7488660 NR DESCRIPTION: desiccation protective protein LEA5
  misc_feature (47)..(143): GI NO: 7489029 NR DESCRIPTION: late-embryogenesis protein homolog
  misc_feature (47)..(143): GI NO: 1370589 NR DESCRIPTION: protein induced upon tuberization
  misc_feature (54)..(145): GI NO: 34894580 NR DESCRIPTION: zinc-induced protein-like
RVVRLLTNTHRKLRGGSSCCGSVQQPIAFAAASTTNQRFKFNLLIQMAQSFSPAKRALAFSLHRRGYAVASDASPSVRGGLDSIGSRSAIEKGVTKNNSGPSGASSAWAPDPVTGYYRPINHTNEIDPVELRRMLLKHKVRSSSSS

SEQ ID NO: 4605 - protein, 100 aa, Glycine max
  misc_feature (1)..(100): useful for making plants with increased drought tolerance as described in USSN 11/241,685
  misc_feature (1)..(100): Ceres Seq. ID no. 12432356
  misc_feature (1)..(91): PFAM Description: Late embryogenesis abundant protein
  misc_feature (1)..(91): GI NO: 7488660 NR DESCRIPTION: desiccation protective protein LEA5
  misc_feature (1)..(97): GI NO: 7489029 NR DESCRIPTION: late-embryogenesis protein homolog
  misc_feature (1)..(97): GI NO: 1370589 NR DESCRIPTION: protein induced upon tuberization
  misc_feature (8)..(99): GI NO: 34894580 NR DESCRIPTION: zinc-induced protein-like
MAQSFSPAKRALAFSLHRRGYAVASDASPSVRGGLDSIGSRSAIEKGVTKNNSGPSGASSAWAPDPVTGYYRPINHTNEIDPVELRRMLLKHKVRSSSSS

SEQ ID NO: 4606 - DNA, 625 bp, Glycine max
  misc_feature (1)..(625): useful for making plants with increased drought tolerance as described in USSN 11/241,685
  misc_feature (1)..(625): Ceres Seq. ID no. 12399500
cacatgcactctctttctctctgttcttcgttcattttcaagtttgatatttgacatcatcatggcaagaggtggaaaactaatgaagctaaaatcagtgctgaagaaatggaactcattcggcaatggcagcaagcatagccgccaccacagcagcagcgccgtcgccgatgacgagtcctcctccagatcagacctccacgccgtctacgtcggcaagtcccgccgcctctatcgcgtctcctccgacgttgtcgaccaccccgtcttccgggaactcgtcgagagatcccgcgattctgaccaacaacaaaacgaagacactactacgatcaatgtcgtcgcatgcgaggttgtccttttcgaacacttgctctggatgctcgataacgccgacccacaacccgagtcactcaacgaactcgtcgacttctacggttgctaatgctagctactatctatcccataccttccacgtgtccctatcatcccacattattaaaaaaaacacgtatattatattataccacttccgattaatttttataagaaacaagtaattgcagtgtattttacacaaaaacttgtttattataaatagaattggagatatattattgttctt

SEQ ID NO: 4607 - protein, 147 aa, Glycine max
  misc_feature (1)..(147): useful for making plants with increased drought tolerance as described in USSN 11/241,685
  misc_feature (1)..(147): Ceres Seq. ID no. 12399501
  misc_feature (30)..(128): PFAM Description: Auxin responsive protein
  misc_feature (21)..(147): GI NO: 15242071 NR DESCRIPTION: putative protein; protein id: At5g20820.1
  misc_feature (21)..(147): GI NO: 21554070 NR DESCRIPTION: unknown
  misc_feature (21)..(147): GI NO: 50946385 NR DESCRIPTION: auxin-induced protein-related-like protein
  misc_feature (44)..(144): GI NO: 21536952 NR DESCRIPTION: unknown
TCTLFLSVLRSFSSLIFDIIMARGGKLMKLKSVLKKWNSFGNGSKHSRHHSSSAVADDESSSRSDLHAVYVGKSRRLYRVSSDVVDHPVFRELVERSRDSDQQQNEDTTTINVVACEVVLFEHLLWMLDNADPQPESLNELVDFYGC

SEQ ID NO: 4608 - protein, 144 aa, Glycine max
  misc_feature (1)..(144): useful for making plants with increased drought tolerance as described in USSN 11/241,685
  misc_feature (1)..(144): Ceres Seq. ID no. 12399502
  misc_feature (1)..(129): PFAM Description: Herpes virus major outer envelope glycoprotein (BLLF1)
MAASIAATTAAAPSPMTSPPPDQTSTPSTSASPAASIASPPTLSTTPSSGNSSRDPAILTNNKTKTLLRSMSSHARLSFSNTCSGCSITPTHNPSHSTNSSTSTVANASYYLSHTFHVSLSSHIIKKNTYIILYHFRLIFIRNK

SEQ ID NO: 4609 - protein, 129 aa, Glycine max
  misc_feature (1)..(129): useful for making plants with increased drought tolerance as described in USSN 11/241,685
  misc_feature (1)..(129): Ceres Seq. ID no. 12399503
  misc_feature (1)..(114): PFAM Description: Herpes virus major outer envelope glycoprotein (BLLF1)
MTSPPPDQTSTPSTSASPAASIASPPTLSTTPSSGNSSRDPAILTNNKTKTLLRSMSSHARLSFSNTCSGCSITPTHNPSHSTNSSTSTVANASYYLSHTFHVSLSSHIIKKNTYIILYHFRLIFIRNK

SEQ ID NO: 4610 - protein, 127 aa, Glycine max
  misc_feature (1)..(127): useful for making plants with increased drought tolerance as described in USSN 11/241,685
  misc_feature (1)..(127): Ceres Seq. ID no. 12399504
  misc_feature (10)..(108): PFAM Description: Auxin responsive protein
  misc_feature (1)..(127): GI NO: 15242071 NR DESCRIPTION: putative protein; protein id: At5g20820.1
  misc_feature (1)..(127): GI NO: 21554070 NR DESCRIPTION: unknown
  misc_feature (1)..(127): GI NO: 50946385 NR DESCRIPTION: auxin-induced protein-related-like protein
  misc_feature (24)..(124): GI NO: 21536952 NR DESCRIPTION: unknown
MARGGKLMKLKSVLKKWNSFGNGSKHSRHHSSSAVADDESSSRSDLHAVYVGKSRRLYRVSSDVVDHPVFRELVERSRDSDQQQNEDTTTINVVACEVVLFEHLLWMLDNADPQPESLNELVDFYGC

SEQ ID NO: 4611 - DNA, 540 bp, Glycine max
  misc_feature (1)..(540): useful for making plants with increased drought tolerance as described in USSN 11/241,685
  misc_feature (1)..(540): Ceres Seq. ID no. 13643428
  misc_feature (97)..(97): n is a, c, t, g, unknown, or other
acgttctcacaagtcacaacataacaaaaacaacaacaaaatcatctttgctccatcaaattctcaagccatatccaacatgtccaaagcaggaaanactaacgaagctcaagtcagtgctgaggaaatggaactcattcagcaacaaacacagtcaagtcagtgtcatctccgccgtcgcgaacgacggaggtgacacctcatcgctcctcccagtgtatgttgggaggacacgtcggcgttatctcgtgagcgccgatgtagtcggacacccgctcttcagggagctggtgggccggtcccgcgacggctccaaggatgaggacgaggacaccatcaacgtggcgtgcgaggttgtcctattcgagcacttgctctggatgctccacaatgccgatcctcaacccgagtcgctcgatgaactcgccgatttttacgcctgctagctctataattattcctttctcgtgaacaacacagtacgagtgaaagasktttaaattaattgccgttgtaattgttttgatgtacgtacgtgat

SEQ ID NO: 4612 - protein, 147 aa, Glycine max
  misc_feature (1)..(147): useful for making plants with increased drought tolerance as described in USSN 11/241,685
  misc_feature (1)..(147): Ceres Seq. ID no. 13643429
  misc_feature (36)..(128): PFAM Description: Auxin responsive protein
  misc_feature (33)..(147): GI NO: 15242071 NR DESCRIPTION: auxin-induced (indole-3-acetic acid induced) protein-related
  misc_feature (33)..(147): GI NO: 21554070 NR DESCRIPTION: unknown
  misc_feature (33)..(147): GI NO: 50946385 NR DESCRIPTION: auxin-induced protein-related-like protein
  misc_feature (62)..(145): GI NO: 21536952 NR DESCRIPTION: unknown
  misc_feature (32)..(32): Xaa is any aa, unknown or other
VLTSHNITKTTTKSSLLHQILKPYPTCPKQEXLTKLKSVLRKWNSFSNKHSQVSVISAVANDGGDTSSLLPVYVGRTRRRYLVSADVVGHPLFRELVGRSRDGSKDEDEDTINVACEVVLFEHLLWMLHNADPQPESLDELADFYAC

SEQ ID NO: 4613 - DNA, 449 bp, Glycine max
  misc_feature (1)..(449): useful for making plants with increased drought tolerance as described in USSN 11/241,685
  misc_feature (1)..(449): Ceres Seq. ID no. 3456813
agtcatcacactctctctctctctctttccttctctcttttcaactcattgaggcattcatcaaacaccttctcaaaatggccaaagttggaaaactaacaaagctcaagtcagcaatcaagagatggccctcattgaccaggctcagccgcaacagcagcagtgtctcttccaacaaaggggtctctggaaaaggaacatcccttaattcatccaaggaacacgagcatgaacaagaacaacttcgtgcggtttatgttggcaagtctaggaggcggtacctcgtgaactccgaagtgatcgatcaccccgtgtttcaggagctagtggacaggtcttgctcttctaattcttcttcttctcatcatcatgacgatgatggggtggtggtggtgtcstgcgaggtggtgctgttcgarcacttgctgtggatgcttgagagcgaarag

SEQ ID NO: 4614 - protein, 148 aa, Glycine max
  misc_feature (1)..(148): useful for making plants with increased drought tolerance as described in USSN 11/241,685
  misc_feature (1)..(148): Ceres Seq. ID no. 3456814
  misc_feature (32)..(146): PFAM Description: Auxin responsive protein
  misc_feature (26)..(147): GI NO: 50946385 NR DESCRIPTION: auxin-induced protein-related-like protein
  misc_feature (26)..(147): GI NO: 21554070 NR DESCRIPTION: unknown
  misc_feature (26)..(147): GI NO: 15242071 NR DESCRIPTION: putative protein; protein id: At5g20820.1
  misc_feature (45)..(146): GI NO: 21536952 NR DESCRIPTION: unknown
  misc_feature (132)..(132): Xaa is any aa, unknown or other
  misc_feature (139)..(139): Xaa is any aa, unknown or other
SSHSLSLSFLLSFQLIEAFIKHLLKMAKVGKLTKLKSAIKRWPSLTRLSRNSSSVSSNKGVSGKGTSLNSSKEHEHEQEQLRAVYVGKSRRRYLVNSEVIDHPVFQELVDRSCSSNSSSSHHHDDDGVVVVXCEVVLFXHLLWMLESE

SEQ ID NO: 4615 - protein, 123 aa, Glycine max
  misc_feature (1)..(123): useful for making plants with increased drought tolerance as described in USSN 11/241,685
  misc_feature (1)..(123): Ceres Seq. ID no. 3456815
  misc_feature (7)..(121): PFAM Description: Auxin responsive protein
  misc_feature (1)..(122): GI NO: 50946385 NR DESCRIPTION: auxin-induced protein-related-like protein
  misc_feature (1)..(122): GI NO: 21554070 NR DESCRIPTION: unknown
  misc_feature (1)..(122): GI NO: 15242071 NR DESCRIPTION: putative protein; protein id: At5g20820.1
  misc_feature (20)..(121): GI NO: 21536952 NR DESCRIPTION: unknown
  misc_feature (107)..(107): Xaa is any aa, unknown or other
  misc_feature (114)..(114): Xaa is any aa, unknown or other
MAKVGKLTKLKSAIKRWPSLTRLSRNSSSVSSNKGVSGKGTSLNSSKEHEHEQEQLRAVYVGKSRRRYLVNSEVIDHPVFQELVDRSCSSNSSSSHHHDDDGVVVVXCEVVLFXHLLWMLESE

SEQ ID NO: 4616 - DNA, 547 bp, Glycine max
  misc_feature (1)..(547): useful for making plants with increased drought tolerance as described in USSN 11/241,685
  misc_feature (1)..(547): Ceres Seq. ID no. 12448255
  misc_feature (527)..(527): n is a, c, t, g, unknown, or other
aatcactacaaccctaagaagaagaaatcatcatgagttcaaaaaatagtatagataggaagccgaagcactatgttctggtgcatggggcttgctatggagcttggctttggtataagctcaagccacgcttggaatctgcagggcacaaggtcacagtgctcgaccttgcagcttctggaaccaacatgaagaaaattgaagatgttgacactttctcacagtacactgagcctttgttgcagctaatggccacaattcccccaaataagaaggtagttctagttggtcacagtcttggggggctcaacatagcacttgcaatggaaaagttcccagaaaaggttgcagttggtgttttcgtaacagctataattccagacattgaacacaagccatcctatgtcttggaaaagatgctgcatagaattacgtactaaagttcaagactcatgcggaaggaaaaatcaaccgtgggaggagtcttgtcggtgcagtgagataaagtagaataaataaagcatgcnccattcagaaatggcacccc

SEQ ID NO: 4617 - protein, 135 aa, Glycine max
  misc_feature (1)..(135): useful for making plants with increased drought tolerance as described in USSN 11/241,685
  misc_feature (1)..(135): Ceres Seq. ID no. 12448256
  misc_feature (39)..(128): PFAM Description: alpha/beta hydrolase fold
  misc_feature (6)..(134): GI NO: 21554666 NR DESCRIPTION: putative acetone-cyanohydrin lyase
  misc_feature (6)..(130): GI NO: 7488034 NR DESCRIPTION: probable (S)-acetone-cyanohydrin lyase
  misc_feature (7)..(128): GI NO: 14279437 NR DESCRIPTION: ethylene-induced esterase
  misc_feature (6)..(128): GI NO: 27754457 NR DESCRIPTION: putative acetone-cyanohydrin lyase
  misc_feature (9)..(132): GI NO: 40549303 NR DESCRIPTION: salicylic acid-binding protein 2
  misc_feature (14)..(130): GI NO: 2780225 NR DESCRIPTION: alpha-hydroxynitrile lyase
  misc_feature (7)..(130): GI NO: 15028131 NR DESCRIPTION: putative alpha-hydroxynitrile lyase
  misc_feature (13)..(130): GI NO: 631916 NR DESCRIPTION: acetone-cyanhydrin lyase (EC 4.1.2.37)
  misc_feature (7)..(130): GI NO: 16648679 NR DESCRIPTION: AT5g10300/F18D22_70
  misc_feature (8)..(133): GI NO: 28393451 NR DESCRIPTION: putative acetone-cyanohydrin lyase
MSSKNSIDRKPKHYVLVHGACYGAWLWYKLKPRLESAGHKVTVLDLAASGTNMKKIEDVDTFSQYTEPLLQLMATIPPNKKVVLVGHSLGGLNIALAMEKFPEKVAVGVFVTAIIPDIEHKPSYVLEKMLHRITY

SEQ ID NO: 4618 - protein, 83 aa, Glycine max
  misc_feature (1)..(83): useful for making plants with increased drought tolerance as described in USSN 11/241,685
  misc_feature (1)..(83): Ceres Seq. ID no. 12448257
  misc_feature (1)..(76): PFAM Description: alpha/beta hydrolase fold
  misc_feature (1)..(82): GI NO: 21554666 NR DESCRIPTION: putative acetone-cyanohydrin lyase
  misc_feature (1)..(78): GI NO: 7488034 NR DESCRIPTION: probable (S)-acetone-cyanohydrin lyase
  misc_feature (1)..(76): GI NO: 14279437 NR DESCRIPTION: ethylene-induced esterase
  misc_feature (1)..(76): GI NO: 27754457 NR DESCRIPTION: putative acetone-cyanohydrin lyase
  misc_feature (1)..(80): GI NO: 40549303 NR DESCRIPTION: salicylic acid-binding protein 2
  misc_feature (1)..(78): GI NO: 2780225 NR DESCRIPTION: alpha-hydroxynitrile lyase
  misc_feature (1)..(78): GI NO: 15028131 NR DESCRIPTION: putative alpha-hydroxynitrile lyase
  misc_feature (1)..(78): GI NO: 631916 NR DESCRIPTION: acetone-cyanhydrin lyase (EC 4.1.2.37)
  misc_feature (1)..(78): GI NO: 16648679 NR DESCRIPTION: AT5g10300/F18D22_70
  misc_feature (1)..(81): GI NO: 28393451 NR DESCRIPTION: putative acetone-cyanohydrin lyase
MKKIEDVDTFSQYTEPLLQLMATIPPNKKVVLVGHSLGGLNIALAMEKFPEKVAVGVFVTAIIPDIEHKPSYVLEKMLHRITY

SEQ ID NO: 4619 - DNA, 427 bp, Glycine max
  misc_feature (1)..(427): useful for making plants with increased drought tolerance as described in USSN 11/241,685
  misc_feature (1)..(427): Ceres Seq. ID no. 13638578
aagaaacgaagctgctagctgctcggcgcacacatgtcgtcatcctcctcctctgcgccagcggccgccgtggcgacgtcgacccgcctcatcctggtgcacggcacgggccacggcgggtggtgctggtacaaggtcgccaccctcctccgcgccgcggggcaccgcgtcgacgcgccggacctcgcggcctgcggcgccgacgcgcgccggctgagcgacgcgccaaccttcgaggactacacgcgccccctgctcgacgcgctccgggccctcccggacggcgagcgagcggtgctcgtgggccacagcttcggcggcatgagcgtcgcgctcgccgccgaggagttccccgacaaggtcgccgccgccgtgttcctcaccgccttcatgccggactgcgccggcccgcgcacccgcgtcatcg

SEQ ID NO: 4620 - protein, 141 aa, Glycine max
  misc_feature (1)..(141): useful for making plants with increased drought tolerance as described in USSN 11/241,685
  misc_feature (1)..(141): Ceres Seq. ID no. 13638579
  misc_feature (19)..(140): PFAM Description: Subtilase family
ETKLLAARRTHVVILLLCASGRRGDVDPPHPGARHGPRRVVLVQGRHPPPRRGAPRRRAGPRGLRRRRAPAERRANLRGLHAPPARRAPGPPGRRASGARGPQLRRHERRARRRGVPRQGRRRRVPHRLHAGLRRPAHPRH

SEQ ID NO: 4621 - protein, 131 aa, Glycine max
  misc_feature (1)..(131): useful for making plants with increased drought tolerance as described in USSN 11/241,685
  misc_feature (1)..(131): Ceres Seq. ID no. 13638580
  misc_feature (44)..(130): PFAM Description: alpha/beta hydrolase fold
  misc_feature (5)..(130): GI NO: 34915034 NR DESCRIPTION: putative acetone-cyanohydrin lyase
  misc_feature (1)..(130): GI NO: 34914020 NR DESCRIPTION: OJ1014_G12.25
  misc_feature (8)..(130): GI NO: 34914024 NR DESCRIPTION: OJ1014_G12.27
  misc_feature (19)..(122): GI NO: 34908770 NR DESCRIPTION: P0415A04.19
  misc_feature (14)..(127): GI NO: 34907174 NR DESCRIPTION: putative pir7b (Pseudomonas inducible protein)
  misc_feature (14)..(125): GI NO: 34907176 NR DESCRIPTION: pir7b protein (Pseudomonas inducible protein)
  misc_feature (20)..(125): GI NO: 498747 NR DESCRIPTION: Pir7b
  misc_feature (20)..(122): GI NO: 7488034 NR DESCRIPTION: probable (S)-acetone-cyanohydrin lyase
  misc_feature (20)..(125): GI NO: 34907178 NR DESCRIPTION: pir7a protein (Pseudomonas inducible protein)
  misc_feature (20)..(122): GI NO: 27754457 NR DESCRIPTION: putative acetone-cyanohydrin lyase
MSSSSSSAPAAAVATSTRLILVHGTGHGGWCWYKVATLLRAAGHRVDAPDLAACGADARRLSDAPTFEDYTRPLLDALRALPDGERAVLVGHSFGGMSVALAAEEFPDKVAAAVFLTAFMPDCAGPRTRVI

SEQ ID NO: 4622 - protein, 71 aa, Glycine max
  misc_feature (1)..(71): useful for making plants with increased drought tolerance as described in USSN 11/241,685
  misc_feature (1)..(71): Ceres Seq. ID no. 13638581
  misc_feature (1)..(71): PFAM Description: Cupin
  misc_feature (3)..(71): GI NO: 50941143 NR DESCRIPTION: CLAVATA1 receptor kinase( CLV1)-like protein
  misc_feature (6)..(71): GI NO: 29828765 NR DESCRIPTION: putative protoporphyrinogen oxidase
RNEAASCSAHTCRHPPPLRQRPPWRRRPASSWCTARATAGGAGTRSPPSSAPRGTASTRRTSRPAAPTRAG

SEQ ID NO: 4623 - DNA, 626 bp, Glycine max
  misc_feature (1)..(626): useful for making plants with increased drought tolerance as described in USSN 11/241,685
  misc_feature (1)..(626): Ceres Seq. ID no. 12480973
agagagagaacaaagaatcacagaaaggggtggtgtctgcttcgaaagcttaataatttgtttatttccagaacatcatagttttcgcagcagcacactaacacattactcatatcatataataagatggcccgttctctctcgcaagccaaacgtattggtgtccttgttgctcaatctatctccctaattcccgttcatcggcgaggttacgcagtggcatccgatgtatcggtaagagttggattgggtaatattgggcgaaggaatggaatcgtgggaggtgtagaagagaagcctgatacaagagatggttcaaaagcctactcaactgattgggccccagacccagtaacaggttactataggcccattaaccacacccctgaaattgacccggtggagcttcggcataggttgctccgatcacctccactagagcctagaggagttgctggacacccatgacatgcccaaattttacttaggatttggtttggtttggtttggtttggtagggtaaccttgtgttgttgttccacaaaatacaaggttttgttaaacgtttactacttcctatgtaccctagaatctacttttaaggttatggttcttattattagtcc

SEQ ID NO: 4624 - protein, 113 aa, Glycine max
  misc_feature (1)..(113): useful for making plants with increased drought tolerance as described in USSN 11/241,685
  misc_feature (1)..(113): Ceres Seq. ID no. 12480974
  misc_feature (1)..(100): PFAM Description: Late embryogenesis abundant protein
  misc_feature (1)..(113): GI NO: 7488660 NR DESCRIPTION: desiccation protective protein LEA5
  misc_feature (1)..(101): GI NO: 1370589 NR DESCRIPTION: protein induced upon tuberization
  misc_feature (1)..(100): GI NO: 7489029 NR DESCRIPTION: late-embryogenesis protein homolog
  misc_feature (15)..(99): GI NO: 34894580 NR DESCRIPTION: zinc-induced protein-like
MARSLSQAKRIGVLVAQSISLIPVHRRGYAVASDVSVRVGLGNIGRRNGIVGGVEEKPDTRDGSKAYSTDWAPDPVTGYYRPINHTPEIDPVELRHRLLRSPPLEPRGVAGHP

SEQ ID NO: 4625 - protein, 62 aa, Glycine max
  misc_feature (1)..(62): useful for making plants with increased drought tolerance as described in USSN 11/241,685
  misc_feature (1)..(62): Ceres Seq. ID no. 12480975
EREQRITERGGVCFESLIICLFPEHHSFRSSTLTHYSYHIIRWPVLSRKPNVLVSLLLNLSP

SEQ ID NO: 4626 - DNA, 971 bp, Glycine max
  misc_feature (1)..(971): useful for making plants with increased drought tolerance as described in USSN 11/241,685
  misc_feature (1)..(971): Ceres Seq. ID no. 13638849
atccaacacaaaaccaaacaggtcttacgcaacaaatggagagcacccagagcaacacaagcgtgatgaaccatttcatcctggtgcacggcctctgccacggggcctggtgttggtacaaggtggttgcggcgcttcaggcagcggggcaccgtgtcacggcggtcgacctggccgcgtccggcgctcacccggcgcgcatcgacgaggtgcactcgttcgaggagtactcccagcctctgcttgacgtagtggccgcggcgccagagggtgacggcgagaggctgattctggtcgggcacagccacggcgggctcagcttggcgctagccatggagaggttccccggcaaggtcgccgccgccgtgttcgcagccgccgggatgccgtgcgttggcaagcacatgggcgtcaccaccgaggagttcatgcgaaggacatcatcggaaggactcatggactgcaagatgctgccaatcaataacaaccacggtgcaggggttgcaatgataatgggcccaaacttcttagcacacaagaactaccagcaaagttcacctgaggatttggccctggcaaaaatgttggtgagaccgggaaacctgttcatggaggatccggtgatgaaggatgcaagcctgctcaccgataccaactacgggtcggtgaagaaggtatatgtggtagcaaaggctgatggctccagcaccgaggagatgcagcgttggatggtgttgttgagccccggcacggaggctgaggagatcgcgggagctgaccacgccatcatgagctcaaggcctagggagctctgtgatgctctggtcaagatcgccgacagcttaaatacttgctaaattgtacgatatatatccctggaaatcaatgtaggtgtgtacttgattttcatctaaaaataaatatgttcagtgatactattaaatcaatggaaattaagtagtattaccttc

SEQ ID NO: 4627 - protein, 284 aa, Glycine max
  misc_feature (1)..(284): useful for making plants with increased drought tolerance as described in USSN 11/241,685
  misc_feature (1)..(284): Ceres Seq. ID no. 13638850
  misc_feature (50)..(276): PFAM Description: alpha/beta hydrolase fold
  misc_feature (18)..(279): GI NO: 34907176 NR DESCRIPTION: pir7b protein (Pseudomonas inducible protein)
  misc_feature (24)..(279): GI NO: 498747 NR DESCRIPTION: Pir7b
  misc_feature (24)..(278): GI NO: 34907178 NR DESCRIPTION: pir7a protein (Pseudomonas inducible protein)
  misc_feature (24)..(282): GI NO: 40549303 NR DESCRIPTION: salicylic acid-binding protein 2
  misc_feature (24)..(278): GI NO: 14279437 NR DESCRIPTION: ethylene-induced esterase
  misc_feature (23)..(278): GI NO: 41814856 NR DESCRIPTION: methylesterase
  misc_feature (24)..(279): GI NO: 27754457 NR DESCRIPTION: putative acetone-cyanohydrin lyase
  misc_feature (24)..(282): GI NO: 21554666 NR DESCRIPTION: putative acetone-cyanohydrin lyase
  misc_feature (23)..(280): GI NO: 34914020 NR DESCRIPTION: OJ1014_G12.25
  misc_feature (17)..(278): GI NO: 21595837 NR DESCRIPTION: polyneuridine aldehyde esterase
PTQNQTGLTQQMESTQSNTSVMNHFILVHGLCHGAWCWYKVVAALQAAGHRVTAVDLAASGAHPARIDEVHSFEEYSQPLLDVVAAAPEGDGERLILVGHSHGGLSLALAMERFPGKVAAAVFAAAGMPCVGKHMGVTTEEFMRRTSSEGLMDCKMLPINNNHGAGVAMIMGPNFLAHKNYQQSSPEDLALAKMLVRPGNLFMEDPVMKDASLLTDTNYGSVKKVYVVAKADGSSTEEMQRWMVLLSPGTEAEEIAGADHAIMSSRPRELCDALVKIADSLNTC

SEQ ID NO: 4628 - protein, 273 aa, Glycine max
  misc_feature (1)..(273): useful for making plants with increased drought tolerance as described in USSN 11/241,685
  misc_feature (1)..(273): Ceres Seq. ID no. 13638851
  misc_feature (39)..(265): PFAM Description: alpha/beta hydrolase fold
  misc_feature (7)..(268): GI NO: 34907176 NR DESCRIPTION: pir7b protein (Pseudomonas inducible protein)
  misc_feature (13)..(268): GI NO: 498747 NR DESCRIPTION: Pir7b
  misc_feature (13)..(267): GI NO: 34907178 NR DESCRIPTION: pir7a protein (Pseudomonas inducible protein)
  misc_feature (13)..(271): GI NO: 40549303 NR DESCRIPTION: salicylic acid-binding protein 2
  misc_feature (13)..(267): GI NO: 14279437 NR DESCRIPTION: ethylene-induced esterase
  misc_feature (12)..(267): GI NO: 41814856 NR DESCRIPTION: methylesterase
  misc_feature (13)..(268): GI NO: 27754457 NR DESCRIPTION: putative acetone-cyanohydrin lyase
  misc_feature (13)..(271): GI NO: 21554666 NR DESCRIPTION: putative acetone-cyanohydrin lyase
  misc_feature (12)..(269): GI NO: 34914020 NR DESCRIPTION: OJ1014_G12.25
  misc_feature (6)..(267): GI NO: 21595837 NR DESCRIPTION: polyneuridine aldehyde esterase
MESTQSNTSVMNHFILVHGLCHGAWCWYKVVAALQAAGHRVTAVDLAASGAHPARIDEVHSFEEYSQPLLDVVAAAPEGDGERLILVGHSHGGLSLALAMERFPGKVAAAVFAAAGMPCVGKHMGVTTEEFMRRTSSEGLMDCKMLPINNNHGAGVAMIMGPNFLAHKNYQQSSPEDLALAKMLVRPGNLFMEDPVMKDASLLTDTNYGSVKKVYVVAKADGSSTEEMQRWMVLLSPGTEAEEIAGADHAIMSSRPRELCDALVKIADSLNTC

SEQ ID NO: 4629 - protein, 263 aa, Glycine max
  misc_feature (1)..(263): useful for making plants with increased drought tolerance as described in USSN 11/241,685
  misc_feature (1)..(263): Ceres Seq. ID no. 13638852
  misc_feature (29)..(255): PFAM Description: alpha/beta hydrolase fold
  misc_feature (1)..(258): GI NO: 34907176 NR DESCRIPTION: pir7b protein (Pseudomonas inducible protein)
  misc_feature (3)..(258): GI NO: 498747 NR DESCRIPTION: Pir7b
  misc_feature (3)..(257): GI NO: 34907178 NR DESCRIPTION: pir7a protein (Pseudomonas inducible protein)
  misc_feature (3)..(261): GI NO: 40549303 NR DESCRIPTION: salicylic acid-binding protein 2
  misc_feature (3)..(257): GI NO: 14279437 NR DESCRIPTION: ethylene-induced esterase
  misc_feature (2)..(257): GI NO: 41814856 NR DESCRIPTION: methylesterase
  misc_feature (3)..(258): GI NO: 27754457 NR DESCRIPTION: putative acetone-cyanohydrin lyase
  misc_feature (3)..(261): GI NO: 21554666 NR DESCRIPTION: putative acetone-cyanohydrin lyase
  misc_feature (2)..(259): GI NO: 34914020 NR DESCRIPTION: OJ1014_G12.25
  misc_feature (1)..(257): GI NO: 21595837 NR DESCRIPTION: polyneuridine aldehyde esterase
MNHFILVHGLCHGAWCWYKVVAALQAAGHRVTAVDLAASGAHPARIDEVHSFEEYSQPLLDVVAAAPEGDGERLILVGHSHGGLSLALAMERFPGKVAAAVFAAAGMPCVGKHMGVTTEEFMRRTSSEGLMDCKMLPINNNHGAGVAMIMGPNFLAHKNYQQSSPEDLALAKMLVRPGNLFMEDPVMKDASLLTDTNYGSVKKVYVVAKADGSSTEEMQRWMVLLSPGTEAEEIAGADHAIMSSRPRELCDALVKIADSLNTC

SEQ ID NO: 4630 - DNA, 466 bp, Triticum aestivum
  misc_feature (1)..(466): useful for making plants with increased drought tolerance as described in USSN 11/241,685
  misc_feature (1)..(466): Ceres Seq. ID no. 11404534
  misc_feature (36)..(36): n is a, c, t, g, unknown, or other
atactccacagctaacgacaagcacggaccgcgganaaacagtcgcaaaaccccacgtgtgcacatcgagatggaggctccggcggaccaaaccagsagcaagcacatcgttctggtgcacggcgcatgcgtcggcggctgggcctggttcaaggtggccacgcggctcagggacgccgggccaccgcgtcagcacgcctgacctcgcggcgtcgggcgtcgaccccaggccgctgcgcgaggtgccgacgttcttcgactacaccaagccgctgctggacctcctggartcsctcycgcccggggagaaggtggtgctcgtcggccacagcctcggcggcgtgaacatcgccctcgcctgcgagctgttcccggagaaggtcgccgccgcggtgttcctctccgcctttatgccggaccacaggtcgtcgccggcgtacgtgctcgaaaagttcgtggagggggg

SEQ ID NO: 4631 - protein, 154 aa, Triticum aestivum
  misc_feature (1)..(154): useful for making plants with increased drought tolerance as described in USSN 11/241,685
  misc_feature (1)..(154): Ceres Seq. ID no. 11404535
  misc_feature (61)..(153): PFAM Description: alpha/beta hydrolase fold
  misc_feature (60)..(153): GI NO: 34908770 NR DESCRIPTION: P0415A04.19
  misc_feature (60)..(153): GI NO: 40549303 NR DESCRIPTION: salicylic acid-binding protein 2
  misc_feature (60)..(153): GI NO: 7488034 NR DESCRIPTION: probable (S)-acetone-cyanohydrin lyase
  misc_feature (60)..(151): GI NO: 27754457 NR DESCRIPTION: putative acetone-cyanohydrin lyase
  misc_feature (60)..(153): GI NO: 15028131 NR DESCRIPTION: putative alpha-hydroxynitrile lyase
  misc_feature (60)..(151): GI NO: 21554666 NR DESCRIPTION: putative acetone-cyanohydrin lyase
  misc_feature (60)..(153): GI NO: 16648679 NR DESCRIPTION: AT5g10300/F18D22_70
  misc_feature (60)..(153): GI NO: 14279437 NR DESCRIPTION: ethylene-induced esterase
  misc_feature (60)..(138): GI NO: 498747 NR DESCRIPTION: Pir7b
  misc_feature (60)..(152): GI NO: 28393451 NR DESCRIPTION: putative acetone-cyanohydrin lyase
  misc_feature (12)..(12): Xaa is any aa, unknown or other
  misc_feature (32)..(32): Xaa is any aa, unknown or other
  misc_feature (96)..(96): Xaa is any aa, unknown or other
  misc_feature (97)..(97): Xaa is any aa, unknown or other
  misc_feature (99)..(99): Xaa is any aa, unknown or other
TPQLTTSTDRGXTVAKPHVCTSRWRLRRTKPXASTSFWCTAHASAAGPGSRWPRGSGTPGHRVSTPDLAASGVDPRPLREVPTFFDYTKPLLDLLXXLXPGEKVVLVGHSLGGVNIALACELFPEKVAAAVFLSAFMPDHRSSPAYVLEKFVEG

SEQ ID NO: 4632 - DNA, 1088 bp, Triticum aestivum
  misc_feature (1)..(1088): useful for making plants with increased drought tolerance as described in USSN 11/241,685
  misc_feature (1)..(1088): Ceres Seq. ID no. 16446802
atcggagccacagctacagctcaagcacagaaaaacagccacaaaaccccacccatgcacatggaggcttgtgcgggccaagctagcagcgcgcacatcgtcctggtgcacggcgcatgcctcggcggctggtcctggttcaaggtggcgacgcggctcaggtcggccgggcaccgcgtcagcacgcctgacctcgcggcgtccggcgtcgaccccaggccgctgcgcgaggtgccgacgttccgcgactacaccaagccgctgctggacctcctggagtccctcccgtccggcgagaaggtggtgctcgtcggccacagcctcggcggcgtgaacgtcgccctcgcctgcgagctgtttccggagaagatcgccgctgcggtgttcgtcgccgccttcatgccggaccacaggtcgccgccgtcgtacgtccttgaaaagttcgtggaggggagaacgctggactggatggacacggagtttaagcctcaagatcctgaggggaagctgcctacttccatgctgttcgggccgctggtcactcgtgcaaagttcttccagttgtgttcgccggaggacctcacgctgggacgatccctgatgagggtcaactccatgttcgtggacgacctgaggctgcagccgccgcacaccgaggcccgctacgggtcggtgcgcaaggcgtacgtcgtcttcaaggacgaccacgccatcgtcgagcagttccagcggtggatggtgcacaactaccccgtggacgaggtgatggaaatcgatggcgcggaccacatggcgttgctctcgacgccgaccgagctggcgcgctgcctcgctgacatcgccgtcaagtatgctgcttgacttcctcgcaaaaaataaaagaaaagtctgctgcttgacgatggtgtggcgcacgttgcttgctgatctatacatctgtctaccttatggtttgtcccgttcgttaggtttcagagacttctactgcactctatttcagaccgataatgtttcaacatcgtatcgtggtgcatgtaactttgctatttaatatttgaagataaatgttggcaaaaaaaaaaaaaaaa

SEQ ID NO: 4633 - protein, 286 aa, Triticum aestivum
  misc_feature (1)..(286): useful for making plants with increased drought tolerance as described in USSN 11/241,685
  misc_feature (1)..(286): Ceres Seq. ID no. 16605607
  misc_feature (58)..(279): PFAM Description: alpha/beta hydrolase fold
  misc_feature (26)..(285): GI NO: 34908770 NR DESCRIPTION: P0415A04.19
  misc_feature (25)..(285): GI NO: 34915034 NR DESCRIPTION: putative acetone-cyanohydrin lyase
  misc_feature (25)..(284): GI NO: 34914020 NR DESCRIPTION: OJ1014_G12.25
  misc_feature (32)..(284): GI NO: 40549303 NR DESCRIPTION: salicylic acid-binding protein 2
  misc_feature (21)..(285): GI NO: 14279437 NR DESCRIPTION: ethylene-induced esterase
  misc_feature (155)..(284): GI NO: 34914024 NR DESCRIPTION: OJ1014_G12.27
  misc_feature (29)..(149): GI NO: 34914024 NR DESCRIPTION: OJ1014_G12.27
  misc_feature (32)..(284): GI NO: 27754457 NR DESCRIPTION: putative acetone-cyanohydrin lyase
  misc_feature (32)..(284): GI NO: 41814856 NR DESCRIPTION: methylesterase
  misc_feature (34)..(281): GI NO: 21595837 NR DESCRIPTION: polyneuridine aldehyde esterase
IGATATAQAQKNSHKTPPMHMEACAGQASSAHIVLVHGACLGGWSWFKVATRLRSAGHRVSTPDLAASGVDPRPLREVPTFRDYTKPLLDLLESLPSGEKVVLVGHSLGGVNVALACELFPEKIAAAVFVAAFMPDHRSPPSYVLEKFVEGRTLDWMDTEFKPQDPEGKLPTSMLFGPLVTRAKFFQLCSPEDLTLGRSLMRVNSMFVDDLRLQPPHTEARYGSVRKAYVVFKDDHAIVEQFQRWMVHNYPVDEVMEIDGADHMALLSTPTELARCLADIAVKYAA

SEQ ID NO: 4634 - protein, 268 aa, Triticum aestivum
  misc_feature (1)..(268): useful for making plants with increased drought tolerance as described in USSN 11/241,685
  misc_feature (1)..(268): Ceres Seq. ID no. 16605608
  misc_feature (40)..(261): PFAM Description: alpha/beta hydrolase fold
  misc_feature (8)..(267): GI NO: 34908770 NR DESCRIPTION: P0415A04.19
  misc_feature (7)..(267): GI NO: 34915034 NR DESCRIPTION: putative acetone-cyanohydrin lyase
  misc_feature (7)..(266): GI NO: 34914020 NR DESCRIPTION: OJ1014_G12.25
  misc_feature (14)..(266): GI NO: 40549303 NR DESCRIPTION: salicylic acid-binding protein 2
  misc_feature (3)..(267): GI NO: 14279437 NR DESCRIPTION: ethylene-induced esterase
  misc_feature (137)..(266): GI NO: 34914024 NR DESCRIPTION: OJ1014_G12.27
  misc_feature (11)..(131): GI NO: 34914024 NR DESCRIPTION: OJ1014_G12.27
  misc_feature (14)..(266): GI NO: 27754457 NR DESCRIPTION: putative acetone-cyanohydrin lyase
  misc_feature (14)..(266): GI NO: 41814856 NR DESCRIPTION: methylesterase
  misc_feature (16)..(263): GI NO: 21595837 NR DESCRIPTION: polyneuridine aldehyde esterase
MHMEACAGQASSAHIVLVHGACLGGWSWFKVATRLRSAGHRVSTPDLAASGVDPRPLREVPTFRDYTKPLLDLLESLPSGEKVVLVGHSLGGVNVALACELFPEKIAAAVFVAAFMPDHRSPPSYVLEKFVEGRTLDWMDTEFKPQDPEGKLPTSMLFGPLVTRAKFFQLCSPEDLTLGRSLMRVNSMFVDDLRLQPPHTEARYGSVRKAYVVFKDDHAIVEQFQRWMVHNYPVDEVMEIDGADHMALLSTPTELARCLADIAVKYAA

SEQ ID NO: 4635 - protein, 266 aa, Triticum aestivum; identical to SEQ ID NO: 3008
  misc_feature (1)..(266): useful for making plants with increased drought tolerance as described in USSN 11/241,685
  misc_feature (1)..(266): Ceres Seq. ID no. 16613014
  misc_feature (38)..(259): PFAM Description: alpha/beta hydrolase fold
  misc_feature (6)..(265): GI NO: 34908770 NR DESCRIPTION: P0415A04.19
  misc_feature (5)..(265): GI NO: 34915034 NR DESCRIPTION: putative acetone-cyanohydrin lyase
  misc_feature (5)..(264): GI NO: 34914020 NR DESCRIPTION: OJ1014_G12.25
  misc_feature (12)..(264): GI NO: 40549303 NR DESCRIPTION: salicylic acid-binding protein 2
  misc_feature (1)..(265): GI NO: 14279437 NR DESCRIPTION: ethylene-induced esterase
  misc_feature (135)..(264): GI NO: 34914024 NR DESCRIPTION: OJ1014_G12.27
  misc_feature (9)..(129): GI NO: 34914024 NR DESCRIPTION: OJ1014_G12.27
  misc_feature (12)..(264): GI NO: 27754457 NR DESCRIPTION: putative acetone-cyanohydrin lyase
  misc_feature (12)..(264): GI NO: 41814856 NR DESCRIPTION: methylesterase
  misc_feature (14)..(261): GI NO: 21595837 NR DESCRIPTION: polyneuridine aldehyde esterase

SEQ ID NO: 4636 - DNA, 469 bp, Triticum aestivum
  misc_feature (1)..(469): useful for making plants with increased drought tolerance as described in USSN 11/241,685
  misc_feature (1)..(469): Ceres Seq. ID no. 13545725
gacaaacatatctgcaagccgctcgccgctcaccggcggcggcatagccagtcgaactcttgcctgaggtgaaatcggatggaggggagcagcagcggcgagcacttcatgctcgtccacggcctcggccacggcgcgtggtgctggtacaagctggtgccgatgctccgcgccgcggggcaccgggtcaccgcgctcgacatggccgcgtccggcgcgcacccggcgcgcatggacgaggtgccgtccttcgaggactactcgcggccgctgctcgacgccgtggccgcggcaccggccggcgagaggctggtcctggtcgggcacagcctcggcgggctcaacatcgcgctcgccatggagaggttcccgcgcaaggtcgccgcggccgtgttcctggccgcgtgcatgccgtgcgtcggcaggcacatgggcgtcacyacggaggagatcatgagacggatcaagc

SEQ ID NO: 4637 - protein, 130 aa, Triticum aestivum
  misc_feature (1)..(130): useful for making plants with increased drought tolerance as described in USSN 11/241,685
  misc_feature (1)..(130): Ceres Seq. ID no. 13545726
  misc_feature (35)..(128): PFAM Description: alpha/beta hydrolase fold
  misc_feature (7)..(129): GI NO: 34907178 NR DESCRIPTION: pir7a protein (Pseudomonas inducible protein)
  misc_feature (1)..(128): GI NO: 34907176 NR DESCRIPTION: pir7b protein (Pseudomonas inducible protein)
  misc_feature (6)..(128): GI NO: 498747 NR DESCRIPTION: Pir7b
  misc_feature (1)..(118): GI NO: 34907174 NR DESCRIPTION: putative pir7b (Pseudomonas inducible protein)
  misc_feature (4)..(112): GI NO: 34915034 NR DESCRIPTION: putative acetone-cyanohydrin lyase
  misc_feature (4)..(112): GI NO: 34914020 NR DESCRIPTION: OJ1014_G12.25
  misc_feature (9)..(112): GI NO: 41814856 NR DESCRIPTION: methylesterase
  misc_feature (8)..(112): GI NO: 27754457 NR DESCRIPTION: putative acetone-cyanohydrin lyase
  misc_feature (8)..(112): GI NO: 7488034 NR DESCRIPTION: probable (S)-acetone-cyanohydrin lyase
  misc_feature (7)..(112): GI NO: 40549303 NR DESCRIPTION: salicylic acid-binding protein 2
  misc_feature (121)..(121): Xaa is any aa, unknown or other
MEGSSSGEHFMLVHGLGHGAWCWYKLVPMLRAAGHRVTALDMAASGAHPARMDEVPSFEDYSRPLLDAVAAAPAGERLVLVGHSLGGLNIALAMERFPRKVAAAVFLAACMPCVGRHMGVXTEEIMRRIK

SEQ ID NO: 4638 - protein, 120 aa, Triticum aestivum
  misc_feature (1)..(120): useful for making plants with increased drought tolerance as described in USSN 11/241,685
  misc_feature (1)..(120): Ceres Seq. ID no. 13545727
  misc_feature (25)..(118): PFAM Description: alpha/beta hydrolase fold
  misc_feature (1)..(119): GI NO: 34907178 NR DESCRIPTION: pir7a protein (Pseudomonas inducible protein)
  misc_feature (1)..(118): GI NO: 34907176 NR DESCRIPTION: pir7b protein (Pseudomonas inducible protein)
  misc_feature (1)..(118): GI NO: 498747 NR DESCRIPTION: Pir7b
  misc_feature (1)..(108): GI NO: 34907174 NR DESCRIPTION: putative pir7b (Pseudomonas inducible protein)
  misc_feature (1)..(102): GI NO: 34915034 NR DESCRIPTION: putative acetone-cyanohydrin lyase
  misc_feature (1)..(102): GI NO: 34914020 NR DESCRIPTION: OJ1014_G12.25
  misc_feature (1)..(102): GI NO: 41814856 NR DESCRIPTION: methylesterase
  misc_feature (1)..(102): GI NO: 27754457 NR DESCRIPTION: putative acetone-cyanohydrin lyase
  misc_feature (1)..(102): GI NO: 7488034 NR DESCRIPTION: probable (S)-acetone-cyanohydrin lyase
  misc_feature (1)..(102): GI NO: 40549303 NR DESCRIPTION: salicylic acid-binding protein 2
  misc_feature (111)..(111): Xaa is any aa, unknown or other
MLVHGLGHGAWCWYKLVPMLRAAGHRVTALDMAASGAHPARMDEVPSFEDYSRPLLDAVAAAPAGERLVLVGHSLGGLNIALAMERFPRKVAAAVFLAACMPCVGRHMGVXTEEIMRRIK

SEQ ID NO: 4639 - protein, 102 aa, Triticum aestivum
  misc_feature (1)..(102): useful for making plants with increased drought tolerance as described in USSN 11/241,685
  misc_feature (1)..(102): Ceres Seq. ID no. 13545728
  misc_feature (7)..(100): PFAM Description: alpha/beta hydrolase fold
  misc_feature (1)..(101): GI NO: 34907178 NR DESCRIPTION: pir7a protein (Pseudomonas inducible protein)
  misc_feature (1)..(100): GI NO: 34907176 NR DESCRIPTION: pir7b protein (Pseudomonas inducible protein)
  misc_feature (1)..(100): GI NO: 498747 NR DESCRIPTION: Pir7b
  misc_feature (1)..(90): GI NO: 34907174 NR DESCRIPTION: putative pir7b (Pseudomonas inducible protein)
  misc_feature (1)..(84): GI NO: 34915034 NR DESCRIPTION: putative acetone-cyanohydrin lyase
  misc_feature (1)..(84): GI NO: 34914020 NR DESCRIPTION: OJ1014_G12.25
  misc_feature (1)..(84): GI NO: 41814856 NR DESCRIPTION: methylesterase
  misc_feature (1)..(84): GI NO: 27754457 NR DESCRIPTION: putative acetone-cyanohydrin lyase
  misc_feature (1)..(84): GI NO: 7488034 NR DESCRIPTION: probable (S)-acetone-cyanohydrin lyase
  misc_feature (1)..(84): GI NO: 40549303 NR DESCRIPTION: salicylic acid-binding protein 2
  misc_feature (93)..(93): Xaa is any aa, unknown or other
MLRAAGHRVTALDMAASGAHPARMDEVPSFEDYSRPLLDAVAAAPAGERLVLVGHSLGGLNIALAMERFPRKVAAAVFLAACMPCVGRHMGVXTEEIMRRIK

SEQ ID NO: 4640 - DNA, 455 bp, Triticum aestivum
  misc_feature (1)..(455): useful for making plants with increased drought tolerance as described in USSN 11/241,685
  misc_feature (1)..(455): Ceres Seq. ID no. 4288946
atccaacacaaaacaaaacaaattttacacaggaaatgaagagcactcagagcaacagcagcaacagcgtgaggaaccatttcatcctggtgcacggcctctgccacggcgcgtggtgctggtacaaggtggtcgcggcgcttgaggcagcggggcaccgcgtcacggcagtcgacctcgccgcttccggcgcccacccggcgcgcgtcgacgaggtgcactcgttcgaggagtactcgcggccgctgctcgacgtgctggccgcggcgccggagggtgacggcgaraggctgattctggtcgggcacagccatggcgggctcagcttggcactagccatggagaggttctccggcaaggtcgccgccgccgtgttcgcagccgccgggatgccgtgtgttggcaagcacatgggcatcaccaccgaggagttcatgcgaagaaaacatccgaag

SEQ ID NO: 4641 - protein, 151 aa, Triticum aestivum
  misc_feature (1)..(151): useful for making plants with increased drought tolerance as described in USSN 11/241,685
  misc_feature (1)..(151): Ceres Seq. ID no. 4288947
  misc_feature (52)..(150): PFAM Description: alpha/beta hydrolase fold
  misc_feature (20)..(150): GI NO: 34907176 NR DESCRIPTION: pir7b protein (Pseudomonas inducible protein)
  misc_feature (24)..(150): GI NO: 498747 NR DESCRIPTION: Pir7b
  misc_feature (26)..(150): GI NO: 34907178 NR DESCRIPTION: pir7a protein (Pseudomonas inducible protein)
  misc_feature (20)..(137): GI NO: 34907174 NR DESCRIPTION: putative pir7b (Pseudomonas inducible protein)
  misc_feature (26)..(147): GI NO: 14279437 NR DESCRIPTION: ethylene-induced esterase
  misc_feature (19)..(143): GI NO: 21554666 NR DESCRIPTION: putative acetone-cyanohydrin lyase
  misc_feature (19)..(131): GI NO: 7488034 NR DESCRIPTION: probable (S)-acetone-cyanohydrin lyase
  misc_feature (19)..(131): GI NO: 27754457 NR DESCRIPTION: putative acetone-cyanohydrin lyase
  misc_feature (24)..(131): GI NO: 41814856 NR DESCRIPTION: methylesterase
  misc_feature (12)..(131): GI NO: 34915034 NR DESCRIPTION: putative acetone-cyanohydrin lyase
  misc_feature (95)..(95): Xaa is any aa, unknown or other
PTQNKTNFTQEMKSTQSNSSNSVRNHFILVHGLCHGAWCWYKVVAALEAAGHRVTAVDLAASGAHPARVDEVHSFEEYSRPLLDVLAAAPEGDGXRLILVGHSHGGLSLALAMERFSGKVAAAVFAAAGMPCVGKHMGITTEEFMRRKHPK

SEQ ID NO: 4642 - protein, 140 aa, Triticum aestivum
  misc_feature (1)..(140): useful for making plants with increased drought tolerance as described in USSN 11/241,685
  misc_feature (1)..(140): Ceres Seq. ID no. 4288948
  misc_feature (41)..(139): PFAM Description: alpha/beta hydrolase fold
  misc_feature (9)..(139): GI NO: 34907176 NR DESCRIPTION: pir7b protein (Pseudomonas inducible protein)
  misc_feature (13)..(139): GI NO: 498747 NR DESCRIPTION: Pir7b
  misc_feature (15)..(139): GI NO: 34907178 NR DESCRIPTION: pir7a protein (Pseudomonas inducible protein)
  misc_feature (9)..(126): GI NO: 34907174 NR DESCRIPTION: putative pir7b (Pseudomonas inducible protein)
  misc_feature (15)..(136): GI NO: 14279437 NR DESCRIPTION: ethylene-induced esterase
  misc_feature (8)..(132): GI NO: 21554666 NR DESCRIPTION: putative acetone-cyanohydrin lyase
  misc_feature (8)..(120): GI NO: 7488034 NR DESCRIPTION: probable (S)-acetone-cyanohydrin lyase
  misc_feature (8)..(120): GI NO: 27754457 NR DESCRIPTION: putative acetone-cyanohydrin lyase
  misc_feature (13)..(120): GI NO: 41814856 NR DESCRIPTION: methylesterase
  misc_feature (1)..(120): GI NO: 34915034 NR DESCRIPTION: putative acetone-cyanohydrin lyase
  misc_feature (84)..(84): Xaa is any aa, unknown or other
MKSTQSNSSNSVRNHFILVHGLCHGAWCWYKVVAALEAAGHRVTAVDLAASGAHPARVDEVHSFEEYSRPLLDVLAAAPEGDGXRLILVGHSHGGLSLALAMERFSGKVAAAVFAAAGMPCVGKHMGITTEEFMRRKHPK

SEQ ID NO: 4643 - DNA, 1044 bp, Triticum aestivum
  misc_feature (1)..(1044): useful for making plants with increased drought tolerance as described in USSN 11/241,685
  misc_feature (1)..(1044): Ceres Seq. ID no. 16602710
ctgctttcgcttttactgaaaacttattgccatgtgcgcccatgctggcgaggtaccctcggcaaagatatctgcaagagcaggagccgctcgccgccggtagcatagccagtcgatctcttgccggaggtgaaatccgatggaggggagcagcagcggcaagcacttcatcctcatccacggcctctgccacggcgcgtggtgctggtacaagctggtgccgatgctccgcgccgcggggcaccgcgtcaccgcgctcgacatggccgcgtccggcgcgcacccggcgcgcatggacgaggtgccgtccttcgaggactactcttggccgctgctcgacgcggtggccgcggcaccggcgggcgagaggctagtcctggtcgggcacagcctcggggggctcaacatcgcgctcgccatggagaggttcccgcgcaaggtcgccgcggccgtgttcctggccgcgtgcatgccgtgcgtcggcaggcacatgggcgccaccacggaggagatcatgagacggatcaagccggatttcttcatggacatgaagaggatggttctgaacacgagccagggccctcgacctgcactcgtgtttggtccaaaaatattggcagcaaagctgtacgatcgaagctcaggtgaggatcagacgctggctacgatgctggtgagaccgggctgccagttcttggatgaccctaccatgaaggacgaggctctgctcaccgaagccaagtacgggtcggtgaagaaggtgtacgtggtggccatggccgacgcatcaaactccgaggagatgcagcgttggatggtcgacatgagccccggcacggaggccgaggagatcgccggagcggatcacatggccatgtgctccaaacccagggagctctgtgatgtcctgctccggatagccgacaagtatgaatgaattgattgtccacacagttagacttgtactccgtaatatcttcccatgaatttctcgttcgctgagagttaagtttgttgttacctttttcaaaaaaaaaaaaaaaa

SEQ ID NO: 4644 - protein, 265 aa, Triticum aestivum; identical to SEQ ID NO: 3009
  misc_feature (1)..(265): useful for making plants with increased drought tolerance as described in USSN 11/241,685
  misc_feature (1)..(265): Ceres Seq. ID no. 16606373
  misc_feature (35)..(259): PFAM Description: alpha/beta hydrolase fold
  misc_feature (7)..(265): GI NO: 34907178 NR DESCRIPTION: pir7a protein (Pseudomonas inducible protein)
  misc_feature (1)..(265): GI NO: 34907176 NR DESCRIPTION: pir7b protein (Pseudomonas inducible protein)
  misc_feature (6)..(265): GI NO: 498747 NR DESCRIPTION: Pir7b
  misc_feature (1)..(118): GI NO: 34907174 NR DESCRIPTION: putative pir7b (Pseudomonas inducible protein)
  misc_feature (170)..(265): GI NO: 34907174 NR DESCRIPTION: putative pir7b (Pseudomonas inducible protein)
  misc_feature (7)..(264): GI NO: 40549303 NR DESCRIPTION: salicylic acid-binding protein 2
  misc_feature (9)..(264): GI NO: 41814856 NR DESCRIPTION: methylesterase
  misc_feature (8)..(264): GI NO: 14279437 NR DESCRIPTION: ethylene-induced esterase
  misc_feature (1)..(264): GI NO: 34915034 NR DESCRIPTION: putative acetone-cyanohydrin lyase
  misc_feature (136)..(264): GI NO: 34914024 NR DESCRIPTION: OJ1014_G12.27

SEQ ID NO: 4645 - protein, 237 aa, Triticum aestivum
  misc_feature (1)..(237): useful for making plants with increased drought tolerance as described in USSN 11/241,685
  misc_feature (1)..(237): Ceres Seq. ID no. 16606374
  misc_feature (7)..(231): PFAM Description: alpha/beta hydrolase fold
  misc_feature (1)..(237): GI NO: 34907178 NR DESCRIPTION: pir7a protein (Pseudomonas inducible protein)
  misc_feature (1)..(237): GI NO: 34907176 NR DESCRIPTION: pir7b protein (Pseudomonas inducible protein)
  misc_feature (1)..(237): GI NO: 498747 NR DESCRIPTION: Pir7b
  misc_feature (1)..(90): GI NO: 34907174 NR DESCRIPTION: putative pir7b (Pseudomonas inducible protein)
  misc_feature (142)..(237): GI NO: 34907174 NR DESCRIPTION: putative pir7b (Pseudomonas inducible protein)
  misc_feature (1)..(236): GI NO: 40549303 NR DESCRIPTION: salicylic acid-binding protein 2
  misc_feature (1)..(236): GI NO: 41814856 NR DESCRIPTION: methylesterase
  misc_feature (1)..(236): GI NO: 14279437 NR DESCRIPTION: ethylene-induced esterase
  misc_feature (1)..(236): GI NO: 34915034 NR DESCRIPTION: putative acetone-cyanohydrin lyase
  misc_feature (108)..(236): GI NO: 34914024 NR DESCRIPTION: OJ1014_G12.27
MLRAAGHRVTALDMAASGAHPARMDEVPSFEDYSWPLLDAVAAAPAGERLVLVGHSLGGLNIALAMERFPRKVAAAVFLAACMPCVGRHMGATTEEIMRRIKPDFFMDMKRMVLNTSQGPRPALVFGPKILAAKLYDRSSGEDQTLATMLVRPGCQFLDDPTMKDEALLTEAKYGSVKKVYVVAMADASNSEEMQRWMVDMSPGTEAEEIAGADHMAMCSKPRELCDVLLRIADKYE

SEQ ID NO: 4646 - protein, 224 aa, Triticum aestivum
  misc_feature (1)..(224): useful for making plants with increased drought tolerance as described in USSN 11/241,685
  misc_feature (1)..(224): Ceres Seq. ID no. 16606375
  misc_feature (1)..(218): PFAM Description: alpha/beta hydrolase fold
  misc_feature (1)..(224): GI NO: 34907178 NR DESCRIPTION: pir7a protein (Pseudomonas inducible protein)
  misc_feature (1)..(224): GI NO: 34907176 NR DESCRIPTION: pir7b protein (Pseudomonas inducible protein)
  misc_feature (1)..(224): GI NO: 498747 NR DESCRIPTION: Pir7b
  misc_feature (1)..(77): GI NO: 34907174 NR DESCRIPTION: putative pir7b (Pseudomonas inducible protein)
  misc_feature (129)..(224): GI NO: 34907174 NR DESCRIPTION: putative pir7b (Pseudomonas inducible protein)
  misc_feature (1)..(223): GI NO: 40549303 NR DESCRIPTION: salicylic acid-binding protein 2
  misc_feature (1)..(223): GI NO: 41814856 NR DESCRIPTION: methylesterase
  misc_feature (1)..(223): GI NO: 14279437 NR DESCRIPTION: ethylene-induced esterase
  misc_feature (1)..(223): GI NO: 34915034 NR DESCRIPTION: putative acetone-cyanohydrin lyase
  misc_feature (95)..(223): GI NO: 34914024 NR DESCRIPTION: OJ1014_G12.27
MAASGAHPARMDEVPSFEDYSWPLLDAVAAAPAGERLVLVGHSLGGLNIALAMERFPRKVAAAVFLAACMPCVGRHMGATTEEIMRRIKPDFFMDMKRMVLNTSQGPRPALVFGPKILAAKLYDRSSGEDQTLATMLVRPGCQFLDDPTMKDEALLTEAKYGSVKKVYVVAMADASNSEEMQRWMVDMSPGTEAEEIAGADHMAMCSKPRELCDVLLRIADKYE

SEQ ID NO: 4647 - DNA, 455 bp, Triticum aestivum
  misc_feature (1)..(455): useful for making plants with increased drought tolerance as described in USSN 11/241,685
  misc_feature (1)..(455): Ceres Seq. ID no. 11425729
  misc_feature (425)..(425): n is a, c, t, g, unknown, or other
aagtcatccctacgcctcctctctctttccgactgaactccaagaacatcttctcattttctctgcttccaatggcgaagggcgggctgagcagcaagctcaagtgcatgatcaggcggtggcactcgtcgagccggatctcgcgcacgccctcggcggcgtcgcacggcggcggcggcggcgaggaggaggacccgtggggccgcggcgtcggcggcggcgcggcgtcgttccacggcgccgacagcgtgcccccgggcctccacccggtctacgtcggcaagtcgcgccgccgctacctcatcgccgccgacctcgtctgccacccgctgttccagaacctcgtggaccgctcgggcggcggcgtgggcggcgacggcgccggcggcaccatcatcggctgcgaggtggtgctgttcgagcanctcctgtggatgctggagaacgcggacccg

SEQ ID NO: 4648 - protein, 151 aa, Triticum aestivum
  misc_feature (1)..(151): useful for making plants with increased drought tolerance as described in USSN 11/241,685
  misc_feature (1)..(151): Ceres Seq. ID no. 11425730
  misc_feature (52)..(143): PFAM Description: Subtilase family
  misc_feature (142)..(142): Xaa is any aa, unknown or other
SHPYASSLFPTELQEHLLIFSASNGEGRAEQQAQVHDQAVALVEPDLAHALGGVARRRRRRGGGPVGPRRRRRRGVVPRRRQRAPGPPPGLRRQVAPPLPHRRRPRLPPAVPEPRGPLGRRRGRRRRRRHHHRLRGGAVRAXPVDAGERGP

SEQ ID NO: 4649 - protein, 151 aa, Triticum aestivum
  misc_feature (1)..(151): useful for making plants with increased drought tolerance as described in USSN 11/241,685
  misc_feature (1)..(151): Ceres Seq. ID no. 11425731
  misc_feature (87)..(147): PFAM Description: Auxin responsive protein
  misc_feature (24)..(150): GI NO: 50946385 NR DESCRIPTION: auxin-induced protein-related-like protein
  misc_feature (87)..(150): GI NO: 15242071 NR DESCRIPTION: putative protein; protein id: At5g20820.1
  misc_feature (87)..(150): GI NO: 21554070 NR DESCRIPTION: unknown
  misc_feature (83)..(150): GI NO: 24943206 NR DESCRIPTION: auxin-regulated protein
  misc_feature (141)..(141): Xaa is any aa, unknown or other
VIPTPPLSFRLNSKNIFSFSLLPMAKGGLSSKLKCMIRRWHSSSRISRTPSAASHGGGGGEEEDPWGRGVGGGAASFHGADSVPPGLHPVYVGKSRRRYLIAADLVCHPLFQNLVDRSGGGVGGDGAGGTIIGCEVVLFEXLLWMLENADP

SEQ ID NO: 4650 - protein, 128 aa, Triticum aestivum
  misc_feature (1)..(128): useful for making plants with increased drought tolerance as described in USSN 11/241,685
  misc_feature (1)..(128): Ceres Seq. ID no. 11425732
  misc_feature (64)..(124): PFAM Description: Auxin responsive protein
  misc_feature (1)..(127): GI NO: 50946385 NR DESCRIPTION: auxin-induced protein-related-like protein
  misc_feature (64)..(127): GI NO: 15242071 NR DESCRIPTION: putative protein; protein id: At5g20820.1
  misc_feature (64)..(127): GI NO: 21554070 NR DESCRIPTION: unknown
  misc_feature (60)..(127): GI NO: 24943206 NR DESCRIPTION: auxin-regulated protein
  misc_feature (118)..(118): Xaa is any aa, unknown or other
MAKGGLSSKLKCMIRRWHSSSRISRTPSAASHGGGGGEEEDPWGRGVGGGAASFHGADSVPPGLHPVYVGKSRRRYLIAADLVCHPLFQNLVDRSGGGVGGDGAGGTIIGCEVVLFEXLLWMLENADP

SEQ ID NO: 4651 - DNA, 421 bp, Triticum aestivum
  misc_feature (1)..(421): useful for making plants with increased drought tolerance as described in USSN 11/241,685
  misc_feature (1)..(421): Ceres Seq. ID no. 11425947
tccaaaaatccaacacaaaccaaacaggttttacgctacgcaagaaatggagagcacccagagcaacagtgtgaggagccatttcatcctggtgcacggcctctgccatggggcttggtgctggtacaaagtggtcgcggcgctcgaggccgcggggcaccgcgtcacggcgatcgacctcgccgcttcgggtacccacccggcgcgcgttgacgaggtgcactcgttcgaggagtactcgcggccgctgctcgacgtggtggccgcggcgccggcgggtgacggcgagaggctgattctggtcgggcacagccacggcggcctcagcttggcgctagccatggagaggttccccggcaagatcgccgctgccgtgttcgcggccgctgcgatgccgagcgtcgggaagcacatgggcgtc

SEQ ID NO: 4652 - protein, 140 aa, Triticum aestivum
  misc_feature (1)..(140): useful for making plants with increased drought tolerance as described in USSN 11/241,685
  misc_feature (1)..(140): Ceres Seq. ID no. 11425948
  misc_feature (53)..(139): PFAM Description: alpha/beta hydrolase fold
  misc_feature (21)..(139): GI NO: 34907176 NR DESCRIPTION: pir7b protein (Pseudomonas inducible protein)
  misc_feature (25)..(139): GI NO: 498747 NR DESCRIPTION: Pir7b
  misc_feature (16)..(138): GI NO: 34907174 NR DESCRIPTION: putative pir7b (Pseudomonas inducible protein)
  misc_feature (27)..(139): GI NO: 34907178 NR DESCRIPTION: pir7a protein (Pseudomonas inducible protein)
  misc_feature (27)..(132): GI NO: 14279437 NR DESCRIPTION: ethylene-induced esterase
  misc_feature (25)..(137): GI NO: 21554666 NR DESCRIPTION: putative acetone-cyanohydrin lyase
  misc_feature (25)..(132): GI NO: 27754457 NR DESCRIPTION: putative acetone-cyanohydrin lyase
  misc_feature (25)..(132): GI NO: 41814856 NR DESCRIPTION: methylesterase
  misc_feature (26)..(132): GI NO: 34914020 NR DESCRIPTION: OJ1014_G12.25
  misc_feature (28)..(137): GI NO: 2780225 NR DESCRIPTION: alpha-hydroxynitrile lyase
PKIQHKPNRFYATQEMESTQSNSVRSHFILVHGLCHGAWCWYKVVAALEAAGHRVTAIDLAASGTHPARVDEVHSFEEYSRPLLDVVAAAPAGDGERLILVGHSHGGLSLALAMERFPGKIAAAVFAAAAMPSVGKHMGV

SEQ ID NO: 4653 - protein, 125 aa, Triticum aestivum
  misc_feature (1)..(125): useful for making plants with increased drought tolerance as described in USSN 11/241,685
  misc_feature (1)..(125): Ceres Seq. ID no. 11425949
  misc_feature (38)..(124): PFAM Description: alpha/beta hydrolase fold
  misc_feature (6)..(124): GI NO: 34907176 NR DESCRIPTION: pir7b protein (Pseudomonas inducible protein)
  misc_feature (10)..(124): GI NO: 498747 NR DESCRIPTION: Pir7b
  misc_feature (1)..(123): GI NO: 34907174 NR DESCRIPTION: putative pir7b (Pseudomonas inducible protein)
  misc_feature (12)..(124): GI NO: 34907178 NR DESCRIPTION: pir7a protein (Pseudomonas inducible protein)
  misc_feature (12)..(117): GI NO: 14279437 NR DESCRIPTION: ethylene-induced esterase
  misc_feature (10)..(122): GI NO: 21554666 NR DESCRIPTION: putative acetone-cyanohydrin lyase
  misc_feature (10)..(117): GI NO: 27754457 NR DESCRIPTION: putative acetone-cyanohydrin lyase
  misc_feature (10)..(117): GI NO: 41814856 NR DESCRIPTION: methylesterase
  misc_feature (11)..(117): GI NO: 34914020 NR DESCRIPTION: OJ1014_G12.25
  misc_feature (13)..(122): GI NO: 2780225 NR DESCRIPTION: alpha-hydroxynitrile lyase
MESTQSNSVRSHFILVHGLCHGAWCWYKVVAALEAAGHRVTAIDLAASGTHPARVDEVHSFEEYSRPLLDVVAAAPAGDGERLILVGHSHGGLSLALAMERFPGKIAAAVFAAAAMPSVGKHMGV

SEQ ID NO: 4654 - protein, 70 aa, Triticum aestivum
  misc_feature (1)..(70): useful for making plants with increased drought tolerance as described in USSN 11/241,685
  misc_feature (1)..(70): Ceres Seq. ID no. 11425950
SKNPTQTKQVLRYARNGEHPEQQCEEPFHPGARPLPWGLVLVQSGRGARGRGAPRHGDRPRRFGYPPGAR

SEQ ID NO: 4655 - DNA, 433 bp, Triticum aestivum
  misc_feature (1)..(433): useful for making plants with increased drought tolerance as described in USSN 11/241,685
  misc_feature (1)..(433): Ceres Seq. ID no. 4603108
gaaaaaagtcatccctacgcctcctttctctttccgactgaaccccaagaacatcctctccatctctctctgcttccaatggcgaagggcgggctgagcagcaagctcaagtgcatgatcaggcggtggcactcgtcgagccggatctcccgcacgccctcggcggtgtcgcacggcggcggcgaggaggaggacccgtggggccgcggcgtcggcgggggcgggggcggcgcggcgtcgttccacggcgccgacggcgtgcccccgggcctccacccggtgtacgtcggcaagtcgcgccgccgctacctcatcgccgccgacctcgtctgccacccgctgttccagaacctcgtggaccgctcgggcggcggcgtgggcggcgacggcgccggcggcaccatcatcggctgcgaggtggtgctgttcgagc

SEQ ID NO: 4656 - protein, 144 aa, Triticum aestivum
  misc_feature (1)..(144): useful for making plants with increased drought tolerance as described in USSN 11/241,685
  misc_feature (1)..(144): Ceres Seq. ID no. 4603109
  misc_feature (91)..(143): PFAM Description: Auxin responsive protein
  misc_feature (27)..(143): GI NO: 50946385 NR DESCRIPTION: auxin-induced protein-related-like protein
  misc_feature (91)..(143): GI NO: 15242071 NR DESCRIPTION: putative protein; protein id: At5g20820.1
  misc_feature (91)..(143): GI NO: 21554070 NR DESCRIPTION: unknown
EKSHPYASFLFPTEPQEHPLHLSLLPMAKGGLSSKLKCMIRRWHSSSRISRTPSAVSHGGGEEEDPWGRGVGGGGGGAASFHGADGVPPGLHPVYVGKSRRRYLIAADLVCHPLFQNLVDRSGGGVGGDGAGGTIIGCEVVLFE

SEQ ID NO: 4657 - protein, 118 aa, Triticum aestivum
  misc_feature (1)..(118): useful for making plants with increased drought tolerance as described in USSN 11/241,685
  misc_feature (1)..(118): Ceres Seq. ID no. 4603110
  misc_feature (65)..(117): PFAM Description: Auxin responsive protein
  misc_feature (1)..(117): GI NO: 50946385 NR DESCRIPTION: auxin-induced protein-related-like protein
  misc_feature (65)..(117): GI NO: 15242071 NR DESCRIPTION: putative protein; protein id: At5g20820.1
  misc_feature (65)..(117): GI NO: 21554070 NR DESCRIPTION: unknown
MAKGGLSSKLKCMIRRWHSSSRISRTPSAVSHGGGEEEDPWGRGVGGGGGGAASFHGADGVPPGLHPVYVGKSRRRYLIAADLVCHPLFQNLVDRSGGGVGGDGAGGTIIGCEVVLFE

SEQ ID NO: 4658 - protein, 106 aa, Triticum aestivum
  misc_feature (1)..(106): useful for making plants with increased drought tolerance as described in USSN 11/241,685
  misc_feature (1)..(106): Ceres Seq. ID no. 4603111
  misc_feature (53)..(105): PFAM Description: Auxin responsive protein
  misc_feature (1)..(105): GI NO: 50946385 NR DESCRIPTION: auxin-induced protein-related-like protein
  misc_feature (53)..(105): GI NO: 15242071 NR DESCRIPTION: putative protein; protein id: At5g20820.1
  misc_feature (53)..(105): GI NO: 21554070 NR DESCRIPTION: unknown
MIRRWHSSSRISRTPSAVSHGGGEEEDPWGRGVGGGGGGAASFHGADGVPPGLHPVYVGKSRRRYLIAADLVCHPLFQNLVDRSGGGVGGDGAGGTIIGCEVVLFE

SEQ ID NO: 4659 - DNA, 481 bp, Triticum aestivum
  misc_feature (1)..(481): useful for making plants with increased drought tolerance as described in USSN 11/241,685
  misc_feature (1)..(481): Ceres Seq. ID no. 11427493
  misc_feature (382)..(382): n is a, c, t, g, unknown, or other
gccaagaaacgaagctgctagctgctcggcgcacacatgtcgtcatcctcctcctctgcgccagcggccgccgtggcgacgtcgacccgcctcatcctggtgcacggcacgggccacggcgggtggtgctggtacaaggtcgccaccctcctccgcgccgcggggcaccgcgtcgacgcgccggacctcgcggcctgcggcgccgacgcgcgccggctgagcgacgcgccaaccttcgaggactacacgcgccccctgctcgacgcgctccgggccctcccggacggcgagcgagcggtgctcgtgggccacagcttcggcggcatgagcgtcgcgctcgccgccgaggagttccccgacaaggtcgccgccgccgtgttcntcagcgccttcatgccggactgcgccggcccgcgcacccgcgttatcgagcaggtccccgtgtccgactggatggacagcgtgstcgacgaggagcacg

SEQ ID NO: 4660 - protein, 159 aa, Triticum aestivum
  misc_feature (1)..(159): useful for making plants with increased drought tolerance as described in USSN 11/241,685
  misc_feature (1)..(159): Ceres Seq. ID no. 11427494
  misc_feature (20)..(158): PFAM Description: Subtilase family
  misc_feature (127)..(127): Xaa is any aa, unknown or other
  misc_feature (155)..(155): Xaa is any aa, unknown or other
QETKLLAARRTHVVILLLCASGRRGDVDPPHPGARHGPRRVVLVQGRHPPPRRGAPRRRAGPRGLRRRRAPAERRANLRGLHAPPARRAPGPPGRRASGARGPQLRRHERRARRRGVPRQGRRRRVXQRLHAGLRRPAHPRYRAGPRVRLDGQRXRRGA

SEQ ID NO: 4661 - protein, 148 aa, Triticum aestivum
  misc_feature (1)..(148): useful for making plants with increased drought tolerance as described in USSN 11/241,685
  misc_feature (1)..(148): Ceres Seq. ID no. 11427495
  misc_feature (44)..(147): PFAM Description: alpha/beta hydrolase fold
  misc_feature (5)..(147): GI NO: 34915034 NR DESCRIPTION: putative acetone-cyanohydrin lyase
  misc_feature (1)..(147): GI NO: 34914020 NR DESCRIPTION: OJ1014_G12.25
  misc_feature (8)..(141): GI NO: 34914024 NR DESCRIPTION: OJ1014_G12.27
  misc_feature (19)..(146): GI NO: 34908770 NR DESCRIPTION: P0415A04.19
  misc_feature (14)..(127): GI NO: 34907174 NR DESCRIPTION: putative pir7b (Pseudomonas inducible protein)
  misc_feature (14)..(146): GI NO: 34907176 NR DESCRIPTION: pir7b protein (Pseudomonas inducible protein)
  misc_feature (20)..(146): GI NO: 498747 NR DESCRIPTION: Pir7b
  misc_feature (20)..(134): GI NO: 7488034 NR DESCRIPTION: probable (S)-acetone-cyanohydrin lyase
  misc_feature (20)..(125): GI NO: 34907178 NR DESCRIPTION: pir7a protein (Pseudomonas inducible protein)
  misc_feature (20)..(140): GI NO: 27754457 NR DESCRIPTION: putative acetone-cyanohydrin lyase
  misc_feature (116)..(116): Xaa is any aa, unknown or other
  misc_feature (144)..(144): Xaa is any aa, unknown or other
MSSSSSSAPAAAVATSTRLILVHGTGHGGWCWYKVATLLRAAGHRVDAPDLAACGADARRLSDAPTFEDYTRPLLDALRALPDGERAVLVGHSFGGMSVALAAEEFPDKVAAAVFXSAFMPDCAGPRTRVIEQVPVSDWMDSVXDEEH

SEQ ID NO: 4662 - DNA, 832 bp, Zea mays subsp. mays
  misc_feature (1)..(832): useful for making plants with increased drought tolerance as described in USSN 11/241,685
  misc_feature (1)..(832): Ceres Seq. ID no. 12402005
accacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacgggccactaccgccccgccaactgggccgccgccgtcgaccccgccgacctccgcgccgctcacctcgcccgcacctacgcccgggcctgagcggccccggctcccttcaccctgctccgcctcgtctcgtatgacatacgcgcaccgtacgtaccagggtgagacgaggtgaggggtcggggttcgtgtggcgaacggcgtgttgagccacgcgcgcgtgcgcccgcgctctgtgacgcccggaacgttcttgggagagcgcgagcgaggtcttgtctcttctcggtgcgggtcgctgtgccatgtgatgtgatgtgacgctggatcgttttgggtccgaccaacgggagaagagcggcctgtggtcgccgtcgccgccgtgtgtgggctggatggcctgctttcttgtgctcctcctatatatcagatgtactccctccaaggagcagggtttcgctaccttttcgtactcgctacagctacagctagtacgtactatactaataaaagctgcagtttcttc

SEQ ID NO: 4663 - protein, 132 aa, Zea mays subsp. mays
  misc_feature (1)..(132): useful for making plants with increased drought tolerance as described in USSN 11/241,685
  misc_feature (1)..(132): Ceres Seq. ID no. 12402006
  misc_feature (38)..(125): PFAM Description: Late embryogenesis abundant protein
  misc_feature (32)..(132): GI NO: 7489602 NR DESCRIPTION: zinc inducible protein homolog
  misc_feature (32)..(112): GI NO: 7489606 NR DESCRIPTION: zinc-induced protein
  misc_feature (32)..(112): GI NO: 19347607 NR DESCRIPTION: Ramy1
TTPHAPQSRARGPESRAPSAILCLPKQQAAAATAAGPMALSLSGTSARFALASLVPRARAYAASAASGAMRRAAEGAAAGEAKEAGRAAAAAAEGSWVPDPVTGHYRPANWAAAVDPADLRAAHLARTYARA

SEQ ID NO: 4664 - protein, 95 aa, Zea mays subsp. mays
  misc_feature (1)..(95): useful for making plants with increased drought tolerance as described in USSN 11/241,685
  misc_feature (1)..(95): Ceres Seq. ID no. 12402007
  misc_feature (1)..(88): PFAM Description: Late embryogenesis abundant protein
  misc_feature (1)..(95): GI NO: 7489602 NR DESCRIPTION: zinc inducible protein homolog
  misc_feature (1)..(75): GI NO: 7489606 NR DESCRIPTION: zinc-induced protein
  misc_feature (1)..(75): GI NO: 19347607 NR DESCRIPTION: Ramy1
MALSLSGTSARFALASLVPRARAYAASAASGAMRRAAEGAAAGEAKEAGRAAAAAAEGSWVPDPVTGHYRPANWAAAVDPADLRAAHLARTYARA

SEQ ID NO: 4665 - protein, 69 aa, Zea mays subsp. mays
  misc_feature (1)..(69): useful for making plants with increased drought tolerance as described in USSN 11/241,685
  misc_feature (1)..(69): Ceres Seq. ID no. 12402008
  misc_feature (36)..(69): GI NO: 21219450 NR DESCRIPTION: putative secreted proline-rich protein
  misc_feature (42)..(69): GI NO: 6523547 NR DESCRIPTION: hydroxyproline-rich glycoprotein DZ-HRGP
  misc_feature (43)..(69): GI NO: 50728126 NR DESCRIPTION: PREDICTED: similar to Wiskott-Aldrich syndrome gene-like protein; neural Wiskott-Aldrich syndrome protein; Wiskott-Aldrich syndrome gene-like
  misc_feature (46)..(69): GI NO: 6649859 NR DESCRIPTION: kexin-like serine endoprotease
  misc_feature (45)..(69): GI NO: 15706272 NR DESCRIPTION: N-WASP protein
  misc_feature (43)..(69): GI NO: 6523547 NR DESCRIPTION: hydroxyproline-rich glycoprotein DZ-HRGP
  misc_feature (5)..(69): GI NO: 23274133 NR DESCRIPTION: Similar to serine/arginine repetitive matrix 1
  misc_feature (5)..(69): GI NO: 42542379 NR DESCRIPTION: Ser/Arg-related nuclear matrix protein
  misc_feature (43)..(69): GI NO: 6523547 NR DESCRIPTION: hydroxyproline-rich glycoprotein DZ-HRGP
  misc_feature (43)..(69): GI NO: 6523547 NR DESCRIPTION: hydroxyproline-rich glycoprotein DZ-HRGP
PHHTRRKAEHGGLRAERHQPSFACPSSKQQQQRRLARWLCLSPAPPPASPSRRWSPGPGPTRRRRRPGP

SEQ ID NO: 4666 - DNA, 992 bp, Zea mays subsp. mays
  misc_feature (1)..(992): useful for making plants with increased drought tolerance as described in USSN 11/241,685
  misc_feature (1)..(992): Ceres Seq. ID no. 12391473
gcacgagaccattacctagaacatcctaatcgaaaagatcgaagtgtgcttgcgtcctgatcccaccaaccgcagaggacagaggaccatggagagcggcacggagcggcggcggcaccacttcgtgctggtgcacggcacctgccacggcgcgtggtgctggtacaaggtggccaccctcctgtcatccgcgggccaccgcgtgacggcgctggacatggccgcgtgcggcgccagccccgggcgcgccgaggaggtgccgtcctttgaggagtacagccgcccgctcctggccacggtggccggcctggcgcccgaggagaaggtggtcctcgtcggccacagcttcggcggggtcagcctcgcgctggccatggagcagtacccggacagggtcgccgtcgccgtcttcgtcgcgaccggcatgccctccgctgggaagccgatggcgttcgtcttcgagcagtttttgcaagaagagtacccagcggaccgctacatggactgcgaattcgaaaccagcggcgacccccagcgtcccgtggagacatttcggttcgggccacagtacctgaagcagagactgtaccagctcagccccccagaggatttgaccctggcaatggcgatgttgaggccgtcacagcggttccgagacgacgcgacgatgaaggggggcgtcctgacggcggagcggtacggcggcgtgaggcgggtgtgcgtcgtcgccgaggacgacgcgtcagtgccggcaggcttcctgcggcggatggcgtcgtggaaccccggcacggaggtgagggggttgcagggagccgatcatatgtccatgctctcgaaaccaggggagctgtcagaacttctcatggaggttgccaacaagtacagctgaaacttgtatcatgtaaatggctatcagcaaaatggttgttcaggtacgcttgtttcagatgaacaaatggagacggaagtttgaagtaacacgatgaaat

SEQ ID NO: 4667 - protein, 267 aa, Zea mays subsp. mays
  misc_feature (1)..(267): useful for making plants with increased drought tolerance as described in USSN 11/241,685
  misc_feature (1)..(267): Ceres Seq. ID no. 12391474
  misc_feature (37)..(261): PFAM Description: alpha/beta hydrolase fold
  misc_feature (1)..(266): GI NO: 34907176 NR DESCRIPTION: pir7b protein (Pseudomonas inducible protein)
  misc_feature (9)..(266): GI NO: 498747 NR DESCRIPTION: Pir7b
  misc_feature (11)..(266): GI NO: 34907178 NR DESCRIPTION: pir7a protein (Pseudomonas inducible protein)
  misc_feature (11)..(267): GI NO: 40549303 NR DESCRIPTION: salicylic acid-binding protein 2
  misc_feature (1)..(118): GI NO: 34907174 NR DESCRIPTION: putative pir7b (Pseudomonas inducible protein)
  misc_feature (172)..(266): GI NO: 34907174 NR DESCRIPTION: putative pir7b (Pseudomonas inducible protein)
  misc_feature (6)..(266): GI NO: 27754457 NR DESCRIPTION: putative acetone-cyanohydrin lyase
  misc_feature (1)..(267): GI NO: 14279437 NR DESCRIPTION: ethylene-induced esterase
  misc_feature (11)..(267): GI NO: 34908770 NR DESCRIPTION: P0415A04.19
  misc_feature (12)..(263): GI NO: 21595837 NR DESCRIPTION: polyneuridine aldehyde esterase
MESGTERRRHHFVLVHGTCHGAWCWYKVATLLSSAGHRVTALDMAACGASPGRAEEVPSFEEYSRPLLATVAGLAPEEKVVLVGHSFGGVSLALAMEQYPDRVAVAVFVATGMPSAGKPMAFVFEQFLQEEYPADRYMDCEFETSGDPQRPVETFRFGPQYLKQRLYQLSPPEDLTLAMAMLRPSQRFRDDATMKGGVLTAERYGGVRRVCVVAEDDASVPAGFLRRMASWNPGTEVRGLQGADHMSMLSKPGELSELLMEVANKYS

SEQ ID NO: 4668 - protein, 224 aa, Zea mays subsp. mays
  misc_feature (1)..(224): useful for making plants with increased drought tolerance as described in USSN 11/241,685
  misc_feature (1)..(224): Ceres Seq. ID no. 12391475
  misc_feature (1)..(218): PFAM Description: alpha/beta hydrolase fold
  misc_feature (1)..(223): GI NO: 34907176 NR DESCRIPTION: pir7b protein (Pseudomonas inducible protein)
  misc_feature (1)..(223): GI NO: 498747 NR DESCRIPTION: Pir7b
  misc_feature (1)..(223): GI NO: 34907178 NR DESCRIPTION: pir7a protein (Pseudomonas inducible protein)
  misc_feature (1)..(224): GI NO: 40549303 NR DESCRIPTION: salicylic acid-binding protein 2
  misc_feature (1)..(75): GI NO: 34907174 NR DESCRIPTION: putative pir7b (Pseudomonas inducible protein)
  misc_feature (129)..(223): GI NO: 34907174 NR DESCRIPTION: putative pir7b (Pseudomonas inducible protein)
  misc_feature (1)..(223): GI NO: 27754457 NR DESCRIPTION: putative acetone-cyanohydrin lyase
  misc_feature (1)..(224): GI NO: 14279437 NR DESCRIPTION: ethylene-induced esterase
  misc_feature (1)..(224): GI NO: 34908770 NR DESCRIPTION: P0415A04.19
  misc_feature (1)..(220): GI NO: 21595837 NR DESCRIPTION: polyneuridine aldehyde esterase
MAACGASPGRAEEVPSFEEYSRPLLATVAGLAPEEKVVLVGHSFGGVSLALAMEQYPDRVAVAVFVATGMPSAGKPMAFVFEQFLQEEYPADRYMDCEFETSGDPQRPVETFRFGPQYLKQRLYQLSPPEDLTLAMAMLRPSQRFRDDATMKGGVLTAERYGGVRRVCVVAEDDASVPAGFLRRMASWNPGTEVRGLQGADHMSMLSKPGELSELLMEVANKYS

SEQ ID NO: 4669 - protein, 172 aa, Zea mays subsp. mays
  misc_feature (1)..(172): useful for making plants with increased drought tolerance as described in USSN 11/241,685
  misc_feature (1)..(172): Ceres Seq. ID no. 12391476
  misc_feature (1)..(166): PFAM Description: alpha/beta hydrolase fold
  misc_feature (1)..(171): GI NO: 34907176 NR DESCRIPTION: pir7b protein (Pseudomonas inducible protein)
  misc_feature (1)..(171): GI NO: 498747 NR DESCRIPTION: Pir7b
  misc_feature (1)..(171): GI NO: 34907178 NR DESCRIPTION: pir7a protein (Pseudomonas inducible protein)
  misc_feature (1)..(172): GI NO: 40549303 NR DESCRIPTION: salicylic acid-binding protein 2
  misc_feature (1)..(23): GI NO: 34907174 NR DESCRIPTION: putative pir7b (Pseudomonas inducible protein)
  misc_feature (77)..(171): GI NO: 34907174 NR DESCRIPTION: putative pir7b (Pseudomonas inducible protein)
  misc_feature (1)..(171): GI NO: 27754457 NR DESCRIPTION: putative acetone-cyanohydrin lyase
  misc_feature (1)..(172): GI NO: 14279437 NR DESCRIPTION: ethylene-induced esterase
  misc_feature (1)..(172): GI NO: 34908770 NR DESCRIPTION: P0415A04.19
  misc_feature (1)..(168): GI NO: 21595837 NR DESCRIPTION: polyneuridine aldehyde esterase
MEQYPDRVAVAVFVATGMPSAGKPMAFVFEQFLQEEYPADRYMDCEFETSGDPQRPVETFRFGPQYLKQRLYQLSPPEDLTLAMAMLRPSQRFRDDATMKGGVLTAERYGGVRRVCVVAEDDASVPAGFLRRMASWNPGTEVRGLQGADHMSMLSKPGELSELLMEVANKYS

SEQ ID NO: 4670 - DNA, 953 bp, Zea mays subsp. mays
  misc_feature (1)..(953): useful for making plants with increased drought tolerance as described in USSN 11/241,685
  misc_feature (1)..(953): Ceres Seq. ID no. 13599613
aggaaataatatacaaaatcaaaggttaagaaaaaaaatgggtgaggagaagaatcagcagcacttcgtgctagtacatggtgcatgccacggcgcgtggtgctggaacaaggttaagccgcttctcgaggcctccggccaccgcgtaaccgccttagacctagctgcttcgggtatagacacaaccaggtctatcactgagatctccacatgcgaacaatactctgagccattgatacagctaatcgcctcattaccaagtgatgagaaggttgtgctcgttggtcatagctttggagggttcagcttagccatggccatggataagtttccagacaaaatctctgtctcagtcttcgtgactgctttcatgcccgataccaaacactcaccatcgttcgtcgtggataagtttaaacgggatacgccaccagaagcatggttgggctcggagttcaaatcatatggctcagacaattccggtgtgtcaatgtctttcagcactgagttcatgaagcacgctctctatcaactttctcctgttgaggatattgagcttggattgcttttaaagaggcccggatcattgttcatcaacgatttatccaaggtggagaacttttcggacaaagggtatggatctgttcctcgagcttacattgtgtgcaaagaggacaaaacaattacaaaagaaattcagtggtggatgatcgataattatccgacgaaagtagtgaaggagatggaggacacagatcatatgccaatgttctgcaagcctcagttactaagtgactatctcttggaaatcgcggaaaaattagcttaaattatcttgttatgaaaatgtatttggatacaaataagtgttgtcctgcaaatgggtctttctaaagatcaagacttttatcgcgttcaaatgtttgacataatttaaaataaacttaacagtc

SEQ ID NO: 4671 - protein, 275 aa, Zea mays subsp. mays
  misc_feature (1)..(275): useful for making plants with increased drought tolerance as described in USSN 11/241,685
  misc_feature (1)..(275): Ceres Seq. ID no. 15218860
  misc_feature (47)..(268): PFAM Description: alpha/beta hydrolase fold
  misc_feature (13)..(275): GI NO: 21554666 NR DESCRIPTION: putative acetone-cyanohydrin lyase
  misc_feature (13)..(273): GI NO: 27754457 NR DESCRIPTION: putative acetone-cyanohydrin lyase
  misc_feature (19)..(275): GI NO: 14279437 NR DESCRIPTION: ethylene-induced esterase
  misc_feature (17)..(273): GI NO: 40549303 NR DESCRIPTION: salicylic acid-binding protein 2
  misc_feature (20)..(275): GI NO: 34908770 NR DESCRIPTION: P0415A04.19
  misc_feature (23)..(275): GI NO: 34915034 NR DESCRIPTION: putative acetone-cyanohydrin lyase
  misc_feature (22)..(272): GI NO: 21595837 NR DESCRIPTION: polyneuridine aldehyde esterase
  misc_feature (15)..(272): GI NO: 25404802 NR DESCRIPTION: probable alpha/beta hydrolase F23O10.18
  misc_feature (55)..(255): GI NO: 25518436 NR DESCRIPTION: hypothetical protein T1K7.26
  misc_feature (22)..(130): GI NO: 21222782 NR DESCRIPTION: putative esterase
GNNIQNQRLRKKMGEEKNQQHFVLVHGACHGAWCWNKVKPLLEASGHRVTALDLAASGIDTTRSITEISTCEQYSEPLIQLIASLPSDEKVVLVGHSFGGFSLAMAMDKFPDKISVSVFVTAFMPDTKHSPSFVVDKFKRDTPPEAWLGSEFKSYGSDNSGVSMSFSTEFMKHALYQLSPVEDIELGLLLKRPGSLFINDLSKVENFSDKGYGSVPRAYIVCKEDKTITKEIQWWMIDNYPTKVVKEMEDTDHMPMFCKPQLLSDYLLEIAEKLA

SEQ ID NO: 4672 - protein, 263 aa, Zea mays subsp. mays
  misc_feature (1)..(263): useful for making plants with increased drought tolerance as described in USSN 11/241,685
  misc_feature (1)..(263): Ceres Seq. ID no. 15218861
  misc_feature (35)..(256): PFAM Description: alpha/beta hydrolase fold
  misc_feature (1)..(263): GI NO: 21554666 NR DESCRIPTION: putative acetone-cyanohydrin lyase
  misc_feature (1)..(261): GI NO: 27754457 NR DESCRIPTION: putative acetone-cyanohydrin lyase
  misc_feature (7)..(263): GI NO: 14279437 NR DESCRIPTION: ethylene-induced esterase
  misc_feature (5)..(261): GI NO: 40549303 NR DESCRIPTION: salicylic acid-binding protein 2
  misc_feature (8)..(263): GI NO: 34908770 NR DESCRIPTION: P0415A04.19
  misc_feature (11)..(263): GI NO: 34915034 NR DESCRIPTION: putative acetone-cyanohydrin lyase
  misc_feature (10)..(260): GI NO: 21595837 NR DESCRIPTION: polyneuridine aldehyde esterase
  misc_feature (3)..(260): GI NO: 25404802 NR DESCRIPTION: probable alpha/beta hydrolase F23O10.18
  misc_feature (43)..(243): GI NO: 25518436 NR DESCRIPTION: hypothetical protein T1K7.26
  misc_feature (10)..(118): GI NO: 21222782 NR DESCRIPTION: putative esterase
MGEEKNQQHFVLVHGACHGAWCWNKVKPLLEASGHRVTALDLAASGIDTTRSITEISTCEQYSEPLIQLIASLPSDEKVVLVGHSFGGFSLAMAMDKFPDKISVSVFVTAFMPDTKHSPSFVVDKFKRDTPPEAWLGSEFKSYGSDNSGVSMSFSTEFMKHALYQLSPVEDIELGLLLKRPGSLFINDLSKVENFSDKGYGSVPRAYIVCKEDKTITKEIQWWMIDNYPTKVVKEMEDTDHMPMFCKPQLLSDYLLEIAEKLA

SEQ ID NO: 4673 - protein, 171 aa, Zea mays subsp. mays
  misc_feature (1)..(171): useful for making plants with increased drought tolerance as described in USSN 11/241,685
  misc_feature (1)..(171): Ceres Seq. ID no. 15218862
  misc_feature (1)..(164): PFAM Description: alpha/beta hydrolase fold
  misc_feature (1)..(171): GI NO: 21554666 NR DESCRIPTION: putative acetone-cyanohydrin lyase
  misc_feature (1)..(169): GI NO: 27754457 NR DESCRIPTION: putative acetone-cyanohydrin lyase
  misc_feature (1)..(171): GI NO: 14279437 NR DESCRIPTION: ethylene-induced esterase
  misc_feature (1)..(169): GI NO: 40549303 NR DESCRIPTION: salicylic acid-binding protein 2
  misc_feature (1)..(171): GI NO: 34908770 NR DESCRIPTION: P0415A04.19
  misc_feature (1)..(171): GI NO: 34915034 NR DESCRIPTION: putative acetone-cyanohydrin lyase
  misc_feature (1)..(168): GI NO: 21595837 NR DESCRIPTION: polyneuridine aldehyde esterase
  misc_feature (1)..(168): GI NO: 25404802 NR DESCRIPTION: probable alpha/beta hydrolase F23O10.18
  misc_feature (1)..(151): GI NO: 25518436 NR DESCRIPTION: hypothetical protein T1K7.26
  misc_feature (1)..(26): GI NO: 21222782 NR DESCRIPTION: putative esterase
MAMDKFPDKISVSVFVTAFMPDTKHSPSFVVDKFKRDTPPEAWLGSEFKSYGSDNSGVSMSFSTEFMKHALYQLSPVEDIELGLLLKRPGSLFINDLSKVENFSDKGYGSVPRAYIVCKEDKTITKEIQWWMIDNYPTKVVKEMEDTDHMPMFCKPQLLSDYLLEIAEKLA

SEQ ID NO: 4674 - DNA, 279 bp, Brassica napus
  misc_feature (1)..(279): useful for making plants with increased drought tolerance as described in USSN 11/241,685
  misc_feature (1)..(279): Ceres Seq. ID no. 4779038
  misc_feature (198)..(198): n is a, c, t, g, unknown, or other
aagaacatctcaaacatttttattcttcattcaatattttgagacccccccacacacacactcatataatcatttatcctcataaaccctaaaccctacctagtttcagcaactatattgttccaaatccaagagaaagggttagattctttttcaatggccaaagttgggaagctgacaaagctcaagtcggcgatnaagaaatggccttcattcgccaagaaccaccaccactcatcctcctcagccgccgtctccgatgagctctcagaggacaac

SEQ ID NO: 4675 - protein, 41 aa, Brassica napus
  misc_feature (1)..(41): useful for making plants with increased drought tolerance as described in USSN 11/241,685
  misc_feature (1)..(41): Ceres Seq. ID no. 4779039
  misc_feature (14)..(14): Xaa is any aa, unknown or other
MAKVGKLTKLKSAXKKWPSFAKNHHHSSSSAAVSDELSEDN

SEQ ID NO: 4676 - protein, 263 aa, Arabidopsis thaliana; identical to SEQ ID NO: 2997
  misc_feature (1)..(263): useful for making plants with increased drought tolerance as described in USSN 11/241,685
  misc_feature (1)..(263): Public GI no. 48310671
  misc_feature (1)..(263): Ortholog of  Ceres CDNA ID no. 12333678 with e-value of 1.59E-115 and percent identity of 80.61

SEQ ID NO: 4677 - protein, 263 aa, Arabidopsis thaliana; identical to SEQ ID NO: 2997
  misc_feature (1)..(263): useful for making plants with increased drought tolerance as described in USSN 11/241,685
  misc_feature (1)..(263): Ceres CLONE ID no. 1010900
  misc_feature (1)..(263): Ortholog of  Ceres CDNA ID no. 12333678 with e-value of 1.40E-115 and percent identity of 80.61

SEQ ID NO: 4678 - protein, 263 aa, Arabidopsis thaliana; identical to SEQ ID NO: 2999
  misc_feature (1)..(263): useful for making plants with increased drought tolerance as described in USSN 11/241,685
  misc_feature (1)..(263): Public GI no. 27754457
  misc_feature (1)..(263): Ortholog of  Ceres CDNA ID no. 12333678 with e-value of 2.89E-115 and percent identity of 80.61

SEQ ID NO: 4679 - protein, 263 aa, Zea mays; identical to SEQ ID NO: 4672
  misc_feature (1)..(263): useful for making plants with increased drought tolerance as described in USSN 11/241,685
  misc_feature (1)..(263): Ceres CLONE ID no. 1065042
  misc_feature (1)..(263): Ortholog of  Ceres CDNA ID no. 12333678 with e-value of 8.69E-114 and percent identity of 79.85

SEQ ID NO: 4680 - protein, 272 aa, Arabidopsis thaliana
  misc_feature (1)..(272): useful for making plants with increased drought tolerance as described in USSN 11/241,685
  misc_feature (1)..(272): Public GI no. 3242720
  misc_feature (1)..(272): Ortholog of  Ceres CDNA ID no. 12333678 with e-value of 6.40E-110 and percent identity of 83.07
MYENGISFIISLLICGCVKSEEMMKQHFVLVHGSCLGAWCWYKVKPLLEASGHRVTALDLAACGIDTRSITDISTCEQYSEPLIQLMTSLPNDEKVVLVGHSYGGLTLAIAMDKFPDKISVSVFVTSFMPDTKNSPSFVLEKFASTMTPEDWMGSELEPYVVFSAEFTKHRILQLSPIEDLELRLLLKRPGSLFLNDLSRMKNFSEKGYGSVPRAYIVSKDDHTISEEYQRWMIDNYPPNLVIEMEGTDHLPLFCKPQLLSDHLLAIADKFS

SEQ ID NO: 4681 - protein, 267 aa, Citrus sinensis; identical to SEQ ID NO: 2996
  misc_feature (1)..(267): useful for making plants with increased drought tolerance as described in USSN 11/241,685
  misc_feature (1)..(267): Public GI no. 14279437
  misc_feature (1)..(267): Ortholog of  Ceres CDNA ID no. 12333678 with e-value of 1.09E-69 and percent identity of 54.58

SEQ ID NO: 4682 - protein, 260 aa, Nicotiana tabacum; identical to SEQ ID NO: 3006
  misc_feature (1)..(260): useful for making plants with increased drought tolerance as described in USSN 11/241,685
  misc_feature (1)..(260): Public GI no. 40549303
  misc_feature (1)..(260): Ortholog of  Ceres CDNA ID no. 12333678 with e-value of 4.09E-68 and percent identity of 53.67

SEQ ID NO: 4683 - protein, 264 aa, Rauvolfia serpentina; identical to SEQ ID NO: 3004
  misc_feature (1)..(264): useful for making plants with increased drought tolerance as described in USSN 11/241,685
  misc_feature (1)..(264): Public GI no. 50401192
  misc_feature (1)..(264): Ortholog of  Ceres CDNA ID no. 12333678 with e-value of 8.00E-64 and percent identity of 48.46

SEQ ID NO: 4684 - protein, 130 aa, Arabidopsis thaliana; identical to SEQ ID NO: 4597
  misc_feature (1)..(130): useful for making plants with increased drought tolerance as described in USSN 11/241,685
  misc_feature (1)..(130): Ceres CLONE ID no. 25463
  misc_feature (1)..(130): Ortholog of  Ceres CDNA ID no. 12333678 with e-value of 1.49E-63 and percent identity of 96.92

SEQ ID NO: 4685 - protein, 141 aa, Arabidopsis thaliana
  misc_feature (1)..(141): useful for making plants with increased drought tolerance as described in USSN 11/241,685
  misc_feature (1)..(141): Public GI no. 7488034
  misc_feature (1)..(141): Ortholog of  Ceres CDNA ID no. 12333678 with e-value of 4.79E-58 and percent identity of 81.56
MSEEKRKQHFVLVHGSCHGAWCWYKVKPLLEAVGHRVTAVDLAASGIDTTRSITDIPTCEQYSEPLTKLLTSLPNDEKVVLVGHSFGGLNLAIAMEKFPEKISVAVFLTAFMPDTEHSPSFVLDKVLEATCLKKHGWAPNS

SEQ ID NO: 4686 - protein, 268 aa, Triticum aestivum; identical to SEQ ID NO: 4634
  misc_feature (1)..(268): useful for making plants with increased drought tolerance as described in USSN 11/241,685
  misc_feature (1)..(268): Ceres CLONE ID no. 644331
  misc_feature (1)..(268): Ortholog of  Ceres CDNA ID no. 12333678 with e-value of 7.09E-32 and percent identity of 33.08

SEQ ID NO: 4687 - protein, 267 aa, Zea mays; identical to SEQ ID NO: 4667
  misc_feature (1)..(267): useful for making plants with increased drought tolerance as described in USSN 11/241,685
  misc_feature (1)..(267): Ceres CLONE ID no. 381168
  misc_feature (1)..(267): Ortholog of  Ceres CDNA ID no. 12333678 with e-value of 1.10E-51 and percent identity of 43.51

SEQ ID NO: 4688 - protein, 268 aa, Oryza sativa subsp. indica; identical to SEQ ID NO: 3010
  misc_feature (1)..(268): useful for making plants with increased drought tolerance as described in USSN 11/241,685
  misc_feature (1)..(268): Public GI no. 34907176
  misc_feature (1)..(268): Ortholog of  Ceres CDNA ID no. 12333678 with e-value of 1.29E-50 and percent identity of 43.13

SEQ ID NO: 4689 - protein, 262 aa, Oryza sativa subsp. japonica
  misc_feature (1)..(262): useful for making plants with increased drought tolerance as described in USSN 11/241,685
  misc_feature (1)..(262): Public GI no. 498747
  misc_feature (1)..(262): Ortholog of  Ceres CDNA ID no. 12333678 with e-value of 1.29E-50 and percent identity of 43.58
SKKHFILVHGLCHGAWCWYRVVAALRAAGHRATALDMAASGAHPARVDEVGTFEEYSRPLLDAVAAAAAPGERLVLVGHSHGGLSVALAMERFPDKVAAAVFVAAAMPCVGKHMGVPTEEFMRRTAPEGLLMDCEMVAINNSQGSGVAINLGPTFLAQKYYQQSPAEDLALAKMLVRPGNQFMDDPVMKDESLLTNGNYGSVKKVYVIAKADSSSTEEMQRWMVAMSPGTDVEEIAGADHAVMNSKPRELCDILIKIANKYE

SEQ ID NO: 4690 - protein, 273 aa, Glycine max; identical to SEQ ID NO: 4628
  misc_feature (1)..(273): useful for making plants with increased drought tolerance as described in USSN 11/241,685
  misc_feature (1)..(273): Ceres CLONE ID no. 1059805
  misc_feature (1)..(273): Ortholog of  Ceres CDNA ID no. 12333678 with e-value of 1.09E-49 and percent identity of 41.6

SEQ ID NO: 4691 - protein, 265 aa, Triticum aestivum; identical to SEQ ID NO: 3009
  misc_feature (1)..(265): useful for making plants with increased drought tolerance as described in USSN 11/241,685
  misc_feature (1)..(265): Ceres CLONE ID no. 936068
  misc_feature (1)..(265): Ortholog of  Ceres CDNA ID no. 12333678 with e-value of 2.09E-23 and percent identity of 53.26

SEQ ID NO: 4692 - protein, 93 aa, Brassica napus; identical to SEQ ID NO: 4576
  misc_feature (1)..(93): useful for making plants with increased drought tolerance as described in USSN 11/241,685
  misc_feature (1)..(93): Ceres CLONE ID no. 1034942
  misc_feature (1)..(93): Ortholog of  Ceres CDNA ID no. 12333678 with e-value of 3.90E-40 and percent identity of 87.1

SEQ ID NO: 4693 - protein, 135 aa, Glycine max; identical to SEQ ID NO: 4617
  misc_feature (1)..(135): useful for making plants with increased drought tolerance as described in USSN 11/241,685
  misc_feature (1)..(135): Ceres CLONE ID no. 723429
  misc_feature (1)..(135): Ortholog of  Ceres CDNA ID no. 12333678 with e-value of 4.39E-39 and percent identity of 58.78

SEQ ID NO: 4694 - protein, 215 aa, Oryza sativa subsp. japonica
  misc_feature (1)..(215): useful for making plants with increased drought tolerance as described in USSN 11/241,685
  misc_feature (1)..(215): Public GI no. 34907174
  misc_feature (1)..(215): Ortholog of  Ceres CDNA ID no. 12333678 with e-value of 8.79E-34 and percent identity of 45.28
MEGSSSSSKHFILVHGLCHGAWCWYKVVTMLRSEGHRVTALDLAASGVHPARVDEVHSFEEYSQPLLDAVAEAPAGERLILVGHSFGGLSIALAMERFPEKIAVAVFVAAAVPCVGKRIIPEDLTLAKLLVRPTSQFVDDPTMKDDRLLTSANYGSVKRVCLMAMEDDLKEVHRYMITLSPGVEVEEIAGADHAVMCSRPRELSDLLAKIGSKYD

SEQ ID NO: 4695 - protein, 125 aa, Triticum aestivum; identical to SEQ ID NO: 4653
  misc_feature (1)..(125): useful for making plants with increased drought tolerance as described in USSN 11/241,685
  misc_feature (1)..(125): Ceres CLONE ID no. 1005331
  misc_feature (1)..(125): Ortholog of  Ceres CDNA ID no. 12333678 with e-value of 1.70E-30 and percent identity of 56.3

SEQ ID NO: 4696 - protein, 131 aa, Glycine max; identical to SEQ ID NO: 4621
  misc_feature (1)..(131): useful for making plants with increased drought tolerance as described in USSN 11/241,685
  misc_feature (1)..(131): Ceres CLONE ID no. 1016894
  misc_feature (1)..(131): Ortholog of  Ceres CDNA ID no. 12333678 with e-value of 1.19E-29 and percent identity of 53.28

SEQ ID NO: 4697 - protein, 140 aa, Triticum aestivum; identical to SEQ ID NO: 4642
  misc_feature (1)..(140): useful for making plants with increased drought tolerance as described in USSN 11/241,685
  misc_feature (1)..(140): Ceres CLONE ID no. 757560
  misc_feature (1)..(140): Ortholog of  Ceres CDNA ID no. 12333678 with e-value of 4.09E-29 and percent identity of 47.73
  misc_feature (84)..(84): Xaa is any aa, unknown, or other

SEQ ID NO: 4698 - protein, 148 aa, Triticum aestivum; identical to SEQ ID NO: 4661
  misc_feature (1)..(148): useful for making plants with increased drought tolerance as described in USSN 11/241,685
  misc_feature (1)..(148): Ceres CLONE ID no. 1018595
  misc_feature (1)..(148): Ortholog of  Ceres CDNA ID no. 12333678 with e-value of 4.09E-29 and percent identity of 50.36
  misc_feature (116)..(116): Xaa is any aa, unknown, or other
  misc_feature (144)..(144): Xaa is any aa, unknown, or other

SEQ ID NO: 4699 - protein, 130 aa, Triticum aestivum; identical to SEQ ID NO: 4637
  misc_feature (1)..(130): useful for making plants with increased drought tolerance as described in USSN 11/241,685
  misc_feature (1)..(130): Ceres CLONE ID no. 735301
  misc_feature (1)..(130): Ortholog of  Ceres CDNA ID no. 12333678 with e-value of 6.60E-29 and percent identity of 47.69

SEQ ID NO: 4700 - protein, 154 aa, Triticum aestivum; identical to SEQ ID NO: 4631
  misc_feature (1)..(154): useful for making plants with increased drought tolerance as described in USSN 11/241,685
  misc_feature (1)..(154): Ceres CLONE ID no. 616073
  misc_feature (1)..(154): Ortholog of  Ceres CDNA ID no. 12333678 with e-value of 9.59E-21 and percent identity of 41.41

SEQ ID NO: 4701 - protein, 116 aa, Brassica napus; identical to SEQ ID NO: 4582
  misc_feature (1)..(116): useful for making plants with increased drought tolerance as described in USSN 11/241,685
  misc_feature (1)..(116): Ceres CLONE ID no. 1128552
  misc_feature (1)..(116): Ortholog of  Ceres CDNA ID no. 12393104 with e-value of 5.89E-52 and percent identity of 91.38

SEQ ID NO: 4702 - protein, 100 aa, Brassica napus; identical to SEQ ID NO: 4578
  misc_feature (1)..(100): useful for making plants with increased drought tolerance as described in USSN 11/241,685
  misc_feature (1)..(100): Ceres CLONE ID no. 1114752
  misc_feature (1)..(100): Ortholog of  Ceres CDNA ID no. 12393104 with e-value of 4.00E-46 and percent identity of 95.0

SEQ ID NO: 4703 - protein, 131 aa, Arabidopsis thaliana; identical to SEQ ID NO: 1995
  misc_feature (1)..(131): useful for making plants with increased drought tolerance as described in USSN 11/241,685
  misc_feature (1)..(131): Public GI no. 26452787
  misc_feature (1)..(131): Ortholog of  Ceres CDNA ID no. 12393104 with e-value of 1.10E-34 and percent identity of 73.5

SEQ ID NO: 4704 - protein, 127 aa, Glycine max; identical to SEQ ID NO: 4610
  misc_feature (1)..(127): useful for making plants with increased drought tolerance as described in USSN 11/241,685
  misc_feature (1)..(127): Ceres CLONE ID no. 602106
  misc_feature (1)..(127): Ortholog of  Ceres CDNA ID no. 12393104 with e-value of 2.40E-25 and percent identity of 52.1

SEQ ID NO: 4705 - protein, 147 aa, Glycine max; identical to SEQ ID NO: 4612
  misc_feature (1)..(147): useful for making plants with increased drought tolerance as described in USSN 11/241,685
  misc_feature (1)..(147): Ceres CLONE ID no. 613622
  misc_feature (1)..(147): Ortholog of  Ceres CDNA ID no. 12393104 with e-value of 1.19E-23 and percent identity of 47.9
  misc_feature (32)..(32): Xaa is any aa, unknown, or other

SEQ ID NO: 4706 - protein, 124 aa, Glycine max
  misc_feature (1)..(124): useful for making plants with increased drought tolerance as described in USSN 11/241,685
  misc_feature (1)..(124): Ceres CLONE ID no. 667669
  misc_feature (1)..(124): Ortholog of  Ceres CDNA ID no. 12393104 with e-value of 1.39E-20 and percent identity of 56.19
  misc_feature (107)..(107): Xaa is any aa, unknown, or other
  misc_feature (114)..(114): Xaa is any aa, unknown, or other
  misc_feature (124)..(124): Xaa is any aa, unknown, or other
MAKVGKLTKLKSAIKRWPSLTRLSRNSSSVSSNKGVSGKGTSLNSSKEHEHEQEQLRAVYVGKSRRRYLVNSEVIDHPVFQELVDRSCSSNSSSSHHHDDDGVVVVXCEVVLFXHLLWMLESEX

SEQ ID NO: 4707 - protein, 165 aa, Oryza sativa subsp. japonica
  misc_feature (1)..(165): useful for making plants with increased drought tolerance as described in USSN 11/241,685
  misc_feature (1)..(165): Public GI no. 51090654
  misc_feature (1)..(165): Ortholog of  Ceres CDNA ID no. 12393104 with e-value of 2.30E-18 and percent identity of 44.92
MAKGGLSKLKCMIKRWHSSSRISRTPSGCSASAGSTSARSSHGGGRVGGEEWGRSVVASGGGGGGGGGGRGGSVSFHGADGVPPGLHPVYVGKSRRRYLIAADLVGHPMFQNLVDRSGGGGVGGGGGGGTVVGCEVVLFEHLLWMLENADPQPESLDELVEYYAC

SEQ ID NO: 4708 - protein, 41 aa, Brassica napus; identical to SEQ ID NO: 4675
  misc_feature (1)..(41): useful for making plants with increased drought tolerance as described in USSN 11/241,685
  misc_feature (1)..(41): Ceres CLONE ID no. 1082845
  misc_feature (1)..(41): Ortholog of  Ceres CDNA ID no. 12393104 with e-value of 2.10E-15 and percent identity of 95.12

SEQ ID NO: 4709 - protein, 128 aa, Triticum aestivum; identical to SEQ ID NO: 4650
  misc_feature (1)..(128): useful for making plants with increased drought tolerance as described in USSN 11/241,685
  misc_feature (1)..(128): Ceres CLONE ID no. 939408
  misc_feature (1)..(128): Ortholog of  Ceres CDNA ID no. 12393104 with e-value of 3.80E-15 and percent identity of 40.95

SEQ ID NO: 4710 - protein, 118 aa, Triticum aestivum; identical to SEQ ID NO: 4657
  misc_feature (1)..(118): useful for making plants with increased drought tolerance as described in USSN 11/241,685
  misc_feature (1)..(118): Ceres CLONE ID no. 1017750
  misc_feature (1)..(118): Ortholog of  Ceres CDNA ID no. 12393104 with e-value of 3.90E-12 and percent identity of 38.95

SEQ ID NO: 4711 - protein, 599 aa, Artificial Sequence
  misc_feature (1)..(599): useful for making plants with increased drought tolerance as described in USSN 11/241,685
  misc_feature (1)..(599): Consensus Sequence of  Ceres CDNA ID no. 12393104  and orthologs
  misc_feature (1)..(1): Xaa is any aa
  misc_feature (8)..(8): Xaa is Gly  or Gln
  misc_feature (10)..(10): Xaa is any aa or nothing
  misc_feature (12)..(12): Xaa is Ser  or Arg
  misc_feature (13)..(13): Xaa is Ile, Val, Leu, or Met
  misc_feature (14)..(14): Xaa is Cys  or Gly
  misc_feature (15)..(15): Xaa is Ser  or Val
  misc_feature (16)..(16): Xaa is any aa
  misc_feature (17)..(17): Xaa is Ala  or Val
  misc_feature (18)..(18): Xaa is any aa
  misc_feature (19)..(19): Xaa is any aa
  misc_feature (20)..(20): Xaa is any aa
  misc_feature (21)..(21): Xaa is Ile, Val, Leu, or Met
  misc_feature (22)..(22): Xaa is Thr, Gly, or Ser
  misc_feature (23)..(23): Xaa is any aa
  misc_feature (24)..(24): Xaa is Ser  or Ile
  misc_feature (25)..(25): Xaa is any aa
  misc_feature (26)..(26): Xaa is Val  or His
  misc_feature (27)..(27): Xaa is any aa
  misc_feature (29)..(29): Xaa is Arg  or Gly
  misc_feature (30)..(30): Xaa is any aa
  misc_feature (31)..(31): Xaa is Tyr  or Ala
  misc_feature (32)..(32): Xaa is Val  or Ala
  misc_feature (33)..(33): Xaa is Ala  or Val
  misc_feature (34)..(34): Xaa is Thr, Gly, or Ser
  misc_feature (35)..(35): Xaa is any aa
  misc_feature (36)..(36): Xaa is any aa
  misc_feature (37)..(37): Xaa is any aa or nothing
  misc_feature (38)..(38): Xaa is any aa or nothing
  misc_feature (39)..(39): Xaa is any aa or nothing
  misc_feature (40)..(40): Xaa is any aa or nothing
  misc_feature (41)..(41): Xaa is any aa or nothing
  misc_feature (43)..(43): Xaa is any aa
  misc_feature (44)..(44): Xaa is any aa or nothing
  misc_feature (45)..(45): Xaa is any aa or nothing
  misc_feature (46)..(46): Xaa is Thr, Gly, or Ser
  misc_feature (47)..(47): Xaa is any aa
  misc_feature (48)..(48): Xaa is Gly  or Ile
  misc_feature (49)..(49): Xaa is Thr, Gly, or Ser
  misc_feature (50)..(50): Xaa is Ser  or Arg
  misc_feature (51)..(51): Xaa is any aa
  misc_feature (52)..(52): Xaa is any aa
  misc_feature (53)..(53): Xaa is any aa
  misc_feature (54)..(54): Xaa is any aa
  misc_feature (55)..(55): Xaa is Val  or Lys
  misc_feature (57)..(57): Xaa is any aa
  misc_feature (58)..(58): Xaa is any aa
  misc_feature (59)..(59): Xaa is Glu  or Lys
  misc_feature (60)..(60): Xaa is any aa
  misc_feature (61)..(61): Xaa is any aa
  misc_feature (62)..(62): Xaa is any aa
  misc_feature (63)..(63): Xaa is any aa
  misc_feature (64)..(64): Xaa is any aa
  misc_feature (65)..(65): Xaa is any aa
  misc_feature (66)..(66): Xaa is any aa or nothing
  misc_feature (67)..(67): Xaa is Thr, Gly, or Ser
  misc_feature (68)..(68): Xaa is Glu  or Ser
  misc_feature (69)..(69): Xaa is Ser  or Lys
  misc_feature (70)..(70): Xaa is Thr, Gly, or Ser
  misc_feature (71)..(71): Xaa is any aa or nothing
  misc_feature (72)..(72): Xaa is any aa or nothing
  misc_feature (73)..(73): Xaa is any aa or nothing
  misc_feature (74)..(74): Xaa is any aa or nothing
  misc_feature (76)..(76): Xaa is any aa
  misc_feature (83)..(83): Xaa is Tyr  or His
  misc_feature (87)..(87): Xaa is any aa
  misc_feature (89)..(89): Xaa is any aa
  misc_feature (90)..(90): Xaa is Thr, Gly, or Ser
  misc_feature (91)..(91): Xaa is any aa
  misc_feature (92)..(92): Xaa is Glu  or Ala
  misc_feature (93)..(93): Xaa is Ile, Val, Leu, or Met
  misc_feature (96)..(96): Xaa is Ala  or Val
  misc_feature (97)..(97): Xaa is Asp or Glu
  misc_feature (100)..(100): Xaa is any aa
  misc_feature (101)..(101): Xaa is any aa
  misc_feature (104)..(104): Xaa is Lys, Arg, or His
  misc_feature (105)..(105): Xaa is any aa
  misc_feature (107)..(107): Xaa is Ala  or Val
  misc_feature (108)..(108): Xaa is Lys, Arg, or His
  misc_feature (111)..(111): Xaa is any aa
  misc_feature (112)..(112): Xaa is any aa
  misc_feature (113)..(113): Xaa is any aa
  misc_feature (114)..(114): Xaa is any aa
  misc_feature (115)..(115): Xaa is any aa
  misc_feature (116)..(116): Xaa is any aa
  misc_feature (117)..(117): Xaa is any aa
  misc_feature (119)..(119): Xaa is any aa
  misc_feature (120)..(120): Xaa is Ile, Val, Leu, or Met
  misc_feature (122)..(122): Xaa is Ile, Val, Leu, or Met
  misc_feature (125)..(125): Xaa is any aa
  misc_feature (126)..(126): Xaa is Cys  or Gly
  misc_feature (127)..(127): Xaa is any aa
  misc_feature (129)..(129): Xaa is Thr, Gly, or Ser
  misc_feature (131)..(131): Xaa is any aa
  misc_feature (133)..(133): Xaa is any aa
  misc_feature (135)..(135): Xaa is Ile, Val, Leu, or Met
  misc_feature (136)..(136): Xaa is any aa
  misc_feature (137)..(137): Xaa is any aa
  misc_feature (138)..(138): Xaa is any aa
  misc_feature (140)..(140): Xaa is any aa
  misc_feature (141)..(141): Xaa is Thr, Gly, or Ser
  misc_feature (142)..(142): Xaa is any aa
  misc_feature (145)..(145): Xaa is Lys, Arg, or His
  misc_feature (147)..(147): Xaa is any aa
  misc_feature (148)..(148): Xaa is any aa
  misc_feature (149)..(149): Xaa is any aa
  misc_feature (151)..(151): Xaa is Ile, Val, Leu, or Met
  misc_feature (154)..(154): Xaa is Ser  or Cys
  misc_feature (156)..(156): Xaa is any aa
  misc_feature (157)..(157): Xaa is any aa
  misc_feature (158)..(158): Xaa is any aa
  misc_feature (159)..(159): Xaa is any aa or nothing
  misc_feature (160)..(160): Xaa is Lys, Arg, or His
  misc_feature (161)..(161): Xaa is any aa
  misc_feature (162)..(162): Xaa is any aa or nothing
  misc_feature (163)..(163): Xaa is any aa or nothing
  misc_feature (164)..(164): Xaa is Asp or Glu
  misc_feature (165)..(165): Xaa is any aa
  misc_feature (166)..(166): Xaa is any aa
  misc_feature (167)..(167): Xaa is Thr, Gly, or Ser
  misc_feature (168)..(168): Xaa is Cys  or Phe
  misc_feature (169)..(169): Xaa is any aa
  misc_feature (170)..(170): Xaa is any aa
  misc_feature (172)..(172): Xaa is Thr, Gly, or Ser
  misc_feature (173)..(173): Xaa is any aa
  misc_feature (176)..(176): Xaa is any aa
  misc_feature (177)..(177): Xaa is any aa
  misc_feature (178)..(178): Xaa is any aa
  misc_feature (179)..(179): Xaa is Ile, Val, Leu, or Met
  misc_feature (180)..(180): Xaa is any aa
  misc_feature (181)..(181): Xaa is Thr, Gly, or Ser
  misc_feature (182)..(182): Xaa is any aa
  misc_feature (183)..(183): Xaa is Pro  or Ala
  misc_feature (184)..(184): Xaa is any aa
  misc_feature (185)..(185): Xaa is any aa
  misc_feature (186)..(186): Xaa is any aa
  misc_feature (187)..(187): Xaa is any aa or nothing
  misc_feature (188)..(188): Xaa is any aa or nothing
  misc_feature (189)..(189): Xaa is any aa or nothing
  misc_feature (190)..(190): Xaa is any aa or nothing
  misc_feature (191)..(191): Xaa is any aa or nothing
  misc_feature (192)..(192): Xaa is Lys, Arg, or His
  misc_feature (193)..(193): Xaa is any aa
  misc_feature (194)..(194): Xaa is Ile, Val, Leu, or Met
  misc_feature (200)..(200): Xaa is any aa
  misc_feature (203)..(203): Xaa is any aa
  misc_feature (204)..(204): Xaa is Ser  or Asn
  misc_feature (205)..(205): Xaa is Ile, Val, Leu, or Met
  misc_feature (207)..(207): Xaa is Ile, Val, Leu, or Met
  misc_feature (209)..(209): Xaa is any aa
  misc_feature (210)..(210): Xaa is Asp or Glu
  misc_feature (211)..(211): Xaa is any aa
  misc_feature (212)..(212): Xaa is Phe, Tyr, or Trp
  misc_feature (213)..(213): Xaa is Pro  or Ser
  misc_feature (214)..(214): Xaa is any aa
  misc_feature (215)..(215): Xaa is Lys, Arg, or His
  misc_feature (216)..(216): Xaa is Ile, Val, Leu, or Met
  misc_feature (217)..(217): Xaa is Thr, Gly, or Ser
  misc_feature (218)..(218): Xaa is Val  or Ala
  misc_feature (219)..(219): Xaa is Thr, Gly, or Ser
  misc_feature (222)..(222): Xaa is any aa
  misc_feature (223)..(223): Xaa is Thr, Gly, or Ser
  misc_feature (224)..(224): Xaa is Thr, Gly, or Ser
  misc_feature (225)..(225): Xaa is any aa
  misc_feature (226)..(226): Xaa is Ile, Val, Leu, or Met
  misc_feature (228)..(228): Xaa is any aa
  misc_feature (229)..(229): Xaa is any aa
  misc_feature (230)..(230): Xaa is any aa
  misc_feature (231)..(231): Xaa is any aa
  misc_feature (232)..(232): Xaa is any aa
  misc_feature (233)..(233): Xaa is any aa
  misc_feature (234)..(234): Xaa is any aa or nothing
  misc_feature (235)..(235): Xaa is Thr, Gly, or Ser
  misc_feature (236)..(236): Xaa is any aa
  misc_feature (237)..(237): Xaa is Val  or Thr
  misc_feature (238)..(238): Xaa is any aa
  misc_feature (239)..(239): Xaa is Asp or Glu
  misc_feature (240)..(240): Xaa is any aa
  misc_feature (241)..(241): Xaa is any aa
  misc_feature (242)..(242): Xaa is any aa
  misc_feature (243)..(243): Xaa is any aa
  misc_feature (244)..(244): Xaa is any aa
  misc_feature (245)..(245): Xaa is any aa
  misc_feature (246)..(246): Xaa is any aa or nothing
  misc_feature (247)..(247): Xaa is any aa or nothing
  misc_feature (248)..(248): Xaa is any aa or nothing
  misc_feature (249)..(249): Xaa is any aa or nothing
  misc_feature (250)..(250): Xaa is any aa or nothing
  misc_feature (251)..(251): Xaa is any aa or nothing
  misc_feature (252)..(252): Xaa is any aa or nothing
  misc_feature (253)..(253): Xaa is any aa or nothing
  misc_feature (254)..(254): Xaa is any aa or nothing
  misc_feature (255)..(255): Xaa is any aa or nothing
  misc_feature (256)..(256): Xaa is any aa or nothing
  misc_feature (257)..(257): Xaa is Ile, Val, Leu, or Met
  misc_feature (258)..(258): Xaa is Gly  or Asp
  misc_feature (259)..(259): Xaa is any aa
  misc_feature (260)..(260): Xaa is any aa
  misc_feature (261)..(261): Xaa is any aa
  misc_feature (262)..(262): Xaa is any aa
  misc_feature (263)..(263): Xaa is any aa
  misc_feature (264)..(264): Xaa is any aa
  misc_feature (265)..(265): Xaa is any aa
  misc_feature (266)..(266): Xaa is any aa
  misc_feature (267)..(267): Xaa is any aa
  misc_feature (268)..(268): Xaa is any aa
  misc_feature (269)..(269): Xaa is any aa
  misc_feature (270)..(270): Xaa is any aa
  misc_feature (271)..(271): Xaa is any aa
  misc_feature (272)..(272): Xaa is any aa
  misc_feature (273)..(273): Xaa is any aa
  misc_feature (274)..(274): Xaa is any aa
  misc_feature (275)..(275): Xaa is any aa or nothing
  misc_feature (276)..(276): Xaa is any aa or nothing
  misc_feature (277)..(277): Xaa is any aa or nothing
  misc_feature (278)..(278): Xaa is any aa or nothing
  misc_feature (279)..(279): Xaa is any aa or nothing
  misc_feature (280)..(280): Xaa is any aa or nothing
  misc_feature (281)..(281): Xaa is any aa or nothing
  misc_feature (282)..(282): Xaa is Phe  or Met
  misc_feature (283)..(283): Xaa is Thr, Gly, or Ser
  misc_feature (284)..(284): Xaa is Thr  or Pro
  misc_feature (285)..(285): Xaa is any aa
  misc_feature (286)..(286): Xaa is any aa
  misc_feature (287)..(287): Xaa is any aa
  misc_feature (288)..(288): Xaa is any aa
  misc_feature (289)..(289): Xaa is any aa
  misc_feature (290)..(290): Xaa is any aa
  misc_feature (291)..(291): Xaa is any aa
  misc_feature (292)..(292): Xaa is Phe, Tyr, or Trp
  misc_feature (293)..(293): Xaa is Gln  or Asp
  misc_feature (294)..(294): Xaa is any aa
  misc_feature (295)..(295): Xaa is Ser  or Cys
  misc_feature (296)..(296): Xaa is Pro  or Ser
  misc_feature (297)..(297): Xaa is any aa
  misc_feature (300)..(300): Xaa is any aa
  misc_feature (301)..(301): Xaa is any aa
  misc_feature (303)..(303): Xaa is Thr, Gly, or Ser
  misc_feature (304)..(304): Xaa is any aa
  misc_feature (305)..(305): Xaa is any aa
  misc_feature (306)..(306): Xaa is Ile, Val, Leu, or Met
  misc_feature (307)..(307): Xaa is any aa
  misc_feature (309)..(309): Xaa is Pro  or Val
  misc_feature (310)..(310): Xaa is any aa
  misc_feature (311)..(311): Xaa is any aa
  misc_feature (312)..(312): Xaa is any aa
  misc_feature (314)..(314): Xaa is any aa
  misc_feature (315)..(315): Xaa is any aa
  misc_feature (316)..(316): Xaa is Asp or Glu
  misc_feature (317)..(317): Xaa is any aa
  misc_feature (318)..(318): Xaa is any aa
  misc_feature (319)..(319): Xaa is any aa
  misc_feature (320)..(320): Xaa is any aa
  misc_feature (321)..(321): Xaa is any aa
  misc_feature (322)..(322): Xaa is any aa
  misc_feature (323)..(323): Xaa is any aa
  misc_feature (324)..(324): Xaa is any aa or nothing
  misc_feature (325)..(325): Xaa is any aa or nothing
  misc_feature (326)..(326): Xaa is any aa or nothing
  misc_feature (327)..(327): Xaa is any aa or nothing
  misc_feature (328)..(328): Xaa is Thr, Gly, or Ser
  misc_feature (329)..(329): Xaa is any aa
  misc_feature (330)..(330): Xaa is any aa
  misc_feature (331)..(331): Xaa is any aa
  misc_feature (332)..(332): Xaa is any aa or nothing
  misc_feature (335)..(335): Xaa is Thr, Gly, or Ser
  misc_feature (337)..(337): Xaa is any aa
  misc_feature (338)..(338): Xaa is Lys, Arg, or His
  misc_feature (339)..(339): Xaa is Ala  or Val
  misc_feature (340)..(340): Xaa is any aa
  misc_feature (341)..(341): Xaa is Ile, Val, Leu, or Met
  misc_feature (343)..(343): Xaa is any aa
  misc_feature (344)..(344): Xaa is any aa
  misc_feature (345)..(345): Xaa is any aa
  misc_feature (347)..(347): Xaa is any aa
  misc_feature (348)..(348): Xaa is any aa
  misc_feature (349)..(349): Xaa is any aa
  misc_feature (350)..(350): Xaa is any aa
  misc_feature (351)..(351): Xaa is any aa
  misc_feature (352)..(352): Xaa is any aa
  misc_feature (353)..(353): Xaa is any aa
  misc_feature (354)..(354): Xaa is Gln  or Leu
  misc_feature (355)..(355): Xaa is Arg  or Trp
  misc_feature (356)..(356): Xaa is Trp  or Arg
  misc_feature (358)..(358): Xaa is any aa
  misc_feature (359)..(359): Xaa is any aa
  misc_feature (360)..(360): Xaa is any aa
  misc_feature (361)..(361): Xaa is any aa
  misc_feature (363)..(363): Xaa is any aa
  misc_feature (364)..(364): Xaa is any aa
  misc_feature (365)..(365): Xaa is any aa
  misc_feature (366)..(366): Xaa is Val  or Ala
  misc_feature (367)..(367): Xaa is any aa
  misc_feature (368)..(368): Xaa is Glu  or Gly
  misc_feature (369)..(369): Xaa is Ile, Val, Leu, or Met
  misc_feature (370)..(370): Xaa is any aa
  misc_feature (371)..(371): Xaa is any aa
  misc_feature (372)..(372): Xaa is Thr, Gly, or Ser
  misc_feature (375)..(375): Xaa is Met  or Ala
  misc_feature (376)..(376): Xaa is any aa
  misc_feature (377)..(377): Xaa is Ile, Val, Leu, or Met
  misc_feature (378)..(378): Xaa is any aa
  misc_feature (379)..(379): Xaa is Cys  or Ser
  misc_feature (380)..(380): Xaa is any aa
  misc_feature (382)..(382): Xaa is any aa
  misc_feature (383)..(383): Xaa is any aa
  misc_feature (385)..(385): Xaa is any aa
  misc_feature (386)..(386): Xaa is any aa
  misc_feature (387)..(387): Xaa is any aa
  misc_feature (388)..(388): Xaa is Leu  or Phe
  misc_feature (389)..(389): Xaa is any aa
  misc_feature (390)..(390): Xaa is any aa
  misc_feature (391)..(391): Xaa is Ile, Val, Leu, or Met
  misc_feature (395)..(395): Xaa is Lys, Arg, or His
  misc_feature (396)..(396): Xaa is Val  or Gly
  misc_feature (398)..(398): Xaa is Lys  or Leu
  misc_feature (399)..(399): Xaa is Leu  or Ser
  misc_feature (400)..(400): Xaa is any aa
  misc_feature (404)..(404): Xaa is Ser  or Cys
  misc_feature (405)..(405): Xaa is any aa
  misc_feature (406)..(406): Xaa is Ile, Val, Leu, or Met
  misc_feature (407)..(407): Xaa is Lys, Arg, or His
  misc_feature (408)..(408): Xaa is Lys, Arg, or His
  misc_feature (410)..(410): Xaa is any aa
  misc_feature (411)..(411): Xaa is any aa or nothing
  misc_feature (412)..(412): Xaa is any aa or nothing
  misc_feature (413)..(413): Xaa is any aa or nothing
  misc_feature (414)..(414): Xaa is any aa or nothing
  misc_feature (415)..(415): Xaa is any aa or nothing
  misc_feature (416)..(416): Xaa is any aa or nothing
  misc_feature (417)..(417): Xaa is any aa or nothing
  misc_feature (418)..(418): Xaa is any aa or nothing
  misc_feature (419)..(419): Xaa is any aa or nothing
  misc_feature (421)..(421): Xaa is any aa
  misc_feature (422)..(422): Xaa is Thr, Gly, or Ser
  misc_feature (423)..(423): Xaa is any aa
  misc_feature (424)..(424): Xaa is any aa
  misc_feature (425)..(425): Xaa is any aa
  misc_feature (426)..(426): Xaa is any aa
  misc_feature (427)..(427): Xaa is any aa
  misc_feature (428)..(428): Xaa is any aa
  misc_feature (429)..(429): Xaa is any aa
  misc_feature (430)..(430): Xaa is any aa
  misc_feature (431)..(431): Xaa is any aa
  misc_feature (432)..(432): Xaa is any aa
  misc_feature (433)..(433): Xaa is any aa
  misc_feature (434)..(434): Xaa is any aa
  misc_feature (435)..(435): Xaa is any aa
  misc_feature (436)..(436): Xaa is any aa
  misc_feature (437)..(437): Xaa is any aa
  misc_feature (438)..(438): Xaa is any aa
  misc_feature (439)..(439): Xaa is any aa
  misc_feature (440)..(440): Xaa is any aa
  misc_feature (441)..(441): Xaa is any aa or nothing
  misc_feature (442)..(442): Xaa is any aa or nothing
  misc_feature (443)..(443): Xaa is any aa or nothing
  misc_feature (444)..(444): Xaa is any aa or nothing
  misc_feature (445)..(445): Xaa is any aa or nothing
  misc_feature (446)..(446): Xaa is any aa or nothing
  misc_feature (447)..(447): Xaa is any aa or nothing
  misc_feature (448)..(448): Xaa is any aa or nothing
  misc_feature (449)..(449): Xaa is any aa or nothing
  misc_feature (450)..(450): Xaa is any aa or nothing
  misc_feature (451)..(451): Xaa is any aa or nothing
  misc_feature (452)..(452): Xaa is any aa or nothing
  misc_feature (453)..(453): Xaa is any aa or nothing
  misc_feature (454)..(454): Xaa is any aa or nothing
  misc_feature (455)..(455): Xaa is any aa or nothing
  misc_feature (456)..(456): Xaa is any aa or nothing
  misc_feature (457)..(457): Xaa is any aa or nothing
  misc_feature (458)..(458): Xaa is any aa or nothing
  misc_feature (459)..(459): Xaa is any aa or nothing
  misc_feature (460)..(460): Xaa is any aa or nothing
  misc_feature (461)..(461): Xaa is any aa or nothing
  misc_feature (462)..(462): Xaa is any aa or nothing
  misc_feature (463)..(463): Xaa is any aa or nothing
  misc_feature (464)..(464): Xaa is any aa or nothing
  misc_feature (465)..(465): Xaa is any aa or nothing
  misc_feature (466)..(466): Xaa is any aa or nothing
  misc_feature (467)..(467): Xaa is any aa or nothing
  misc_feature (468)..(468): Xaa is any aa or nothing
  misc_feature (469)..(469): Xaa is any aa or nothing
  misc_feature (470)..(470): Xaa is any aa or nothing
  misc_feature (471)..(471): Xaa is any aa or nothing
  misc_feature (472)..(472): Xaa is any aa or nothing
  misc_feature (473)..(473): Xaa is any aa or nothing
  misc_feature (474)..(474): Xaa is any aa or nothing
  misc_feature (475)..(475): Xaa is any aa or nothing
  misc_feature (476)..(476): Xaa is any aa or nothing
  misc_feature (477)..(477): Xaa is any aa or nothing
  misc_feature (478)..(478): Xaa is any aa or nothing
  misc_feature (479)..(479): Xaa is any aa or nothing
  misc_feature (480)..(480): Xaa is any aa or nothing
  misc_feature (481)..(481): Xaa is any aa or nothing
  misc_feature (482)..(482): Xaa is any aa or nothing
  misc_feature (483)..(483): Xaa is any aa or nothing
  misc_feature (484)..(484): Xaa is any aa or nothing
  misc_feature (485)..(485): Xaa is any aa or nothing
  misc_feature (486)..(486): Xaa is any aa or nothing
  misc_feature (487)..(487): Xaa is any aa or nothing
  misc_feature (488)..(488): Xaa is any aa or nothing
  misc_feature (489)..(489): Xaa is any aa or nothing
  misc_feature (490)..(490): Xaa is any aa or nothing
  misc_feature (491)..(491): Xaa is any aa or nothing
  misc_feature (492)..(492): Xaa is any aa or nothing
  misc_feature (493)..(493): Xaa is any aa or nothing
  misc_feature (494)..(494): Xaa is any aa or nothing
  misc_feature (495)..(495): Xaa is any aa or nothing
  misc_feature (496)..(496): Xaa is any aa or nothing
  misc_feature (497)..(497): Xaa is any aa or nothing
  misc_feature (498)..(498): Xaa is any aa or nothing
  misc_feature (500)..(500): Xaa is any aa
  misc_feature (501)..(501): Xaa is any aa
  misc_feature (506)..(506): Xaa is any aa
  misc_feature (507)..(507): Xaa is Thr, Gly, or Ser
  misc_feature (510)..(510): Xaa is any aa
  misc_feature (512)..(512): Xaa is any aa
  misc_feature (513)..(513): Xaa is Ile, Val, Leu, or Met
  misc_feature (514)..(514): Xaa is any aa
  misc_feature (515)..(515): Xaa is any aa
  misc_feature (516)..(516): Xaa is Asp or Glu
  misc_feature (517)..(517): Xaa is Ile, Val, Leu, or Met
  misc_feature (518)..(518): Xaa is Ile, Val, Leu, or Met
  misc_feature (519)..(519): Xaa is any aa
  misc_feature (522)..(522): Xaa is Ile, Val, Leu, or Met
  misc_feature (524)..(524): Xaa is Gln  or Arg
  misc_feature (525)..(525): Xaa is Glu  or Asn
  misc_feature (528)..(528): Xaa is any aa
  misc_feature (529)..(529): Xaa is Lys, Arg, or His
  misc_feature (530)..(530): Xaa is any aa
  misc_feature (531)..(531): Xaa is any aa
  misc_feature (532)..(532): Xaa is any aa
  misc_feature (533)..(533): Xaa is any aa
  misc_feature (534)..(534): Xaa is any aa
  misc_feature (535)..(535): Xaa is any aa
  misc_feature (536)..(536): Xaa is any aa
  misc_feature (537)..(537): Xaa is any aa
  misc_feature (538)..(538): Xaa is any aa
  misc_feature (539)..(539): Xaa is any aa or nothing
  misc_feature (540)..(540): Xaa is any aa or nothing
  misc_feature (541)..(541): Xaa is any aa or nothing
  misc_feature (542)..(542): Xaa is any aa or nothing
  misc_feature (543)..(543): Xaa is any aa or nothing
  misc_feature (544)..(544): Xaa is any aa or nothing
  misc_feature (545)..(545): Xaa is any aa or nothing
  misc_feature (546)..(546): Xaa is any aa or nothing
  misc_feature (547)..(547): Xaa is any aa or nothing
  misc_feature (548)..(548): Xaa is any aa or nothing
  misc_feature (549)..(549): Xaa is any aa or nothing
  misc_feature (550)..(550): Xaa is any aa or nothing
  misc_feature (551)..(551): Xaa is any aa or nothing
  misc_feature (552)..(552): Xaa is any aa or nothing
  misc_feature (553)..(553): Xaa is any aa or nothing
  misc_feature (554)..(554): Xaa is any aa or nothing
  misc_feature (555)..(555): Xaa is any aa or nothing
  misc_feature (556)..(556): Xaa is Ile, Val, Leu, or Met
  misc_feature (557)..(557): Xaa is any aa or nothing
  misc_feature (558)..(558): Xaa is Ile, Val, Leu, or Met
  misc_feature (559)..(559): Xaa is Thr, Gly, or Ser
  misc_feature (573)..(573): Xaa is any aa
  misc_feature (574)..(574): Xaa is any aa
  misc_feature (575)..(575): Xaa is Thr, Gly, or Ser
  misc_feature (576)..(576): Xaa is any aa or nothing
  misc_feature (577)..(577): Xaa is any aa or nothing
  misc_feature (578)..(578): Xaa is any aa or nothing
  misc_feature (579)..(579): Xaa is any aa or nothing
  misc_feature (580)..(580): Xaa is any aa or nothing
  misc_feature (581)..(581): Xaa is any aa or nothing
  misc_feature (582)..(582): Xaa is any aa or nothing
  misc_feature (583)..(583): Xaa is any aa or nothing
  misc_feature (584)..(584): Xaa is any aa or nothing
  misc_feature (585)..(585): Xaa is Gln  or Asp
  misc_feature (586)..(586): Xaa is any aa or nothing
  misc_feature (587)..(587): Xaa is Glu  or Gln
  misc_feature (588)..(588): Xaa is Gly  or Pro
  misc_feature (589)..(589): Xaa is Gly  or Glu
  misc_feature (591)..(591): Xaa is Ile, Val, Leu, or Met
  misc_feature (592)..(592): Xaa is any aa
  misc_feature (595)..(595): Xaa is Ala  or Val
  misc_feature (596)..(596): Xaa is Asp or Glu
XAARSLSXAXKXXXXXXXXXXXXXXXXRXXXXXXXXXXXXXGXXXXXXXXXXXXXGXXXXXXXXXXXXXXXXXXWXPDPVTGXYRPXNXXXXXDPXXLRXXLLXXKXXSMXXXXXXXHXXLXHGXXXGXWXWXKXXXXLXXXGHXVXXXDXAAXGXXXXXXXXXXXXXXXYXXPLXXXXXXXXXXXXXXXXXXXLVGHSXGGXXXAXAXXXXXXXXXXXVFXXXXXPXXXXXXXXXXXXXXXXXXXXXXXXXXXXXXXXXXXXXXXXXXXXXXXXXXXXXXXXXXXXXXXXXXXXXXEDXXLXXXXXRXXXXFXXXXXXXXXXXXXXXXXXXYGXVXXXXXVXXXDXXXXXXXXXXMXXXXPXXXXXXXXXXDHXXXXXXPXXLXXXXXXXAMAXXGXXXKLKXXXXXWXXXXXXXXXXSXXXXXXXXXXXXXXXXXXXXXXXXXXXXXXXXXXXXXXXXXXXXXXXXXXXXXXXXXXXXXXXXXXXXXXXXXXXXXXLXXVYVGXXRRXYXXXXXXXXHPXFXXLVXXXXXXXXXXXXXXXXXXXXXXXXXXXXXXXXCEVVLFEHLLWMLXXXXXXXXXXXXXXXXXSXXELXXFYT

SEQ ID NO: 4712 - protein, 99 aa, Brassica napus; identical to SEQ ID NO: 4574
  misc_feature (1)..(99): useful for making plants with increased drought tolerance as described in USSN 11/241,685
  misc_feature (1)..(99): Ceres CLONE ID no. 976586
  misc_feature (1)..(99): Ortholog of  Ceres CDNA ID no. 12420738 with e-value of 1.19E-33 and percent identity of 82.65
  misc_feature (99)..(99): Xaa is any aa, unknown, or other

SEQ ID NO: 4713 - protein, 87 aa, Arabidopsis thaliana
  misc_feature (1)..(87): useful for making plants with increased drought tolerance as described in USSN 11/241,685
  misc_feature (1)..(87): Public GI no. 7268339
  misc_feature (1)..(87): Ortholog of  Ceres CDNA ID no. 12420738 with e-value of 3.10E-33 and percent identity of 94.25
MAARSLSGAVKSLCPPHPENVTAAGLSKGGSTRVMVGKMEQRGLDQEAESAWGPDPVTGYYRPSNRAAEIDPAELRELLLKNKAKSF

SEQ ID NO: 4714 - protein, 113 aa, Glycine max; identical to SEQ ID NO: 4624
  misc_feature (1)..(113): useful for making plants with increased drought tolerance as described in USSN 11/241,685
  misc_feature (1)..(113): Public GI no. 75098170
  misc_feature (1)..(113): Ortholog of  Ceres CDNA ID no. 12420738 with e-value of 2.10E-11 and percent identity of 40.2

SEQ ID NO: 4715 - protein, 113 aa, Glycine max; identical to SEQ ID NO: 4624
  misc_feature (1)..(113): useful for making plants with increased drought tolerance as described in USSN 11/241,685
  misc_feature (1)..(113): Ceres CLONE ID no. 1042120
  misc_feature (1)..(113): Ortholog of  Ceres CDNA ID no. 12420738 with e-value of 2.10E-11 and percent identity of 40.2

SEQ ID NO: 4716 - protein, 100 aa, Glycine max; identical to SEQ ID NO: 4605
  misc_feature (1)..(100): useful for making plants with increased drought tolerance as described in USSN 11/241,685
  misc_feature (1)..(100): Ceres CLONE ID no. 561776
  misc_feature (1)..(100): Ortholog of  Ceres CDNA ID no. 12420738 with e-value of 3.39E-11 and percent identity of 42.11

SEQ ID NO: 4717 - protein, 95 aa, Zea mays; identical to SEQ ID NO: 4664
  misc_feature (1)..(95): useful for making plants with increased drought tolerance as described in USSN 11/241,685
  misc_feature (1)..(95): Ceres CLONE ID no. 296494
  misc_feature (1)..(95): Ortholog of  Ceres CDNA ID no. 12420738 with e-value of 1.09E-7 and percent identity of 37.63

SEQ ID NO: 4718 - DNA, 621 bp, Arabidopsis thaliana
  misc_feature (1)..(621): useful for making plants with increased cold tolerance as described in USSN 12/863,773
  misc_feature (1)..(621): Ceres SEEDLINE ID no.ME00327
  misc_feature (1)..(621): Inplanta Sequence
actagttagttgaaatggaggctttcaagcttcggatccaacgcacgtaatctctctctctctctctcttctctcttttttctttctctcttctttctctctgtaaaacttgtctaatggcagagatctgctgcgtcaaagagatccaagaagaagacgtggagaagatccgattaccgacccgacccgaattagacattcctgtctctgatcacgaagatccaacggtcaacgaagaagaagggtgcaagactccaacatcgtccgatcacaagattccggaggtgaagtatacgttatgtccaccggctccgagaaaaccaaaaccgaatcgatcttccggtacgaaacggaaattaacgccggttaatgttcttaaccgcataccgattgatctgagccgtgagatcgagatgttcttcgaggatttggaccgtaggatcaagaagtcacggaaacaataagaagattattgccttaattggtaatgatcgttcatttctaattcatgactgtgtggtggtaatttgatcctttgaatttttcttcattttttttttcttttttttttcgttttctgtataattaattagctaataacaataagaaaatttatgtacc

SEQ ID NO: 4719 - protein, 115 aa, Arabidopsis thaliana
  misc_feature (1)..(115): useful for making plants with increased cold tolerance as described in USSN 12/863,773
  misc_feature (1)..(115): Ceres SEEDLINE ID no.ME00327
  misc_feature (1)..(115): Bit score of 224.6 for HMM based on sequences of FIGURE 1 of USSN 12/863,773.
MAEICCVKEIQEEDVEKIRLPTRPELDIPVSDHEDPTVNEEEGCKTPTSSDHKIPEVKYTLCPPAPRKPKPNRSSGTKRKLTPVNVLNRIPIDLSREIEMFFEDLDRRIKKSRKQ

SEQ ID NO: 4720 - DNA, 992 bp, Gossypium hirsutum
  misc_feature (1)..(992): useful for making plants with increased cold tolerance as described in USSN 12/863,773
  misc_feature (1)..(992): Ceres CLONE ID no.1897908
gggttgtcaaagccttttctctgtctctcatctttgccttctctttctcatttcgcagctaaattccaaactaaaatccaagatagaaaaagaaattcagagaacaatcaaggaagatggtgatgtgatgaattaaaaaaaagaaaaaccctctggcattttcgtttcctatatatcaaataccaagcttcttctctttgtttttctaggcttttttttcctgctggtacttgtactgtcttttccttcatttgcttgcaattttcataatttgatccctctctctaatctttaaattctttgtcttcatcatttcttcatatcctaggttgattttggacttccatgtactcaaaattaaaaccagttccattcatgggtgtctcaactaccatggaactcagtttcttggttaggcctcctctagaattcaatgaagattgtggaactgcaactaatgttaaacaagaagaagaagaagagaagagcaagttggtgatgatgggtacatctgaatctgaggtggttgctgctgctaatgatgatcaagatgaaaacgacaacgatgggttcaagactcctacttcgttcgaccataaaatcccagccgccaccatcctcaagtgcccacctgcaccaaggaaaccaaaatccctccccattatatcgtcaccagcaaaacgaaaatcgcttcgcaggagaatcctacttgatttgacgaaagagatcgagtctttgttccctccagctcttattgcagatctagggaacaagattaagaaagtcagacaaggaagtgacttcaaatgatatgatatatatatacatatatacatacaaatataactatatatgtatcatgtatttatttgaagaattttaattatgttatttgttttcatcatccaagaccatcacatctatgttcagtttcattgatgtgttttttatttggtgtttctatcagatctaaaaccatataaagactttgc

SEQ ID NO: 4721 - protein, 154 aa, Gossypium hirsutum
  misc_feature (1)..(154): useful for making plants with increased cold tolerance as described in USSN 12/863,773
  misc_feature (1)..(154): Ceres CLONE ID no.1897908
  misc_feature (1)..(154): Bit score of 132.4 for HMM based on sequences of FIGURE 1 of USSN 12/863,773.
  misc_feature (1)..(154): Functional Homolog Of Ceres SEEDLINE ID no. ME00327
MYSKLKPVPFMGVSTTMELSFLVRPPLEFNEDCGTATNVKQEEEEEKSKLVMMGTSESEVVAAANDDQDENDNDGFKTPTSFDHKIPAATILKCPPAPRKPKSLPIISSPAKRKSLRRRILLDLTKEIESLFPPALIADLGNKIKKVRQGSDFK

SEQ ID NO: 4722 - DNA, 1175 bp, Gossypium hirsutum
  misc_feature (1)..(1175): useful for making plants with increased cold tolerance as described in USSN 12/863,773
  misc_feature (1)..(1175): Ceres CLONE ID no.1938030
aaaagtgggttgtcaaagccttttctctgtctctcatctttgctttctctttctcatttcgcagctaaattccaaactaaaatccaagatagaaaaagaaattcagagagcaatcaaggaagatggtgatgtgatgaattaaaaaaaaaaactttggcattttcgtttactatatatcaaataacaagcttcttctctttgtttttctaggctttttttttcctgctggtacttgaactgtcttttccttcatttgcttgcaattttcataagttgatccctctctctcatctttaaattctttgtccttcaccatttcttcatatcctaggttgattttggacttccatgtactcaaaattaaaaccagttccattcatgggtgtctcaagtaccatggaactcagtttcttggttaggcctcctctagaattcaatgaagattgtggaactgcaactaatgttaaacaggaagaagaagaagagaagagcaagttggtgacgatgggtacatctgaatctgaggtggttgctgctgctaatgattatcaagatgaaaacgacaacgatgggttcaagaccaacgatgggttcaagactcctacttcattggaccataaaatcccagccgccgccatcctcaagtgcccacctgcaccaaggaaaccaaaatccctccccattatatcgtcaccagcaaaacgaaaatctcttcgcaggagaatcctgcttgatttgacgaaagagatcgagtctttgttccctccagctcttattgcagatctagggaacaagattaagaaagtcagacaaggaagtgacttcaaatgacatgatacatatacatatatacatacatacaaatataactatatatgtgtcatgtatttatttgaagaattttaattatgttatttgttttcatcatcctagaccatcacttctatgttcagtttcattggtgtgttttttatttggtgtttctatcagatctaaaaccatacaaagactttgcaaaatggatcaaagcaagtacaaagtgagtgatgtgattcatggattttagcattgggttctttactttctttttcttttggctgcactcttaacctagctaaaagatgaacttttgaggtttgattttaaatttaattagagctacatataattatacg

SEQ ID NO: 4723 - protein, 160 aa, Gossypium hirsutum
  misc_feature (1)..(160): useful for making plants with increased cold tolerance as described in USSN 12/863,773
  misc_feature (1)..(160): Ceres CLONE ID no.1938030
  misc_feature (1)..(160): Bit score of 131.1 for HMM based on sequences of FIGURE 1 of USSN 12/863,773.
  misc_feature (1)..(160): Functional Homolog Of Ceres SEEDLINE ID no. ME00327
MYSKLKPVPFMGVSSTMELSFLVRPPLEFNEDCGTATNVKQEEEEEKSKLVTMGTSESEVVAAANDYQDENDNDGFKTNDGFKTPTSLDHKIPAAAILKCPPAPRKPKSLPIISSPAKRKSLRRRILLDLTKEIESLFPPALIADLGNKIKKVRQGSDFK

SEQ ID NO: 4724 - DNA, 781 bp, Gossypium hirsutum
  misc_feature (1)..(781): useful for making plants with increased cold tolerance as described in USSN 12/863,773
  misc_feature (1)..(781): Ceres CLONE ID no.1915941
tcgctcgctcgctgggttaaaactgtttcgtcctattttctctcttaactgtagaaacaaagtctggaattgtacaactccaccagggggaaggatggtgatttgatgatttaccatattgctttatgttatacattctcatcgctttttatctgtttgcactaatgtatgtagaattgcggctgcctgcaggtttcccttgtcggtatctcgagttcagagacggccgtagtcaaaggtggtgaagaaggaatggaattcgacattctgaaacgacccctaccggtgaagtgccaaactacaacctcttcttctttttcacccggtaaacaacaaaaagaagaaggagaaatcaacgttaaagcagctggtgaggggaaggaagagaagaaagaaaagaattccaaggaaatagatgatgatgatgatgatgggtttaaaactccaacatctacggattccaaaatcccagctgagccgaaacaatgcccgcctgcacctagaaaacccaagccaaataaaagaaaagcatcatcgcctaccaatggttcaaccgcagtcaggaatccgctactgctggatctttcggaagagctcgagtccttgagtcacaaggtcaagaaaaaaactcgaacacaagagcagcaataatttttattcattgttagcggtattaagtacacacccatcaaacattaataacttaattctttatttgtatttatgggagttcattgtttttgctgacggtgaagatcatgatgatattgaagcttatgac

SEQ ID NO: 4725 - protein, 132 aa, Gossypium hirsutum
  misc_feature (1)..(132): useful for making plants with increased cold tolerance as described in USSN 12/863,773
  misc_feature (1)..(132): Ceres CLONE ID no.1915941
  misc_feature (1)..(132): Bit score of 254.1 for HMM based on sequences of FIGURE 1 of USSN 12/863,773.
  misc_feature (1)..(132): Functional Homolog Of Ceres SEEDLINE ID no. ME00327
MEFDILKRPLPVKCQTTTSSSFSPGKQQKEEGEINVKAAGEGKEEKKEKNSKEIDDDDDDGFKTPTSTDSKIPAEPKQCPPAPRKPKPNKRKASSPTNGSTAVRNPLLLDLSEELESLSHKVKKKTRTQEQQ

SEQ ID NO: 4726 - DNA, 483 bp, Populus balsamifera subsp. trichocarpa
  misc_feature (1)..(483): useful for making plants with increased cold tolerance as described in USSN 12/863,773
  misc_feature (1)..(483): Ceres ANNOT ID no.1461830
atggggttttccaactctgagatgtttttctctgagaaagatctgaatcccatggaattcaatttccttgtgagatctgcattagaacttggagatgactgtgaaattgtaccccaagatcttcatcaggaaaaagaagtacttgaaaaagaagaaaagcaagaagacgaatgcgagatatcggtgcctactttgaagataaaactgccgtctgtagaagcattccaaattgaagatgataaagatgacgatgatgatgggttcaagactccaacttctttggatcgcaaaattcctgtcatttttcaatgtccgcccgcacccagaaaacctaaatcactcccatcagccaaacgaaaatcgcctcaacggagagtcttacttgatctgtccaatgagatcgaatccttgtttcctccagctcttgctggggatcttggtggcaagattaagaaagttagacaaggcaatgacaccaagtaa

SEQ ID NO: 4727 - protein, 143 aa, Populus balsamifera subsp. trichocarpa
  misc_feature (1)..(143): useful for making plants with increased cold tolerance as described in USSN 12/863,773
  misc_feature (1)..(143): Ceres ANNOT ID no.1461830
  misc_feature (1)..(143): Bit score of 305.4 for HMM based on sequences of FIGURE 1 of USSN 12/863,773.
  misc_feature (1)..(143): Functional Homolog Of Ceres SEEDLINE ID no. ME00327
MEFNFLVRSALELGDDCEIVPQDLHQEKEVLEKEEKQEDECEISVPTLKIKLPSVEAFQIEDDKDDDDDGFKTPTSLDRKIPVIFQCPPAPRKPKSLPSAKRKSPQRRVLLDLSNEIESLFPPALAGDLGGKIKKVRQGNDTK

SEQ ID NO: 4728 - DNA, 561 bp, Populus balsamifera subsp. trichocarpa
  misc_feature (1)..(561): useful for making plants with increased cold tolerance as described in USSN 12/863,773
  misc_feature (1)..(561): Ceres ANNOT ID no.1439985
atggctgacccgataaagagtgaacctcattctcaaagcgaaggtttttctgccatgttctcggaatcgaaaccattttcgttaacggggttgcctaactctcagatttttttctctgagaaagatccgaatcctaaggaattcaatttccttgtgagacccacgttagaacttggagatgacggtgaaactgtacctcaagagcttcatcaggaaaaagaagttgaagaagaaggaaagcaagaagataaatgcgagatctcggtacctactttgaagataaaattcccatctttaggagctttccaaattgaagatagtgatcatggtgatggttcgaagactccaacttcttcggattgcaaaatccctgtcatttttcaatgtccgcctgcacctataaaacctaaatcacttccatcaaccaaacgaaaatcgcctcgacggagagtcttacttgatctgtccaacgaggttgaaactttgtttcccccagctcttgctgcaaatcttggtggcaagattaagaaagttagacaaggcaacgacagtaccaaataa

SEQ ID NO: 4729 - protein, 168 aa, Populus balsamifera subsp. trichocarpa
  misc_feature (1)..(168): useful for making plants with increased cold tolerance as described in USSN 12/863,773
  misc_feature (1)..(168): Ceres ANNOT ID no.1439985
  misc_feature (1)..(168): Bit score of 220.9 for HMM based on sequences of FIGURE 1 of USSN 12/863,773.
  misc_feature (1)..(168): Functional Homolog Of Ceres SEEDLINE ID no. ME00327
MFSESKPFSLTGLPNSQIFFSEKDPNPKEFNFLVRPTLELGDDGETVPQELHQEKEVEEEGKQEDKCEISVPTLKIKFPSLGAFQIEDSDHGDGSKTPTSSDCKIPVIFQCPPAPIKPKSLPSTKRKSPRRRVLLDLSNEVETLFPPALAANLGGKIKKVRQGNDSTK

SEQ ID NO: 4730 - protein, 115 aa, Arabidopsis thaliana
  misc_feature (1)..(115): useful for making plants with increased cold tolerance as described in USSN 12/863,773
  misc_feature (1)..(115): Public GI ID no.15241794
  misc_feature (1)..(115): Bit score of 218.0 for HMM based on sequences of FIGURE 1 of USSN 12/863,773.
  misc_feature (1)..(115): Functional Homolog Of Ceres SEEDLINE ID no. ME00327
MAEICCVKEIQEEDVEKIRLPTRPELDIPDSDHEDPTVNEEEGCKTPTSSDHKIPEVKYTLCPPAPRKPKPNRSSGTKRKLTPVNVVNRIPIDLSREIEMFFEDLDRRIKKSRKQ

SEQ ID NO: 4731 - DNA, 678 bp, Brassica napus
  misc_feature (1)..(678): useful for making plants with increased cold tolerance as described in USSN 12/863,773
  misc_feature (1)..(678): Ceres CLONE ID no.1080942
ctaagaagatttgttcagtgcacacgacaaaacacaaaaacaaaaccttcaagaacaactccatttaaatatctataaagaaatgaatcttgatttaatacaagatctgcccatgctgaagttcccatcacccatcaagatcccatccaacaacaccaacagagatgatgacggcagcagcggcggctgcaccactcccacttcctccgaccacaagattcctccctccaccgccactactcctcctcctccgcctcagaaacgccgcccacctccgtcgccatcatgtttcatcagatcttgcaagaggaagcttttgacgccatcaaaggttgagatcatcgtcaacaaagatgagatcgaacggttcttctcctctgtttacaatcactcaacgacgtcatcccccacaacaaccaccaccaaaaaggctctcgcggtggttaggcgacggagaagtttccgttcttgttcacgaagatgatcaataattggagttaaccacaataaagttaaaggttccttcatttcggtaactttttatttattttatgtaacgattctcaactttacacgtcgacccactctataaatatacatgtgctatcgatcgttggaatctttcttttcttaatagcttcatgaattatgtaaatgttcaataaatttatatttgct

SEQ ID NO: 4732 - protein, 133 aa, Brassica napus
  misc_feature (1)..(133): useful for making plants with increased cold tolerance as described in USSN 12/863,773
  misc_feature (1)..(133): Ceres CLONE ID no.1080942
  misc_feature (1)..(133): Bit score of 274.7 for HMM based on sequences of FIGURE 1 of USSN 12/863,773.
  misc_feature (1)..(133): Functional Homolog Of Ceres SEEDLINE ID no. ME00327
MNLDLIQDLPMLKFPSPIKIPSNNTNRDDDGSSGGCTTPTSSDHKIPPSTATTPPPPPQKRRPPPSPSCFIRSCKRKLLTPSKVEIIVNKDEIERFFSSVYNHSTTSSPTTTTTKKALAVVRRRRSFRSCSRR

SEQ ID NO: 4733 - DNA, 623 bp, Glycine max
  misc_feature (1)..(623): useful for making plants with increased cold tolerance as described in USSN 12/863,773
  misc_feature (1)..(623): Ceres CLONE ID no.1073190
aacaagttttctacatccacacaaaaaaggttttccaaacataagcacacatttacagacatggatgatcttgagttattacaagatctgtcccaattcaacttcccagcaaccatcaagatcccatctaaaacctctaaagacaacaaagacggcgatggtgataacgacgagggctttagctgcagcacacccacatctcaagaacacaagattccttctgtccacgattctccacctcccccgccgagaaaacctcgtgcactgccttcaaaaccgtcgcctacggcggctctggtgataagatcgtgtaagaggaagctcttagtgtcggctcctgagattatcatgaacaaggaagagattgaccgtttcttctcctctgtctatagtgacacgtcaacgacggctaaacggcggagacgttatctttattgtgcgcgaagatgagcctttagttcaagatttacattttctacagttttactggaaatatataaattaaaaaccttattataagtattttaattttcaaaatggatggataattttctgtagccgcatattaattccgcatggaggggtcgttgttgtaaattccgtaataaatgaaatttaattcc

SEQ ID NO: 4734 - protein, 129 aa, Glycine max
  misc_feature (1)..(129): useful for making plants with increased cold tolerance as described in USSN 12/863,773
  misc_feature (1)..(129): Ceres CLONE ID no.1073190
  misc_feature (1)..(129): Bit score of 272.3 for HMM based on sequences of FIGURE 1 of USSN 12/863,773.
  misc_feature (1)..(129): Functional Homolog Of Ceres SEEDLINE ID no. ME00327
MDDLELLQDLSQFNFPATIKIPSKTSKDNKDGDGDNDEGFSCSTPTSQEHKIPSVHDSPPPPPRKPRALPSKPSPTAALVIRSCKRKLLVSAPEIIMNKEEIDRFFSSVYSDTSTTAKRRRRYLYCARR

SEQ ID NO: 4735 - DNA, 1377 bp, Arabidopsis thaliana
  misc_feature (1)..(1377): useful for making plants with increased cold tolerance as described in USSN 12/863,773
  misc_feature (1)..(1377): Ceres SEEDLINE ID no.ME04315
  misc_feature (1)..(1377): Expected Sequence
aaaaaacttcaaagagagagagagagagagttttgtgaactcaagaaaataaaaaaagttatagttaatgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcacttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctgattcgaatctacggtggataaacaatcaacctgaagacttcatatcttccaccgttgatttacagtcggtgtataataagtatagtgagtcttaccgtagacaaacatcttatcctctttaccgttttaattactttttttttacgcgctctcactgccactgtaactcttttttttttcttcctatatatgtatgcttatttttatttagaaaatgttatgaaatcatataatttggtaatc

SEQ ID NO: 4736 - DNA, 1377 bp, Arabidopsis thaliana
  misc_feature (1)..(1377): useful for making plants with increased cold tolerance as described in USSN 12/863,773
  misc_feature (1)..(1377): Ceres SEEDLINE ID no.ME04315
  misc_feature (1)..(1377): Inplanta Sequence
aaaaaacttcaaagagagagagagagagagttttgtgaactcaagaaaataaaaaaagttatagttaatgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcacttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctgattcgaatctacggtggataaacaatcaacctgaagacttcatatcttccaccgttgatttacagtcggtgtataataagtatagtgagtcttaccgtagacaaacatcttatcctctttaccgttttaattactttttttttacgcgctctcactgccactgtaactcttttttttttcttcctatatatgtatgcttatttttatttaaaaaatgttatgaaatcatataatttggtaatc

SEQ ID NO: 4737 - protein, 355 aa, Arabidopsis thaliana
  misc_feature (1)..(355): useful for making plants with increased cold tolerance as described in USSN 12/863,773
  misc_feature (1)..(355): Ceres SEEDLINE ID no.ME04315
  misc_feature (1)..(355): Bit score of 860.9 for HMM based on sequences of FIGURE 2 of USSN 12/863,773.
  misc_feature (285)..(329): Pfam Name: CCT Pfam Description: CCT motif
  misc_feature (56)..(103): Pfam Name: zf-B_box Pfam Description: B-box zinc finger
MGFGLESIKSISGGWGAAARSCDACKSVTAAVFCRVDSAFLCIACDTRIHSFTRHERVWVCEVCEQAPAAVTCKADAAALCVTCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 4738 - DNA, 1541 bp, Gossypium hirsutum
  misc_feature (1)..(1541): useful for making plants with increased cold tolerance as described in USSN 12/863,773
  misc_feature (1)..(1541): Ceres CLONE ID no.1842825
aagagcaaactgtggcactactccatgtatactcccaaaatctctaaaaagggaaatactagtcctttcgagggcaactgaaagaggagaaaaaaaaatctattggttttgatttgtgaggatggtaatcgatacaaccaacgtcaagggacttacgggacgctggggcatggcagcaaagacatgcgacacatgtaaatcagcggcagcggctattttctgtcgttctgattccgcttttatgtgcctcagctgcgattccaggatccactctgctaatgacaagcttgtttcttgtcgtcacgagagggtgtggatgtgtgaggtgtgcgagcaggccccagctgccgtcacttgcaaggccgacgccgctgccctttgcgtcgcctgcgattccgacatccactctgctaatcctttggctcgtcgccacgagcgtgtccctgtccagcctttctttgactctgctgattccatcgtcaaatcttcttctttcagcttccttgtgccgactgatcctaatactggttctaattgtcaacaagaagatgtagagacaggttcttggctgttgcccaatcccaaactcaccatggaaactaaccaagtcaaaacaggggattttttcttctccgacatggatccgtttattgattttgagtaccaggattcgtttcaacagcatgacggagctatggacagcgtagttccagttcagaccaaaccagctacaatttcaatgatcaacaatgaaaattgtttcgatgttgatttctgtcgatccaagttccctactttcagctaccagacaaagtctcaaagccatagtgtttcatcatcgtcgctcgaggtaggagtagttccagatgggaactccgtgtcggatatctcatatactttgggacggaccatgggtgacccaagcgcaccaatctgggcagctacagccaataaccaagcaccacctcaggcccaagtcggtggaatggatcgagaagctagagttctaaggtacagagagaagagaaagaacagaaaatttgagaaaacaatccgctacgcttcgagaaaggcatacgccgagtcaaggccaaggatcaaaggccgtttcgccaaaagaaatgaaaccgacaacgaagttgaccacatgtataactcggcttcttccgctgctaccgcagcagctttcatgtacgataaccagtacggcatcgtcccatccttttgaggatgtcatgaatgaatctgattcagatggaaacaagaattgttggctgtaatattcaactgtgatatatatatccagcaagtagaatcaactaccctaaggaaaacaaatgatgtagcttttaattatggttattgatgtaaaaatagtgtatccatgagctattgatttgcagggattcattcaagttgattaactgcagaataagatggaaaagtcctgcaaaatctgaaacaaagcccttccactttttctctagagggcttcttctgtgattctgttatctagaagtaaaagtttttcttggtttttc

SEQ ID NO: 4739 - protein, 368 aa, Gossypium hirsutum
  misc_feature (1)..(368): useful for making plants with increased cold tolerance as described in USSN 12/863,773
  misc_feature (1)..(368): Ceres CLONE ID no.1842825
  misc_feature (1)..(368): Bit score of 932.9 for HMM based on sequences of FIGURE 2 of USSN 12/863,773.
  misc_feature (291)..(335): Pfam Name: CCT Pfam Description: CCT motif
  misc_feature (62)..(109): Pfam Name: zf-B_box Pfam Description: B-box zinc finger
  misc_feature (1)..(368): Functional Homolog Of Ceres SEEDLINE ID no. ME04315
MVIDTTNVKGLTGRWGMAAKTCDTCKSAAAAIFCRSDSAFMCLSCDSRIHSANDKLVSCRHERVWMCEVCEQAPAAVTCKADAAALCVACDSDIHSANPLARRHERVPVQPFFDSADSIVKSSSFSFLVPTDPNTGSNCQQEDVETGSWLLPNPKLTMETNQVKTGDFFFSDMDPFIDFEYQDSFQQHDGAMDSVVPVQTKPATISMINNENCFDVDFCRSKFPTFSYQTKSQSHSVSSSSLEVGVVPDGNSVSDISYTLGRTMGDPSAPIWAATANNQAPPQAQVGGMDREARVLRYREKRKNRKFEKTIRYASRKAYAESRPRIKGRFAKRNETDNEVDHMYNSASSAATAAAFMYDNQYGIVPSF

SEQ ID NO: 4740 - DNA, 1332 bp, Gossypium hirsutum
  misc_feature (1)..(1332): useful for making plants with increased cold tolerance as described in USSN 12/863,773
  misc_feature (1)..(1332): Ceres CLONE ID no.1834027
ttaaaatcaataacaaacacttcaaaccctccacgtttgatccaaacataatatttttttatttccattgctttgatttgattcgcgattatgggaatcgaaataagcggcggcacgatcattccaggaggttggggggccgccgccatggctgtcgcggctaagacatgcgacgcatgtaaatcatcggcggcagctatcttttgtcgtactgattgggtctttttatgcttgaattgtgattccaatttccattccggtcacgaaagggtgtctatgtgtgaagtttgcgaacaagctccggcggctgtcacttgtaaagccgacgcggcggctctttgtgtcacttgcgacgccgatatccattcagcgaacccactggctcgccgtcacgaacgtgtacccatcgaacctttctacgactccgctgattccatcgtcaaatcttccccttttagcttccttgtgccgacgacggatcataatggtactaattgtaaacaagaaattgaatctaacaaaggggatttttttttcacagaaatggatcggtttatcgatttcgggtacccgaattcatctcaacatcttcatgatgccgccatggatagcgttgttccagttcaaactccaaaaccagtcattccactgatcaacgatggaagctgtttcgatactttcagctatcaaactcaatcatctctcagtcatagcgtttcatcatcgtcgcttgaagtagaaacagttccagatgggaattaccacgcaacacaagtgggtggttcaatcgatcgagaagctagggttttaaggtacaaagagaagagaaagaacaggaaattcgagaagacaatacgatacgcttcaagaaaggcttacgctgaatcaagaccaagaatcaaaggtcgatttgctaaaagaacagaaacccacaacgatgatgttgatcacatgttcaataactcttctttcgctgttggtcctgctggtttcatggcggaaacagactatggtgtcgttccatcgttttgaatgttgatgttttatgtttggtttaatctgtaatgtattaaattatttaatccaatttccagcaaagtagaaataaccttatggccattgaaaatcaaggaagaaagatgcttagttctttgattaatcattaaagtttctgatgtataaaaaacagtgtatcggtggagttcgtcgtatgttcgccatggttgatttgcaggattcctgcaagggagatatattagttttcataaaaatgtttatttcaatctctgaataaaaccagatatatggtaagtaaatgcttcaatttagttc

SEQ ID NO: 4741 - protein, 313 aa, Gossypium hirsutum
  misc_feature (1)..(313): useful for making plants with increased cold tolerance as described in USSN 12/863,773
  misc_feature (1)..(313): Ceres CLONE ID no.1834027
  misc_feature (1)..(313): Bit score of 543.8 for HMM based on sequences of FIGURE 2 of USSN 12/863,773.
  misc_feature (235)..(279): Pfam Name: CCT Pfam Description: CCT motif
  misc_feature (64)..(106): Pfam Name: zf-B_box Pfam Description: B-box zinc finger
  misc_feature (1)..(313): Functional Homolog Of Ceres SEEDLINE ID no. ME04315
MGIEISGGTIIPGGWGAAAMAVAAKTCDACKSSAAAIFCRTDWVFLCLNCDSNFHSGHERVSMCEVCEQAPAAVTCKADAAALCVTCDADIHSANPLARRHERVPIEPFYDSADSIVKSSPFSFLVPTTDHNGTNCKQEIESNKGDFFFTEMDRFIDFGYPNSSQHLHDAAMDSVVPVQTPKPVIPLINDGSCFDTFSYQTQSSLSHSVSSSSLEVETVPDGNYHATQVGGSIDREARVLRYKEKRKNRKFEKTIRYASRKAYAESRPRIKGRFAKRTETHNDDVDHMFNNSSFAVGPAGFMAETDYGVVPSF

SEQ ID NO: 4742 - DNA, 1226 bp, Gossypium hirsutum
  misc_feature (1)..(1226): useful for making plants with increased cold tolerance as described in USSN 12/863,773
  misc_feature (1)..(1226): Ceres CLONE ID no.1837064
gattccaaagatctcaccccatcaactgaaatggctgcaaagcattcggacgcctgtaaaccaacagctaccgatccagattttatgtgcctgagttatgattcttccaccgccatccatggctgcattgggagggtgttgatgtgcgacgtttgcgagcaagttccggctgcgttcacttgcaaagccgatgccgccgcgctttgtgtcgcttgtgatgccgatattcactccgctaatcatttggctcgtcgtcactaccgtgtcccgatcgacccttttcttggtccacaaaaagaggatgtagtagtgatgggttcttggtctttgttacctggtttcaatcataaactggttgaaacagaggatttggggatttcagaaatggatccatttattgatttggagtaccaggatggatatcatgttttacagcatcataatttaggtatggaaagcttagttccagttcagatcgaaccggcaacaacagttccagtggtcaaccctattcacttctgccaatctcagtctctcagccatagtgtatcgtcatcctcggttgagttaggtgatgggaattctttatcagatatctcatgcccattaagaggtaccacaactgatccaagcatactcatatgcaacaaccaagtagaccaagttggttcaatggatcgagtggctcgggttttgaggtacagagaaaagagaaagaagagaaaatttgagaaaacagttcgttacgcttcacgaaaagcctacgctgaatcaagaccgagaatcaaaggtcgtttcgttaaaagaactcaaatccataaccgagttgaccatctctgtaactcggcaacatcaccatcatcatcaacaacgacatcccacacgcattactacggtatcgtcccatcttttttatgaaagggaaacgtggaaaaatgaaaccaaaaaatttaattttagtgatgatattgtaaaattccactagtttatgtagcaagtagaataataatcccaagtccattaagattgaggaagatattatgtaacccaaataacggtgatgtttttggtagccgttgatatttggggcttttagggttatacgcaagcagatgttagagttctaagaactgatattttgcttgcagttctgaaaaaaatgaagcccttttcaccatttttattgagaggggcttcttttgtttttatgttactaaagtttgacc

SEQ ID NO: 4743 - protein, 295 aa, Gossypium hirsutum
  misc_feature (1)..(295): useful for making plants with increased cold tolerance as described in USSN 12/863,773
  misc_feature (1)..(295): Ceres CLONE ID no.1837064
  misc_feature (1)..(295): Bit score of 317.3 for HMM based on sequences of FIGURE 2 of USSN 12/863,773.
  misc_feature (217)..(261): Pfam Name: CCT Pfam Description: CCT motif
  misc_feature (34)..(81): Pfam Name: zf-B_box Pfam Description: B-box zinc finger
  misc_feature (1)..(295): Functional Homolog Of Ceres SEEDLINE ID no. ME04315
MAAKHSDACKPTATDPDFMCLSYDSSTAIHGCIGRVLMCDVCEQVPAAFTCKADAAALCVACDADIHSANHLARRHYRVPIDPFLGPQKEDVVVMGSWSLLPGFNHKLVETEDLGISEMDPFIDLEYQDGYHVLQHHNLGMESLVPVQIEPATTVPVVNPIHFCQSQSLSHSVSSSSVELGDGNSLSDISCPLRGTTTDPSILICNNQVDQVGSMDRVARVLRYREKRKKRKFEKTVRYASRKAYAESRPRIKGRFVKRTQIHNRVDHLCNSATSPSSSTTTSHTHYYGIVPSFL

SEQ ID NO: 4744 - DNA, 1155 bp, Populus balsamifera subsp. trichocarpa
  misc_feature (1)..(1155): useful for making plants with increased cold tolerance as described in USSN 12/863,773
  misc_feature (1)..(1155): Ceres ANNOT ID no.1482536
atgggaattgaagttgagagcttaaagaacttgaccggaggatggagtgttgcggctaaacgttgcgactcgtgcaaaacggcagctgcagctgcgttttgccgggcggactctgcttttttgtgtctgaattgtgacaccaagattcaccatagtggggtgaacagcaagatcatgtcaaggcacgagcgtgtgtggatgtgtgaggtttgcgagcaagcacccgctgcggttacctgtaaggctgatgcagctgctctttgtgttacttgtgatgctgacatccactctgctaaccctcttgctcgccgtcatgaacgagtccccgtggagcctttttatgactctgctgaatcaattgttaagacttcctcggcgtttaattttctagtgcctggtgatcaaaatggtgtgtctgcatatgatcataacgatgagatcgagggtgtttcgtggttgttgcacggtaatcacacaacacatgaccttaataccaagatcaacatcgagaatcctgttgtcaagactggagatatgtttttctgtgaaatggatccctttcttgattttgagtatcagaattcgatggatgggaggtacaagcagagtcatggtgggggtggtgctggagctgatagcgttgtgcctgtgcaaaacaaaccagctccgcttcccgtgatcgatcataaaaactgctttgatattgatttctgtagatcgaaactcacctctttcagcagctacccctctcagtcccttagccacagcgtttcttcgtcttccctcgatgttggtgttgttcctgatgggaattctatgtccgatatttcgtatcccttcggccgaagcatgaatacttataccgatccaagcatgcccatctcaggttccactacaaatcaagcagcagctcagttagctgggattgaccgcgaagctagagttttgaggtacagagagaaaagaaagaaccgtaaattcgaaaaaaccatacggtatgcttcacgtaaagcttacgcagaaaccaggccaagaatcaaaggccgattcgcgaagcgaaccgaaatggaatccgatatggacaccctatataactctccgagctctgtccctttcctggccgatactcattacggtgtcgttccctcgttttga

SEQ ID NO: 4745 - protein, 384 aa, Populus balsamifera subsp. trichocarpa
  misc_feature (1)..(384): useful for making plants with increased cold tolerance as described in USSN 12/863,773
  misc_feature (1)..(384): Ceres ANNOT ID no.1482536
  misc_feature (1)..(384): Bit score of 969.7 for HMM based on sequences of FIGURE 2 of USSN 12/863,773.
  misc_feature (311)..(355): Pfam Name: CCT Pfam Description: CCT motif
  misc_feature (63)..(110): Pfam Name: zf-B_box Pfam Description: B-box zinc finger
  misc_feature (1)..(384): Functional Homolog Of Ceres SEEDLINE ID no. ME04315
MGIEVESLKNLTGGWSVAAKRCDSCKTAAAAAFCRADSAFLCLNCDTKIHHSGVNSKIMSRHERVWMCEVCEQAPAAVTCKADAAALCVTCDADIHSANPLARRHERVPVEPFYDSAESIVKTSSAFNFLVPGDQNGVSAYDHNDEIEGVSWLLHGNHTTHDLNTKINIENPVVKTGDMFFCEMDPFLDFEYQNSMDGRYKQSHGGGGAGADSVVPVQNKPAPLPVIDHKNCFDIDFCRSKLTSFSSYPSQSLSHSVSSSSLDVGVVPDGNSMSDISYPFGRSMNTYTDPSMPISGSTTNQAAAQLAGIDREARVLRYREKRKNRKFEKTIRYASRKAYAETRPRIKGRFAKRTEMESDMDTLYNSPSSVPFLADTHYGVVPSF

SEQ ID NO: 4746 - protein, 355 aa, Arabidopsis thaliana
  misc_feature (1)..(355): useful for making plants with increased cold tolerance as described in USSN 12/863,773
  misc_feature (1)..(355): Public GI ID no.18424009
  misc_feature (1)..(355): Bit score of 856.7 for HMM based on sequences of FIGURE 2 of USSN 12/863,773.
  misc_feature (285)..(329): Pfam Name: CCT Pfam Description: CCT motif
  misc_feature (56)..(103): Pfam Name: zf-B_box Pfam Description: B-box zinc finger
  misc_feature (1)..(355): Functional Homolog Of Ceres SEEDLINE ID no. ME04315
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 4747 - protein, 351 aa, Arabidopsis thaliana
  misc_feature (1)..(351): useful for making plants with increased cold tolerance as described in USSN 12/863,773
  misc_feature (1)..(351): Public GI ID no.9759262
  misc_feature (1)..(351): Bit score of 833.0 for HMM based on sequences of FIGURE 2 of USSN 12/863,773.
  misc_feature (281)..(325): Pfam Name: CCT Pfam Description: CCT motif
  misc_feature (56)..(103): Pfam Name: zf-B_box Pfam Description: B-box zinc finger
  misc_feature (1)..(351): Functional Homolog Of Ceres SEEDLINE ID no. ME04315
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 4748 - DNA, 1428 bp, Glycine max
  misc_feature (1)..(1428): useful for making plants with increased cold tolerance as described in USSN 12/863,773
  misc_feature (1)..(1428): Ceres CLONE ID no.463157
aactcactcactcattcaagtcgctaatcctagttccttcaactcctcgctggcaacaacagcagtactaccattagccgcgtttttcaaaagtgattttcgagaattagcgatgggaattgaaagaggaggcttcaagggattcaggagcgcctggagcgtgccgcccaagccgtgcgattcctgcaagctggcctcggcggcgcttttctgccgccccgattccgcgtttctctgcatcgcctgcgattccaacattcactgctcgaacaaactcgcgtcgcgccacgagcgcgtgtggatgtgtgaggtgtgcgagcaggcacccgctgctgtcacgtgcaaggccgacgccgccgccctctgcgtcacgtgtgactccgacatccactccgcgaaccccctcgcgcaacgccacgagcgcgtccccgtggaacctttctttgactccgctgagtccatagtgaaagcctctgctgccgccaccttcgggttcattgtcccatccgacgacggcggcgcctccgacgctttcgcccccgatgactccgacgccgccgcgtggctcatcccgaaccctaatttcgggtccaagctcatggacgcccccgaaatcaagtccaaggagatattcttctctgaaatggaccccttcctcgattttgattactcaaactccttccaaaacaacaacagcgccggaaacgacagcgtcgttccagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaacacggtgtcagacatgtcgtattcttttggtcggaacagttcggattcgagtgggattgttgttgtgtcaggaaatagtgtggggcaaggtgcgacgcagttgtgtggaatggatcgggaagcgagggtactgcgatacagagagaaaaggaagaaccgaaaattcgagaagacaattcgatacgcatcgcgaaaagcatatgcggaaacccggcccaggataaaaggccgcttcgccaaacgaacagaaattgactcggatgtggagcgtctctatagccctggccctgcggtgctcatgctggacactccatacggcgtcgtaccatcgttttagttaatttcaaaatgaagaaacgatggagtgcatgaatcttagaataatgattagcgattctgtgggattgttaggggaaaaaggtgaagaatcgaatcggtacgaacgtgattcttagctggagcgcgatgggggaagattattgtgaagatttgtctcgatcgaccagaaaagcccgtttactttttatg

SEQ ID NO: 4749 - protein, 374 aa, Glycine max
  misc_feature (1)..(374): useful for making plants with increased cold tolerance as described in USSN 12/863,773
  misc_feature (1)..(374): Ceres CLONE ID no.463157
  misc_feature (1)..(374): Bit score of 912.7 for HMM based on sequences of FIGURE 2 of USSN 12/863,773.
  misc_feature (302)..(346): Pfam Name: CCT Pfam Description: CCT motif
  misc_feature (60)..(107): Pfam Name: zf-B_box Pfam Description: B-box zinc finger
  misc_feature (1)..(374): Functional Homolog Of Ceres SEEDLINE ID no. ME04315
MGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 4750 - DNA, 1556 bp, Triticum aestivum
  misc_feature (1)..(1556): useful for making plants with increased cold tolerance as described in USSN 12/863,773
  misc_feature (1)..(1556): Ceres CLONE ID no.685991
aacttttgcttcgccgtggaagggatcgtcgtagctggcttagcttgctgctttgcttccaagtgttgctgctggtggtgctgtggtagtgtggtgtgaggtgtgatggagctgcaggggctggggaggtactggggcgtgggcggcaggaggtgcgggtcgtgccgggggtcgccggcggcggtgcactgccggacgtgcgatgggggcagtggggacggggcgtacctgtgcgcgggctgtggcgaggggcacgcgcgggcggggcacgagagggtgtgggtctgcgaggtgtgcgagctcgcgccggccgcggtcacctgcaaggccgacgccgccgcgctctgcgccgcctgcgacgccgacatccaccacgccaacccgctcgcgcgccgccacgagcgcgtccccgtgcagcccatcgggtcctcgtcacccgaggggcaggagcaggagcaggatgcgttcgtgatgtcgttcggcggctcggtcgacggggagaagcagcagaaccccgtggtgaacctgaacgacgctctggaggccggcgccggcgggaaggagaacgtgaagctggacttcctgttcgcggacatgatggaccctttcttcggctccgagctcccgcgcttcccgcacgccgacagcgttgtccccagcggcggcgcggtggagctggacttcggtggcgtcgccgcccccgtcgtcgtctccaacccgtcctacagctcctacacggcggcgtcgctcggtggaagtggctcgtcgtcggaggtcggcttggtgccggacgcgatctgtggccgaggcggcggcatcatcgagctggacttcgcacagtccaaggccgcgtacctgccctacacccccacaccaagccacagtaccgtctcctcggtggatgttgggtcggtgccggagcggagcgacagcgccgtcgcggcggcgacgccggcgacgggggaggggagggaggcgcgtctgatgcggtaccgcgagaagcgcaagaaccggcggttcgagaagaccatccggtacgcgtcccggaaggcctacgccgagagcaggccgcgcgtcaagggccgcttcgccaagcgcgccgacgacgcggacaccgacgccgtcgcggcggccacgatcaccacgccggggccatgcgtgctcgacttcggcagctacggcgtcgtgcccaccttctgaggcggcgcctgatttcgtgtccatttcctccggcgagcgtgccggctgggtgcctaattaaatccggcaccgccatggccggcacgagcgcgccgacgtgcatgcgtcgtgttccctcttgtataattgcatgtaatgtttttcgagctggctgatcgctggctggcgtgtagtatactgtaatcaacatgcacgcacgcacgcacgcatgttttgctagaactagaataatacagatagttctagttgactagtctactaccctgtaccctttccctgggctagcttgatgccaaattaggctagggcaatgtaacgtgtttgctggaacagcttagttctagttttggatccgc

SEQ ID NO: 4751 - protein, 364 aa, Triticum aestivum
  misc_feature (1)..(364): useful for making plants with increased cold tolerance as described in USSN 12/863,773
  misc_feature (1)..(364): Ceres CLONE ID no.685991
  misc_feature (1)..(364): Bit score of 464.6 for HMM based on sequences of FIGURE 2 of USSN 12/863,773.
  misc_feature (289)..(333): Pfam Name: CCT Pfam Description: CCT motif
  misc_feature (56)..(103): Pfam Name: zf-B_box Pfam Description: B-box zinc finger
  misc_feature (1)..(364): Functional Homolog Of Ceres SEEDLINE ID no. ME04315
MELQGLGRYWGVGGRRCGSCRGSPAAVHCRTCDGGSGDGAYLCAGCGEGHARAGHERVWVCEVCELAPAAVTCKADAAALCAACDADIHHANPLARRHERVPVQPIGSSSPEGQEQEQDAFVMSFGGSVDGEKQQNPVVNLNDALEAGAGGKENVKLDFLFADMMDPFFGSELPRFPHADSVVPSGGAVELDFGGVAAPVVVSNPSYSSYTAASLGGSGSSSEVGLVPDAICGRGGGIIELDFAQSKAAYLPYTPTPSHSTVSSVDVGSVPERSDSAVAAATPATGEGREARLMRYREKRKNRRFEKTIRYASRKAYAESRPRVKGRFAKRADDADTDAVAAATITTPGPCVLDFGSYGVVPTF

SEQ ID NO: 4752 - DNA, 1442 bp, Triticum aestivum
  misc_feature (1)..(1442): useful for making plants with increased cold tolerance as described in USSN 12/863,773
  misc_feature (1)..(1442): Ceres CLONE ID no.702632
acctcagatcaatcactcttccctcccactactcccaccgcgttcacccgccattgcctgtcgaagctacgagattagttactagtatgatggagctgcgcaagtactggggcgtgggggggaggaggtgcggggcgtgcgagggggcggcgccggcggcggtgcactgccgggattgcgccgggtacctgtgcacggggtgcgacgcgcggccggcgcacgcgcgggctggccacgagcgcgtctgggtgtgcgaggtctgcgaggtcagccccgcggccgtgacgtgcaaggccgacgccgccgtgctctgcgccgtgtgcgacgccgacatccaccacgccaacccgctcgccgagcgccacgtgcgcgtgcccatcgcgcccatctgctcccccgaggccgccgcggtggcggccgaggccatgatgttctgtggcgccggtgacggcgaggcgcgggcggatcaggacgacgtgcccgagcagctgcaccaacacggggggatgctgaaacctcaacgtggaggccggcaaggagggccggaagatggactacctcttctccgacctcgtcgacccctacctcgctgtcgactttacgcgcttcgcccacgctgacagcgtcgtgcccagcggcgtcgccaccggcgccgtacccgccgtcgtggacctggacttcgcgtgcgggatcggcgccaagccgccggcgacctacagctcctcgtacacggccaacgcctccggcgcgcacagcggctcttcatcggaggtcagcgtggtgccggaggccatctgcggcggcgtcgggagcttcgagatcgacttcacccggcccaagccgcagccgtacatgcccgcgtacaccgcggcaccgccgagccatggggtgagcgcgcagcaggcgtggccggtggacatggggtacttgacggtgccggagcgtccggtggcggtgaccggggagggcagggtggcgaggctgatgcggtaccgggagaagaggaagaaccgccggttcgagaagaccatccggtacgcgtccaggaaggcctacgccgagtcgcggccgcgcgtcaagggccgcttcgccaagcgcaccgaccaggacgccgacggcgacgacgtggacgcggaggcccatgccgtgccgtcttccacgtcctacttgctcgactttggctacggcgtcgtgccgtccttctgatccgccggcccggcgccccggccggcggccttgtacttgtaccattgatgcatgtacagtagtacgtaggggactagtaatccatccatgtactcctcctgagctagttcgatcgcgcttttgatgtactagtaatactgtaaactgtaacagtagtagtactttggccaatatgctcgtttatttttggatggccgaaactagtagcccaaacatttggatcatcaatcattatt

SEQ ID NO: 4753 - protein, 372 aa, Triticum aestivum
  misc_feature (1)..(372): useful for making plants with increased cold tolerance as described in USSN 12/863,773
  misc_feature (1)..(372): Ceres CLONE ID no.702632
  misc_feature (1)..(372): Bit score of 497.8 for HMM based on sequences of FIGURE 2 of USSN 12/863,773.
  misc_feature (295)..(339): Pfam Name: CCT Pfam Description: CCT motif
  misc_feature (51)..(98): Pfam Name: zf-B_box Pfam Description: B-box zinc finger
  misc_feature (1)..(372): Functional Homolog Of Ceres SEEDLINE ID no. ME04315
MMELRKYWGVGGRRCGACEGAAPAAVHCRDCAGYLCTGCDARPAHARAGHERVWVCEVCEVSPAAVTCKADAAVLCAVCDADIHHANPLAERHVRVPIAPICSPEAAAVAAEAMMFCGAGDGEARADQDDVPEQLHQHGGMLNLNVEAGKEGRKMDYLFSDLVDPYLAVDFTRFAHADSVVPSGVATGAVPAVVDLDFACGIGAKPPATYSSSYTANASGAHSGSSSEVSVVPEAICGGVGSFEIDFTRPKPQPYMPAYTAAPPSHGVSAQQAWPVDMGYLTVPERPVAVTGEGRVARLMRYREKRKNRRFEKTIRYASRKAYAESRPRVKGRFAKRTDQDADGDDVDAEAHAVPSSTSYLLDFGYGVVPSF

SEQ ID NO: 4754 - DNA, 1345 bp, Zea mays
  misc_feature (1)..(1345): useful for making plants with increased cold tolerance as described in USSN 12/863,773
  misc_feature (1)..(1345): Ceres CLONE ID no.1559496
ctgacacccgtggcatccctctcgtgactcccggagcggaggcatggacaccgcggcggagctggagctggggctggagttggagcagaagccggcggcggggtactggagcgtggtgggcgcgcgcccttgcgacgcgtgcgccgcggagccggcgcggctgcactgccgcgcggacggcgcgttcctgtgccccggctgcgacgcccgggcgcacggcgccgggtcgcgccacgcgcgcgtctggctgtgcgaggtctgcgagcacgcccccgccgtcgtcacctgccgcgccgacgccgccgcgctctgcgccgcctgcgacgccgacatccactcggccaacccgctcgcgcgccgccacgagcgcctccccatcgcccctctcttcggcgcgctcgcggacgcgccgcagcccttcccgtccccggccctcgctgccgccgcgggggccgaggccccggccccgaccccggctcagggtgaagcggtggcggaagactacgggagcagcgaggccgaggcggcgtcgtggttgctccccgagcccgacaacagccacgaggacagcgccgccgacacgttcttcgcggagtcggacgcgtacctcggcgccgacctcgacttcgcccggtgcatggacggcgtcaaggccatcggcgtgccggtcgcgccgcccgagctggacatcggtgccggcagcttttgctaccccgaacactccatgaaccacattttgtcgtcatcctcggaggtggcggtggtaccggacgcgcaggcggccggtctgccggtggtggtggtggtgagcagaggggaggagcgggaggcgcggctgatgcggtaccgtgagaagcgcaagaaccgccggttcgacaagaccatccgctacgcgtcccgcaaggcgtacgccgagacgcggccgcgcatcaagggccgcttcgccaagcgccgttccgcggagggcgaggacgaggcgctggagcacgaggaaggggcgtgcttctcgcccgcggggtcggcgcccgccgcgtcggacggcgtcgtcccgtccttgtgttgaggggagaagacgacgacgaccccggcagacggctgcttaactttgccagctctgtcgaccctgaaccttttttttttccctcccccaccttctctcttttgatcgaggggttgccagctctggatctgaaactctgaacgcatgggacgcgagctgtgtgtagcatgaataactgcgtagtttgttggatggacgaactcaatcgcgctcgcatggaatggaactcttgtaatccaccctttgtacattaccatctagagttgctccttttttccatgagcc

SEQ ID NO: 4755 - protein, 339 aa, Zea mays
  misc_feature (1)..(339): useful for making plants with increased cold tolerance as described in USSN 12/863,773
  misc_feature (1)..(339): Ceres CLONE ID no.1559496
  misc_feature (1)..(339): Bit score of 612.0 for HMM based on sequences of FIGURE 2 of USSN 12/863,773.
  misc_feature (261)..(305): Pfam Name: CCT Pfam Description: CCT motif
  misc_feature (70)..(112): Pfam Name: zf-B_box Pfam Description: B-box zinc finger
  misc_feature (1)..(339): Functional Homolog Of Ceres SEEDLINE ID no. ME04315
MDTAAELELGLELEQKPAAGYWSVVGARPCDACAAEPARLHCRADGAFLCPGCDARAHGAGSRHARVWLCEVCEHAPAVVTCRADAAALCAACDADIHSANPLARRHERLPIAPLFGALADAPQPFPSPALAAAAGAEAPAPTPAQGEAVAEDYGSSEAEAASWLLPEPDNSHEDSAADTFFAESDAYLGADLDFARCMDGVKAIGVPVAPPELDIGAGSFCYPEHSMNHILSSSSEVAVVPDAQAAGLPVVVVVSRGEEREARLMRYREKRKNRRFDKTIRYASRKAYAETRPRIKGRFAKRRSAEGEDEALEHEEGACFSPAGSAPAASDGVVPSLC

SEQ ID NO: 4756 - DNA, 1490 bp, Zea mays
  misc_feature (1)..(1490): useful for making plants with increased cold tolerance as described in USSN 12/863,773
  misc_feature (1)..(1490): Ceres CLONE ID no.1674443
gctgcgctgcctccctccactactacgccagccactctgccttccctcccccaccaccacaagaaccgcttcaccattgccgcgccgcgtccagctgagcctcctcttagccgcgccagccaggagaaggcgcgcgcgcacacctgctgcttggtgaccgcgttcgatggagctgcacaagtactggggcgtggggggccggcggtgcggcagctgcgagggggccccggcggcggtgcactgccgcacgtgcgttggtggatccttcctctgcacgacgtgcgacgcccgccccgcgcacgcgcgcctgggccacgagcgcgtgtggatgtgcgaggtctgcgagctggcccccgccgccgtcacgtgcaaggccgacgccgccgtgctctgcgccgcttgcgactccgacatccacgacgccaacccgctggcccggcgccacgcgcgggtccccgtcgcccccatcggctccgaggccgccgccgcggccgtggaggccatgctgttcgggaccggcgaggcggccgcttccgaggccgacgagcagcacgcggcggccgagcacgcgcacgcgcacgcgctgaacctcaacgtggaggccaaggacatgaagctggactacctcttctctgaactggatccctacctcagcgtcgagatcccgcgcttccagcacgctgacagcgtcgtccccaacggcgccggcgctgccgtcgagctggacttcacgtgcggcatcggcgttaagcactcctcctacagctcctacacggccacctccctcgctcatagcggctcctcgtcggaggttggcgtggtgccagaggccttcggcggcagcggcagcggcggcgggagctttgagctcgacttcacaaggcccaagcctcaggcctacatgccatacaccgggactccccagagccacagcgtgccatccgcggacgtggaggtggtgccggagcggggagacttggctgcggtgaggccggtgccgctgatgggggagagcagggaggcgcgcctgatgcggtaccgtgagaaaaggaagaacaggcgcttcgagaagaccatccggtacgcgtcccggaaggcctacgccgagacgcggccgcgaatcaagggccggtttgccaagcgtgctgaccacgacggggacgccgacgccgacgacgctgaggccgaggccgaggccgaggccgccgtgccgatgtcatatgtgctcgacttcggctacggcgtcgtaccgagcttttgatgtgcccgggcccaacacgcgcgcacatggccggccgcgcgcttgaaccggcatggcacgccgctgcgcgcgcgccttgtacttgtatcgatcgatgtatagggaggagtagtaatcccatgtactctctttttgagcaagctcttgcgtaaactagtgatgtataatttgtactactagtaagaaactgcagtagccgctgctaatggatcaccaatctataccgcgc

SEQ ID NO: 4757 - protein, 364 aa, Zea mays
  misc_feature (1)..(364): useful for making plants with increased cold tolerance as described in USSN 12/863,773
  misc_feature (1)..(364): Ceres CLONE ID no.1674443
  misc_feature (1)..(364): Bit score of 815.7 for HMM based on sequences of FIGURE 2 of USSN 12/863,773.
  misc_feature (284)..(328): Pfam Name: CCT Pfam Description: CCT motif
  misc_feature (51)..(98): Pfam Name: zf-B_box Pfam Description: B-box zinc finger
  misc_feature (1)..(364): Functional Homolog Of Ceres SEEDLINE ID no. ME04315
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGTGEAAASEADEQHAAAEHAHAHALNLNVEAKDMKLDYLFSELDPYLSVEIPRFQHADSVVPNGAGAAVELDFTCGIGVKHSSYSSYTATSLAHSGSSSEVGVVPEAFGGSGSGGGSFELDFTRPKPQAYMPYTGTPQSHSVPSADVEVVPERGDLAAVRPVPLMGESREARLMRYREKRKNRRFEKTIRYASRKAYAETRPRIKGRFAKRADHDGDADADDAEAEAEAEAAVPMSYVLDFGYGVVPSF

SEQ ID NO: 4758 - DNA, 1449 bp, Panicum virgatum
  misc_feature (1)..(1449): useful for making plants with increased cold tolerance as described in USSN 12/863,773
  misc_feature (1)..(1449): Ceres CLONE ID no.1828897
gcgcgcgctccctcccctcccctcctcccaccagcccaccaccaccacaagcaccgcgtcgtccacaccacctgccattgccgcgccgagctcagcctctagctgcgccaggagggcgcccgcctccctccctgccgacgccggtgtgatggagctgcacaagtactggggcgtggggggccgccggtgcggcggctgcgaggcggccccggcggcggtgcactgccgctcgtgccccgccgggggcgcgttcctctgcacggcgtgcgacgcgcgcccggggcacgcgcatctgggccacgagcgcgtgtggatgtgcgaggtctgcgagctggcgcccgccgccgtcacgtgcaaggccgacgccgccgtgctctgcgccgcctgcgacgccgacatccacgacgccaacccgctggcgcgccgccacgcacgcgtccccgtcgcgcccatcggctcggaggccgcggccgccgccgtggaggccatgctgttcgggaccggcgagccggccgcgtccgaggccgaggagccgcagaacgcggcggccgggcacaaccaccagcacgcgctgaacctcaacgtggaggccaaggacatgaagctggactacctcttttccgacctggacccctacctcagcgtcgatatcccgcgcttccagcacgccgacagcgtcgtccccagcggcgtcggcgccggagcagccggcgccgtcgagctggacttcacgtgcggcatcggcgtcgagccctccgggggggggggggggggggggacatccctcgcccacagcggctcctcttctgaggtcggcgtggtgccagaggccttctgcggcgggggggggagcttcgagctcgacttcacaaggcccaagcctcaagcctacatgccgtacaccgcgactcctcagagtcacagcgtgtcgtcggtggacgtggaggtggtgccggagcggggggacatgatggcggcggcgaggccggtgccgctggtgggggagagccgggaggcgcggctgatgcgctaccgggagaagcggaagaaccggcggttcgagaagaccatccggtacgcgtcccggaaggcctacgccgagatgcggccgcggatcaagggccggttcgccaagcgcgccgaccacgacgccgacgccgacgacgccgaggccgaggccgaggccgccgtgccgtcgccggcgtcgtacgtgctcgacttcggctacggcgtcgtgcccagcttctgatcgacgacgatcgtctcgctcgttccacgcgcggcgcgcttgacccggcaccggcgcgcgcgccttgtacttgtatcgatgcatgtataggggaggaatagtaatcccatgtactctcgtcttggagctgcgctagccctgcgtacgtacgctagtgatgtataatttgtacaacccagtattttgccctgtacccgctc

SEQ ID NO: 4759 - protein, 366 aa, Panicum virgatum
  misc_feature (1)..(366): useful for making plants with increased cold tolerance as described in USSN 12/863,773
  misc_feature (1)..(366): Ceres CLONE ID no.1828897
  misc_feature (1)..(366): Bit score of 667.9 for HMM based on sequences of FIGURE 2 of USSN 12/863,773.
  misc_feature (288)..(332): Pfam Name: CCT Pfam Description: CCT motif
  misc_feature (52)..(99): Pfam Name: zf-B_box Pfam Description: B-box zinc finger
  misc_feature (1)..(366): Functional Homolog Of Ceres SEEDLINE ID no. ME04315
MELHKYWGVGGRRCGGCEAAPAAVHCRSCPAGGAFLCTACDARPGHAHLGHERVWMCEVCELAPAAVTCKADAAVLCAACDADIHDANPLARRHARVPVAPIGSEAAAAAVEAMLFGTGEPAASEAEEPQNAAAGHNHQHALNLNVEAKDMKLDYLFSDLDPYLSVDIPRFQHADSVVPSGVGAGAAGAVELDFTCGIGVEPSGGGGGGGTSLAHSGSSSEVGVVPEAFCGGGGSFELDFTRPKPQAYMPYTATPQSHSVSSVDVEVVPERGDMMAAARPVPLVGESREARLMRYREKRKNRRFEKTIRYASRKAYAEMRPRIKGRFAKRADHDADADDAEAEAEAAVPSPASYVLDFGYGVVPSF

SEQ ID NO: 4760 - protein, 332 aa, Oryza sativa subsp. indica
  misc_feature (1)..(332): useful for making plants with increased cold tolerance as described in USSN 12/863,773
  misc_feature (1)..(332): Public GI ID no.125540249
  misc_feature (1)..(332): Bit score of 624.0 for HMM based on sequences of FIGURE 2 of USSN 12/863,773.
  misc_feature (261)..(305): Pfam Name: CCT Pfam Description: CCT motif
  misc_feature (72)..(114): Pfam Name: zf-B_box Pfam Description: B-box zinc finger
  misc_feature (1)..(332): Functional Homolog Of Ceres SEEDLINE ID no. ME04315
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFTFSQAAADAAGAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGAAAPPMVVVVASKGKEREARLMRYREKRKNRRFDKTIRYASRKAYAETRPRIKGRFAKRTADADDDDEAPCSPAFSALAASDGVVPSF

SEQ ID NO: 4761 - protein, 331 aa, Oryza sativa subsp. indica
  misc_feature (1)..(331): useful for making plants with increased cold tolerance as described in USSN 12/863,773
  misc_feature (1)..(331): Public GI ID no.116310719
  misc_feature (1)..(331): Bit score of 733.5 for HMM based on sequences of FIGURE 2 of USSN 12/863,773.
  misc_feature (239)..(283): Pfam Name: CCT Pfam Description: CCT motif
  misc_feature (62)..(104): Pfam Name: zf-B_box Pfam Description: B-box zinc finger
  misc_feature (1)..(331): Functional Homolog Of Ceres SEEDLINE ID no. ME04315
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADSDPYLDLDFARSMDDIKAIGVQNGPPELDITGGKLFYSDHSMNHSVSSSEAAVVPDAAAGGGAPMPVVSRGREREARLMRYREKRKSRRFEKTIRYASRKAYAETRPRIKGRFAKRTKGGAGADADADADGEDEEMYSSAAAAVAALMAPGGSDADYGVDGVVPTF

SEQ ID NO: 4762 - protein, 370 aa, Oryza sativa subsp. indica
  misc_feature (1)..(370): useful for making plants with increased cold tolerance as described in USSN 12/863,773
  misc_feature (1)..(370): Public GI ID no.125556324
  misc_feature (1)..(370): Bit score of 608.3 for HMM based on sequences of FIGURE 2 of USSN 12/863,773.
  misc_feature (294)..(338): Pfam Name: CCT Pfam Description: CCT motif
  misc_feature (50)..(97): Pfam Name: zf-B_box Pfam Description: B-box zinc finger
  misc_feature (1)..(370): Functional Homolog Of Ceres SEEDLINE ID no. ME04315
MELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVAAEAMLFGVAAAGAEAEAVEEKAAAEHHHHQQRQQHGALNLNVEAKDMKLDYLFSDLDPYLNVEFARFPHADSVVPNGAGAGAAIELDFTCGLGVGVGGAKQSYSSYTATDLAHSGSSSEVGVVPEAMCGGGGAIDLDFTRPKPQPYMPYTATPPPSHSVVSAQMSSSVVDVGVVPERAAAMGEGREARLMRYREKRKNRRFEKTIRYASRKAYAETRPRIKGRFAKRADHDADDADADADDPAAVPSSYMLDFGYGVVPSF

SEQ ID NO: 4763 - protein, 347 aa, Oryza sativa subsp. indica
  misc_feature (1)..(347): useful for making plants with increased cold tolerance as described in USSN 12/863,773
  misc_feature (1)..(347): Public GI ID no.125538317
  misc_feature (1)..(347): Bit score of 444.3 for HMM based on sequences of FIGURE 2 of USSN 12/863,773.
  misc_feature (279)..(323): Pfam Name: CCT Pfam Description: CCT motif
  misc_feature (55)..(102): Pfam Name: zf-B_box Pfam Description: B-box zinc finger
  misc_feature (1)..(347): Functional Homolog Of Ceres SEEDLINE ID no. ME04315
MELGLGRYWGVGGRRCGACAVAPAAVHCRTCDGGGGGGGYLCAGCDAEHGRAGHERVWVCEVCELAPAAVTCKADAAALCAACDSDIHDANPLARRHERVPGHPIGSSAAPPPDALLLGGENDAAAAVDGGGGGKEVKLDFLFADFMDPYLGGSPELARFPHADSVVPNHNGSAGPAMELGFAGGGGAAVKPSYSSYTAASLGNSGSSSEVGLVPDAICGGGGGGIIELDFAQSKAAYLPYASTPSHSMSSSMDMGVAAPEMSDGAAAAAGRAYAAEGRAARLMRYREKRKNRRFEKTIRYASRKAYAETRPRVKGRFAKRADDHDAAAPPPQIMLDFAGYGVVPTF

SEQ ID NO: 4764 - protein, 332 aa, Oryza sativa subsp. japonica
  misc_feature (1)..(332): useful for making plants with increased cold tolerance as described in USSN 12/863,773
  misc_feature (1)..(332): Public GI ID no.115447239
  misc_feature (1)..(332): Bit score of 623.8 for HMM based on sequences of FIGURE 2 of USSN 12/863,773.
  misc_feature (261)..(305): Pfam Name: CCT Pfam Description: CCT motif
  misc_feature (72)..(114): Pfam Name: zf-B_box Pfam Description: B-box zinc finger
  misc_feature (1)..(332): Functional Homolog Of Ceres SEEDLINE ID no. ME04315
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFPFSQAAADAAAAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGSAAPPMVVVVASKGKEREARLMRYREKRKNRRFDKTIRYASRKAYAETRPRIKGRFAKRTADADDDDEAPCSPAFSALAASDGVVPSF

SEQ ID NO: 4765 - protein, 333 aa, Oryza sativa subsp. japonica
  misc_feature (1)..(333): useful for making plants with increased cold tolerance as described in USSN 12/863,773
  misc_feature (1)..(333): Public GI ID no.115459216
  misc_feature (1)..(333): Bit score of 726.7 for HMM based on sequences of FIGURE 2 of USSN 12/863,773.
  misc_feature (239)..(283): Pfam Name: CCT Pfam Description: CCT motif
  misc_feature (62)..(104): Pfam Name: zf-B_box Pfam Description: B-box zinc finger
  misc_feature (1)..(333): Functional Homolog Of Ceres SEEDLINE ID no. ME04315
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADSDPYLDLDFARSMDDIKAIGVQNGPPELDITGGKLFYSDHSMNHSVSSSEAAVVPDAAAGGGAPMPVVSRGREREARLMRYREKRKSRRFEKTIRYASRKAYAETRPRIKGRFAKRTKGGAGADADADADADGEDEEMYSSAAAAVAALMAPGGSDADYGVDGVVPTF

SEQ ID NO: 4766 - protein, 370 aa, Oryza sativa subsp. japonica
  misc_feature (1)..(370): useful for making plants with increased cold tolerance as described in USSN 12/863,773
  misc_feature (1)..(370): Public GI ID no.115469296
  misc_feature (1)..(370): Bit score of 607.4 for HMM based on sequences of FIGURE 2 of USSN 12/863,773.
  misc_feature (294)..(338): Pfam Name: CCT Pfam Description: CCT motif
  misc_feature (50)..(97): Pfam Name: zf-B_box Pfam Description: B-box zinc finger
  misc_feature (1)..(370): Functional Homolog Of Ceres SEEDLINE ID no. ME04315
MELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVAAEAMLFGVAAAGAEAEAVEDKAAAEHHHHQQRQQHGALNLNVEAKDMKLDYLFSDLDPYLNVEFARFPHADSVVPNGAGAGAAIELDFTCGLGVGVGGAKQSYSSYTATDLAHSGSSSEVGVVPEAMCGGGGAIDLDFTRPKPQPYMPYTATPPPSHSVVSAQMSSSVVDVGVVPERAAAMGEGREARLMRYREKRKNRRFEKTIRYASRKAYAETRPRIKGRFAKRADHDADDADADADDPAAVPSSYMLDFGYGVVPSF

SEQ ID NO: 4767 - protein, 332 aa, Oryza sativa subsp. japonica
  misc_feature (1)..(332): useful for making plants with increased cold tolerance as described in USSN 12/863,773
  misc_feature (1)..(332): Public GI ID no.125582846
  misc_feature (1)..(332): Bit score of 505.9 for HMM based on sequences of FIGURE 2 of USSN 12/863,773.
  misc_feature (261)..(305): Pfam Name: CCT Pfam Description: CCT motif
  misc_feature (27)..(71): Pfam Name: zf-B_box Pfam Description: B-box zinc finger
  misc_feature (1)..(332): Functional Homolog Of Ceres SEEDLINE ID no. ME04315
MEAVEDKAMVGVGGAVAAGYSSSSWGLGTRACDSCGGEAARLYCRADGAFLCARCDARAHGAGSRHARVWLCEVCEHAPARRHVPGGRRGAVRRLRRRHHSANPLARRHERLPVAPFFGPLADAPQPFPFSQAAADAAAAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGSAAPPMVVVVASKGKEREARLMRYREKRKNRRFDKTIRYASRKAYAETRPRIKGRFAKRTADADDDDEAPCSPAFSALAASDGVVPSF

SEQ ID NO: 4768 - protein, 375 aa, Medicago truncatula
  misc_feature (1)..(375): useful for making plants with increased cold tolerance as described in USSN 12/863,773
  misc_feature (1)..(375): Public GI ID no.92875402
  misc_feature (1)..(375): Bit score of 812.8 for HMM based on sequences of FIGURE 2 of USSN 12/863,773.
  misc_feature (298)..(342): Pfam Name: CCT Pfam Description: CCT motif
  misc_feature (60)..(107): Pfam Name: zf-B_box Pfam Description: B-box zinc finger
  misc_feature (1)..(375): Functional Homolog Of Ceres SEEDLINE ID no. ME04315
MGIERGGLKSLRGGWSVPPKLCDSCKLTPAALFCRSDSAFLCINCDSTIHSANKLSSRHERVWMCEVCEQAPASVTCKADAAALCVTCDSDIHSANPLARRHERVPVEPFFDSAESVVKSSSAAAAAAASFNFVVPTDDGYGQDDAEAAAWLIPNPNFGSKLNETQDIKTREMFFSDMDPFLDFDYSNNFQNNNCSNAMNDSVVPVQTKPTPAPMMNHNSEGCFDIDFCRSKLSSFNYPSHSISHSVSSSSLDVGVVPDGNTVSEISYNFGSESMVSGGVNSSNQGVQGATQLCGMDREARVMRYREKRKNRKFEKTIRYASRKAYAETRPRIKGRFAKRTEIDSDVDRLYNPADPLSVPSSMLMDCPYGVVPTF

SEQ ID NO: 4769 - protein, 307 aa, Raphanus sativus
  misc_feature (1)..(307): useful for making plants with increased cold tolerance as described in USSN 12/863,773
  misc_feature (1)..(307): Public GI ID no.3341723
  misc_feature (1)..(307): Bit score of 395.2 for HMM based on sequences of FIGURE 2 of USSN 12/863,773.
  misc_feature (1)..(48): Pfam Name: zf-B_box Pfam Description: B-box zinc finger
  misc_feature (241)..(285): Pfam Name: CCT Pfam Description: CCT motif
  misc_feature (1)..(307): Functional Homolog Of Ceres SEEDLINE ID no. ME04315
MASRLCDSCRSAAATLYCRADAAFLCGECDGKIHTANKLASRHERVLLCQICEQAPAHVTCEADAAALCVTCDRDIHSANPLSRRHERVSVTPFYDAPAQGGSPATTKSAASSNLFGEDADVSMEAVSWLLPNPSVKEGVVVEIPNLFADLDYSAVDPKMEASENSSGNDGVVPVQTKALFLNEDYFNFDVSASKTTFPHGYSCINQTVSSTSLEVPLVPEGGAVTTTNATPAVQLSPAEREARVLRYREKRKNRKFEKTIRYASRKAYAEVRPRIKGRFAKRTDSRVNDGGGDVGVYGGFGVVPSF

SEQ ID NO: 4770 - protein, 329 aa, Malus x domestica
  misc_feature (1)..(329): useful for making plants with increased cold tolerance as described in USSN 12/863,773
  misc_feature (1)..(329): Public GI ID no.4091806
  misc_feature (1)..(329): Bit score of 506.4 for HMM based on sequences of FIGURE 2 of USSN 12/863,773.
  misc_feature (1)..(48): Pfam Name: zf-B_box Pfam Description: B-box zinc finger
  misc_feature (268)..(312): Pfam Name: CCT Pfam Description: CCT motif
  misc_feature (1)..(329): Functional Homolog Of Ceres SEEDLINE ID no. ME04315
MASKLCDSCQSATATLFCRADSAFLCVNCDSKIHAANKLASRHPRVWLCEVCEQAPAHVTCKADDAALCVTCDRDIHSANPLSSRHDRVPVTPFYDSVNSAANSVPVVKSVVNFLDDRYLSDVDGETEVSREEAEAASWLLPNPKAMENPDLNSGQYLFQEMDPYLDLDYGHVDPKLEEAQEQNSCGADGVVPVQSKNMQPLLVNDQSFELDFSAGSKPFVYGYHHARCLSQSVSSSSMDISVVPDGNAVTAAVETSQPAVQLSSVDRVARVLRYREKRKNRKFEKTIRYASRKAYAETRPRIKGRFAKRTEVEIEAERMCRYGVVPSF

SEQ ID NO: 4771 - protein, 312 aa, Pisum sativum
  misc_feature (1)..(312): useful for making plants with increased cold tolerance as described in USSN 12/863,773
  misc_feature (1)..(312): Public GI ID no.60459257
  misc_feature (1)..(312): Bit score of 400.3 for HMM based on sequences of FIGURE 2 of USSN 12/863,773.
  misc_feature (1)..(48): Pfam Name: zf-B_box Pfam Description: B-box zinc finger
  misc_feature (245)..(289): Pfam Name: CCT Pfam Description: CCT motif
  misc_feature (1)..(312): Functional Homolog Of Ceres SEEDLINE ID no. ME04315
MATKLCDSCKSTKATLFCRSDSAFLCITCDSNIQAANKLASRHHRVTLCEVCEQAPAHVTCKADAAALCVSCDHDIHSANPPASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSSSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 4772 - DNA, 1283 bp, Panicum virgatum
  misc_feature (1)..(1283): useful for making plants with increased cold tolerance as described in USSN 12/863,773
  misc_feature (1)..(1283): Ceres CLONE ID no.1756710
agcagccactacaagctgccgtgccgagtgagctagtgagcgagcgagctcccggcgcgcgatggagggtgacaagaagtcggcgggcggggccccggcctactggggcctgggcgcgcggccctgcgacgagtgcggcgccgaggcggcgcggctctactgccgcgcggacgcggcgttcctctgcgccgggtgcgacgcgcgcgcgcacggcgccgggtcgcgccacgcccgcgtctggctgtgcgaggtctgcgagcacgcgccggccgccgtcacgtgccgcgcggacgccgccgcgctctgcgcctcctgcgacgccgacatccactccgccaacccgctcgcgcgccgccacgagcgccagaccgtggcgcccttctacggcgcgctcgccgacgcgcccaagcccttcgcctcgtcggtggccgtgcccaaagcggccgacgacgacggaagcaacgaggccgaggcggcgtcgtggctcctccccgagcccgaccacgggcacaaggaaggcgccacgacggaggtgttcttcgcggactccgacccgtacctcgacctcgacttcgcgcgcaccatggacgacatcaaggccatcggcgcccagaacggccccgccggcgccgagctcgacctcaccggcgccaagctcttctactccgaccactccatgaactacagcgtgtcgtcgtcggaggcagcggtggtgcccgacgcggcggcgggcgcggcgcccgtcgtgcctgtggtgagcaggggcctggagcgggaggcccggctgatgcggtaccgggagaagcgcaagagccggcggttcgagaagacgatccggtacgcgtcccgcaaggcgtacgcggagacgcggccgcgcatcaagggccggttcgccaagcgcaccccggggcccggcgcggacggggaggacccgctggaggagcacgaggaggagatgtactcctccgccgcggccgccgtggccgcgctcatggcccccggcggcgccgacgccgactacggcgtcgtgcccacgtattgatcggcgccggcctgctgtacactagctagcctcgacctctcggggctgtaatttttgctgcatgccttgcatgcaaaaagctgccgtgtagcattgattacctgtaatatgattccacggaagccatgaggctggacttccaagctcttcttcctccctaatgattccgtcatgtacggatgtatattattattatttatcacgaactgctgctaatctgcaactgtaatttctaattagc

SEQ ID NO: 4773 - protein, 326 aa, Panicum virgatum
  misc_feature (1)..(326): useful for making plants with increased cold tolerance as described in USSN 12/863,773
  misc_feature (1)..(326): Ceres CLONE ID no.1756710
  misc_feature (1)..(326): Bit score of 628.3 for HMM based on sequences of FIGURE 2 of USSN 12/863,773.
  misc_feature (238)..(282): Pfam Name: CCT Pfam Description: CCT motif
  misc_feature (62)..(104): Pfam Name: zf-B_box Pfam Description: B-box zinc finger
  misc_feature (1)..(326): Functional Homolog Of Ceres SEEDLINE ID no. ME04315
MEGDKKSAGGAPAYWGLGARPCDECGAEAARLYCRADAAFLCAGCDARAHGAGSRHARVWLCEVCEHAPAAVTCRADAAALCASCDADIHSANPLARRHERQTVAPFYGALADAPKPFASSVAVPKAADDDGSNEAEAASWLLPEPDHGHKEGATTEVFFADSDPYLDLDFARTMDDIKAIGAQNGPAGAELDLTGAKLFYSDHSMNYSVSSSEAAVVPDAAAGAAPVVPVVSRGLEREARLMRYREKRKSRRFEKTIRYASRKAYAETRPRIKGRFAKRTPGPGADGEDPLEEHEEEMYSSAAAAVAALMAPGGADADYGVVPTY

SEQ ID NO: 4774 - DNA, 1398 bp, Triticum aestivum
  misc_feature (1)..(1398): useful for making plants with increased cold tolerance as described in USSN 12/863,773
  misc_feature (1)..(1398): Ceres CLONE ID no.907473
gtttttaactcgacttagccaagtttggcaaacgaacaggccccgtggccccgcccccgcgcgacagcgaccgggcgcccgaagtgtctcgcgctcgcccacggcacccgagcggagcccccgcccctaccatgtgctctccctgcccgcagacccctcaaaacccacccgcgcccgcacccaggcaccgagcacccagcagaaagaaacgcaccaaatctttatcccctgccctcagcagtgccgacctgagcgccggagatctgcggcgagcgagatgaaagtggaggagcagacggtggtgggaggaggaggaggggggctctgggggctggccgggcggccgtgcgacacgtgcgccgtggacgcggcgcggctctactgccggtcggacggcgcctacctctgcgccgggtgcgacgcgcgcgctcacggggccggctcccgccacgcgcgcgtctggctctgcgaggtctgcgagcacgcgcccgccgcggtcacctgccgcgccgacgccgccgcgctctgcgccacgtgcgacgccgacatccactccgccaacccgctcgccagccggcacgagcgcctccccgtcacgcctttcttcggcgcgctcgccgacccgccccagcccgccccctccccgtcctccgccgccgcgacgcaggaggacgcggacgacgacgggagcaacgaggccgaggcggcctcctggcttcttcccgagcctggcgatagccccgaggacagcaccgctaccttcttccctgactcggacgcgtacctcgatctggacttcgtccggtctatggacgggatcaaggccatcggggtgcccgtcgccccttccgagctcgacgtcgccggcggcgctctcttctaccccgaacactccatgaaccacagcatgtcaacgtccgaggtcgcggtggtgccggacgcgctgtcagccggcggggccccggcgccggcgccgtcggtggcggtggtggctagcaaggggaaggagcgggaggcccggctgatgcggtaccgggagaagcgcaagaaccggaggttccagaagaccatccgctacgcgtcccgcaaggcgtacgccgagacgcggccgcgcatcaagggccggttcgccaagcgcaccgccgaggacgacgcgctggagcgggacgggccgttctcgcccgcgtcgtcggcgcacctggcgtcggacggtgactacggcgtcgtgccgtccttctgaggagaccggcgacggcgacggcgactctgctgtagttttggcgcgcgcatccatccgagtgcgctcgcgtgcggtggctgcgacgcgcgctccgtgtaacattgaataatctgtacagttttgttccatgggattagtgccgtgaccgtgccgacctg

SEQ ID NO: 4775 - protein, 320 aa, Triticum aestivum
  misc_feature (1)..(320): useful for making plants with increased cold tolerance as described in USSN 12/863,773
  misc_feature (1)..(320): Ceres CLONE ID no.907473
  misc_feature (1)..(320): Bit score of 719.5 for HMM based on sequences of FIGURE 2 of USSN 12/863,773.
  misc_feature (245)..(289): Pfam Name: CCT Pfam Description: CCT motif
  misc_feature (64)..(106): Pfam Name: zf-B_box Pfam Description: B-box zinc finger
  misc_feature (1)..(320): Functional Homolog Of Ceres SEEDLINE ID no. ME04315
MKVEEQTVVGGGGGGLWGLAGRPCDTCAVDAARLYCRSDGAYLCAGCDARAHGAGSRHARVWLCEVCEHAPAAVTCRADAAALCATCDADIHSANPLASRHERLPVTPFFGALADPPQPAPSPSSAAATQEDADDDGSNEAEAASWLLPEPGDSPEDSTATFFPDSDAYLDLDFVRSMDGIKAIGVPVAPSELDVAGGALFYPEHSMNHSMSTSEVAVVPDALSAGGAPAPAPSVAVVASKGKEREARLMRYREKRKNRRFQKTIRYASRKAYAETRPRIKGRFAKRTAEDDALERDGPFSPASSAHLASDGDYGVVPSF

SEQ ID NO: 4776 - protein, 340 aa, Malus x domestica
  misc_feature (1)..(340): useful for making plants with increased cold tolerance as described in USSN 12/863,773
  misc_feature (1)..(340): Public GI ID no.4091804
  misc_feature (1)..(340): Bit score of 486.8 for HMM based on sequences of FIGURE 2 of USSN 12/863,773.
  misc_feature (1)..(48): Pfam Name: zf-B_box Pfam Description: B-box zinc finger
  misc_feature (279)..(323): Pfam Name: CCT Pfam Description: CCT motif
  misc_feature (1)..(340): Functional Homolog Of Ceres SEEDLINE ID no. ME04315
MALKLCDSCKSATGTLFCRADSAFLCVNCDSKIHAANKLASRHARVWLCEVCEQAPAHVTCKADDAALCVTCDRDIHSANPLSHADERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 4777 - protein, 323 aa, Hordeum vulgare subsp. vulgare
  misc_feature (1)..(323): useful for making plants with increased cold tolerance as described in USSN 12/863,773
  misc_feature (1)..(323): Public GI ID no.21667487
  misc_feature (1)..(323): Bit score of 599.5 for HMM based on sequences of FIGURE 2 of USSN 12/863,773.
  misc_feature (236)..(280): Pfam Name: CCT Pfam Description: CCT motif
  misc_feature (61)..(103): Pfam Name: zf-B_box Pfam Description: B-box zinc finger
  misc_feature (1)..(323): Functional Homolog Of Ceres SEEDLINE ID no. ME04315
MEGEEKPVVGGAYWGVGARACDSCATEAARLFCRADAAFLCAGCDARAHGSGSRHARVWLCEVCEHAPAAVTCKADAAVLCASCDADIHAANPLARRHERVPVAPFFGAAADAHKPFPSSGAQAGAAASAEDDGSNDAEAASWLLPEPDHKDGANGATADVFFADSDHYLDLDFARSMDDIKAISVQLNGQPEIDLNGGNKGFYSDHSMNHSLSSSEAAVVPDAAAAPVVSRGREREARLMRYREKRKSRRFEKTIRYASRKAYAETRPRVKGRFAKRTGTADADALEEHEEMYSSAAAAVAALMAPGPDHDYGVDGVVPTLV

SEQ ID NO: 4778 - protein, 325 aa, Hordeum vulgare subsp. vulgare
  misc_feature (1)..(325): useful for making plants with increased cold tolerance as described in USSN 12/863,773
  misc_feature (1)..(325): Public GI ID no.21655154
  misc_feature (1)..(325): Bit score of 678.1 for HMM based on sequences of FIGURE 2 of USSN 12/863,773.
  misc_feature (250)..(294): Pfam Name: CCT Pfam Description: CCT motif
  misc_feature (70)..(112): Pfam Name: zf-B_box Pfam Description: B-box zinc finger
  misc_feature (1)..(325): Functional Homolog Of Ceres SEEDLINE ID no. ME04315
MKVEEQTVVGGGGGAGQGGAGFWGLAGRPCDTCAVDAARLYCRLDGAYLCAGCDARAHGAGSRHARVWLCEVCEHAPAAVTCRADAAALCATCDADIHSANPLASRHLLLPTPFFGALADPPQPVPSPSSAAATQEDAEDDGSNEAEAASWLLPEPGDSPEDSAATFFADSDAYLDLDFVRSMDGIKAIGVPVAPSELDLAGGTLFYPEHSMNHSMSTSEVAVVPDALSAGGAPAPAPSVAVVASKGKEREARLMRYREKRKNRRFQKTIRYASRKAYAETRPRIKGRFAKRTAEDDALEQDGPFSPASSAHLASDGDYGVVPSF

SEQ ID NO: 4779 - protein, 391 aa, Solanum lycopersicum
  misc_feature (1)..(391): useful for making plants with increased cold tolerance as described in USSN 12/863,773
  misc_feature (1)..(391): Public GI ID no.45544883
  misc_feature (1)..(391): Bit score of 432.4 for HMM based on sequences of FIGURE 2 of USSN 12/863,773.
  misc_feature (322)..(366): Pfam Name: CCT Pfam Description: CCT motif
  misc_feature (52)..(99): Pfam Name: zf-B_box Pfam Description: B-box zinc finger
  misc_feature (1)..(391): Functional Homolog Of Ceres SEEDLINE ID no. ME04315
MLKKENSNNWARVCDSCHSATCTVYCRADSAYLCAGCDARIHTASLMASRHERVWVCEACERAPAAFLCKADAASLCASCDADIHSANPLARRHHRVPIMPIPGTIYGPPAVHTITGGSMMIGGTTGEGTEDDGFLSLNQDADDTTIDEEDEDEAASWLLLNPPVKNNNKNNNYGMLFGGEVVDDYLDLAEYGGDSQFNDQYSVNQQQQHYSVPQKSYVEDSVVPVQNGQRKSLILYQTPQQQQSHHLNFQLGMEYDNSNTGYGYPASLSHSVSISSMDVSVVPESAQSETSNSHPRPPKGTIDLFSGPPIQIPPQLTPMDREARVLRYREKKKNRKFEKTIRYASRKAYAETRPRIKGRFAKRTDVEAEVDQMFSTQLMTDSNYGIVPSF

SEQ ID NO: 4780 - protein, 376 aa, Hordeum vulgare subsp. vulgare
  misc_feature (1)..(376): useful for making plants with increased cold tolerance as described in USSN 12/863,773
  misc_feature (1)..(376): Public GI ID no.21655166
  misc_feature (1)..(376): Bit score of 528.8 for HMM based on sequences of FIGURE 2 of USSN 12/863,773.
  misc_feature (297)..(341): Pfam Name: CCT Pfam Description: CCT motif
  misc_feature (51)..(98): Pfam Name: zf-B_box Pfam Description: B-box zinc finger
  misc_feature (1)..(376): Functional Homolog Of Ceres SEEDLINE ID no. ME04315
MMELRKYWGVGGRRCGGCEGAAPAAVHCRDCAGYLCTGCDARPAHARAGHERVWVCEVCEVSPAAVTCKADAAVLCAACDADIHHANPLAERHVRVPIAPIGSPEAAAVAAEAMMLCGAGDGDARADPDEVHDQLHHHGHGGMLNLNVEAGKEGGKMDYLFSDLVDPYLAVDFTRFAHADSVVPNGVATAAVPAVVDLDFACGIGAKPPPSYSSSYTANGSGAHSGSSSEVGVVPEAIHGGAGSFELDFTRPKPQAYMPAYTPAPPSHGVGMQQASAVDMGYLTVPERPVAVTGEGRVARLMRYREKRKNRRFEKTIRYASRKAYAESRPRVKGRFAKRADQDADGDGDDLDAEAHAVPSSTSYLLDFGYGVVPSF

SEQ ID NO: 4781 - protein, 417 aa, Ipomoea nil
  misc_feature (1)..(417): useful for making plants with increased cold tolerance as described in USSN 12/863,773
  misc_feature (1)..(417): Public GI ID no.10946337
  misc_feature (1)..(417): Bit score of 351.2 for HMM based on sequences of FIGURE 2 of USSN 12/863,773.
  misc_feature (348)..(392): Pfam Name: CCT Pfam Description: CCT motif
  misc_feature (77)..(119): Pfam Name: zf-B_box Pfam Description: B-box zinc finger
  misc_feature (1)..(417): Functional Homolog Of Ceres SEEDLINE ID no. ME04315
MLKEESCEVLDLDVTIGSSSGSRSGNKQNWARVCDICRSAACSVYCRADLAYLCGGCDARVHGANTVAGRHERVLVCEACESAPATVICKADAASLCAACDSDIHSANPLARRHHRVPILPISGTLYGPPTSNPCRESSMMVGLTGDAAEEDNGFLTQDAEETTMDEDEDEAASWLLLNPNPNPNPNPVKSNNSTNMCKGGNNNNNEMSCAVEAVDAYLDLAEFSSCHNNLFEDKYSINQQQNYSVPQRNMSYRGDSIVPNHGKNQFHYTQGLQQHNHHAIFNCKEWNMRILTRDMVSISSMDVGVVPESTLSDTSISHSRASKGTIDLFSGPPIQMPPQLQLSQMDREARVLRYREKKKTRKFEKTIRYASRKAYAETRPRIKGRFAKRTDVDTEVDQIFYAPLMAESGYGIVPSF

SEQ ID NO: 4782 - protein, 381 aa, Cleome spinosa
  misc_feature (1)..(381): useful for making plants with increased cold tolerance as described in USSN 12/863,773
  misc_feature (1)..(381): Public GI ID no.90657642
  misc_feature (1)..(381): Bit score of 456.0 for HMM based on sequences of FIGURE 2 of USSN 12/863,773.
  misc_feature (312)..(356): Pfam Name: CCT Pfam Description: CCT motif
  misc_feature (59)..(106): Pfam Name: zf-B_box Pfam Description: B-box zinc finger
  misc_feature (1)..(381): Functional Homolog Of Ceres SEEDLINE ID no. ME04315
MLKEERTSGGETGENNWARICDTCRSAACTVYCRADSAYLCTSCDARVHAANHVASRHERVWVCESCERAPAAFLCKADAASLCAACDAEIHSANPLARRHHRVPILPISGSMSGPMANHHPSETAMTDTENDMVVGREEAEDEDEDDEEAASWLLLNPGKNSGNNNNQNNGFFFDGEADEYLDLVEYNSSMENQFSDQYSQYHQDCGVPQKSFGGDGVVPLQVEESRGQLHHEQQSFQLAITYGSPGALYGSYNGSMNHSVSMSSMDIVVVPESTASDMAVVSQLRAPKGTTDLLIGPPIQMMPQLSPMDREARVLRYREKKKTRKFEKTIRYASRKAYAETRPRIKGRFAKRTDIEAEVDQAFSTTLMQESGYGIVPSF

SEQ ID NO: 4783 - DNA, 155 bp, Hordeum vulgare subsp. vulgare
  misc_feature (1)..(155): useful for making plants with increased cold tolerance as described in USSN 12/863,773
  misc_feature (1)..(155): 000HORDEUM
  misc_feature (1)..(155): Homolog Of Ceres SEEDLINE ID no. ME00572
tcctcgtgtcagaattaacgttcttgaccttgtaaggccttttcttgaccttgtaaggccctcccctaacgtttctcctggtgtctccaacctcacactttctttcccctttctatccctcctgagctattccctattttgtacgtctacaatct

SEQ ID NO: 4784 - DNA, 161 bp, Picea sp.
  misc_feature (1)..(161): useful for making plants with increased cold tolerance as described in USSN 12/863,773
  misc_feature (1)..(161): 000PICEA
  misc_feature (1)..(161): Homolog Of Ceres SEEDLINE ID no. ME00572
atcaccccaaactgagcctttcttgaccttgtaagaccttttcttgaccttgtaagaccagccatagaatcccgagaacaaggtcgctcaactctcaaacaatcttcttctaattagtctatccctcctgagctatttacagttgagtttcaagttcttcc

SEQ ID NO: 4785 - protein, 409 aa, Solanum lycopersicum
  misc_feature (1)..(409): useful for making plants with increased cold tolerance as described in USSN 12/863,773
  misc_feature (1)..(409): Public GI ID no.45544887
  misc_feature (1)..(409): Bit score of 383.3 for HMM based on sequences of FIGURE 2 of USSN 12/863,773.
  misc_feature (340)..(384): Pfam Name: CCT Pfam Description: CCT motif
  misc_feature (59)..(106): Pfam Name: zf-B_box Pfam Description: B-box zinc finger
  misc_feature (1)..(409): Functional Homolog Of Ceres SEEDLINE ID no. ME04315
MLKKENSGGLDGSSNYWARVCDSCRSVTCTIYCQADSAYLCADCDARIHAASLVTSRHKRVWVCEACERAPAAFLCKADAASLCASCDADIHSANPLAHRHHRIPIITIPGTLYGPPAVETVGGDSMMISGSTGEGTEDDGFLSLTQDADDTIIDEEDEDEDEAASWLLLNHPVKNNNKNNVNNNNNQTNNYDMLFGGEVVDDYLDLAEYGGDSQFNDQYNVNQQQQQYFVPQMSYGGDSVVPVQDGQGKPLIFYQQQQQQQQSHHQNFQLGMEYDNSNTRLGLPASMSHSVSVVSMDVSVVPESALCETSNSQPRPQKGTIELFSGHPIQIPLLTPMDREARVLRYREKKKNRKFEKTIRYASRKAYAETRPRIKGRFAKRTDVEAEVDQMFSTQLMTDSSYRIVPSF

SEQ ID NO: 4786 - protein, 376 aa, Lolium temulentum
  misc_feature (1)..(376): useful for making plants with increased cold tolerance as described in USSN 12/863,773
  misc_feature (1)..(376): Public GI ID no.47606678
  misc_feature (1)..(376): Bit score of 188.5 for HMM based on sequences of FIGURE 2 of USSN 12/863,773.
  misc_feature (307)..(351): Pfam Name: CCT Pfam Description: CCT motif
  misc_feature (34)..(66): Pfam Name: zf-B_box Pfam Description: B-box zinc finger
  misc_feature (1)..(376): Functional Homolog Of Ceres SEEDLINE ID no. ME04315
MNSNSSSTIYEEAVGQEGSWSRLCDGCCMVPSVVYCHADSAYLCASCDVRIHSANRVASRHERVCLSKAHEHAPALLQCRTDAVASCAAYEAQAHYANLLAGMHQCVPVVSHPATAIPAASLLAEAAVTTTILSCKEEEAFWLLLSKNSANQNCSGDNRSSSTYFGEVDEYFDLVGYNSYYDSRMNNNQAQYGMQEQQHLQPMQKEYAEKEGSECVVPSQFATVSKPQQSGYALVGSEQAASMTAGVSVYTDSVNNSISFSSMEGGIVPDNTVVDLPYSIIPTPAGASSLHSGPPLQMPLHFSSMDREAKVLRYKEKKKTRTFEKTTRYATKKAYAEARPRIKGRFAKISEAEMEVDQLFSAAALSDSSYSTVPWF

SEQ ID NO: 4787 - DNA, 1350 bp, Panicum virgatum
  misc_feature (1)..(1350): useful for making plants with increased cold tolerance as described in USSN 12/863,773
  misc_feature (1)..(1350): Ceres CLONE ID no.1755065
aaccatttccgacgcagaacccccgggggccggaatccgtgacacccacccggaggagagcagagcagaggcatcaggcatggccgccgcggtggagctggagcagaagccggcggtggggtactggggcgtggccggcgcgcggccctgcgacgcgtgcgccgcggagccggcgcggctgcactgccgcgcggacggcgcgttcctgtgccccgggtgcgacgcccgcgcgcacggcgccgggtcgcgccacgcgcgcgtctggctctgcgaggtctgtgagcacgctcccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtccgcggccttcgccaccgcggggggccagtcccagggggacgcggcggcggcggcggcggcggacgacgacgggagcaacgaggccgaggccgcctcatggctcctccccgagcccgacaccagccacgaggacagcgcagccgccaccgacgccttcttcgcggactccgacaagtacctcggcgtcgacctcgacttcgcccggtccatggacggcatcaaggccatcggcgtcccggtcgcgccgccggagctggacatcgccgctggcgctttctactaccccgaacactccatgaaccatagcgtgtcgtcatcagaggtggcggtcgtgccggacgtgctggcgggcggcgtcccggcggtgccggtggcgagccgggggaaggagcgggaagcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctccgccgaggccgaggacgaggacgaggcgctgctggagcacgaggaaggggcgtgcttctcgcccgcggtgtcggcccccgcggcctcggacggcgtcgtcccgtccttctgctaagggggacgacgggtggcggccgcgcctcctcctcctccccggctcccaggcggcaaccccttaattttgccgactctgaatcgacccccaacgcatgccaacatgcgaatgcgatgcgcgcgctccgtgtagcataataattgtacagcagctcgtccgacgcaacgagctcaatcgcggtcgcacggaacgcctgtaatcctcctcaccatccgtgtaatccagccttgtacattaccatctagaggtgtttgtgcttctcttgc

SEQ ID NO: 4788 - protein, 334 aa, Panicum virgatum
  misc_feature (1)..(334): useful for making plants with increased cold tolerance as described in USSN 12/863,773
  misc_feature (1)..(334): Ceres CLONE ID no.1755065
  misc_feature (1)..(334): Bit score of 736.3 for HMM based on sequences of FIGURE 2 of USSN 12/863,773.
  misc_feature (253)..(297): Pfam Name: CCT Pfam Description: CCT motif
  misc_feature (64)..(106): Pfam Name: zf-B_box Pfam Description: B-box zinc finger
  misc_feature (1)..(334): Functional Homolog Of Ceres SEEDLINE ID no. ME04315
MAAAVELEQKPAVGYWGVAGARPCDACAAEPARLHCRADGAFLCPGCDARAHGAGSRHARVWLCEVCEHAPAAVTCRADAAALCAACDADIHSANPLARRHERLPVAPFFGALADAPQPFPSAAFATAGGQSQGDAAAAAAADDDGSNEAEAASWLLPEPDTSHEDSAAATDAFFADSDKYLGVDLDFARSMDGIKAIGVPVAPPELDIAAGAFYYPEHSMNHSVSSSEVAVVPDVLAGGVPAVPVASRGKEREARLMRYREKRKNRRFDKTIRYASRKAYAETRPRIKGRFAKRCSAEAEDEDEALLEHEEGACFSPAVSAPAASDGVVPSFC

SEQ ID NO: 4789 - DNA, 166 bp, Sorghum bicolor
  misc_feature (1)..(166): useful for making plants with increased cold tolerance as described in USSN 12/863,773
  misc_feature (1)..(166): 000SORGHUM
  misc_feature (1)..(166): Homolog Of Ceres SEEDLINE ID no. ME00572
tggtttcgcaaggtgaggtcttcttgaccttgcaagaccttttcttgaccttgtaagacccaactctgcgacatctctttcctgtcttacaccttcctcttcattcttacttcttttctatgtctatcccttatgagctgtgttgagctatgttaggtcctagtta

SEQ ID NO: 4790 - DNA, 154 bp, Triticum aestivum
  misc_feature (1)..(154): useful for making plants with increased cold tolerance as described in USSN 12/863,773
  misc_feature (1)..(154): 000TRITICUM
  misc_feature (1)..(154): Homolog Of Ceres SEEDLINE ID no. ME00572
tcctcatgccagaattaatgttcttgaccttgtaaggccttttcttgaccttgtaaggccctccccttacgtttctccgggtgtctccaacctcacactttctccccccttctatccctcctgagctatctccatgcatattttgtctagcaat

SEQ ID NO: 4791 - protein, 314 aa, Arabidopsis thaliana
  misc_feature (1)..(314): useful for making plants with increased cold tolerance as described in USSN 12/863,773
  misc_feature (1)..(314): Ceres CLONE ID no.1844076
  misc_feature (1)..(314): Bit score of 824.2 for HMM based on sequences of FIGURE 3 of USSN 12/863,773.
  misc_feature (38)..(173): Pfam Name: adh_short Pfam Description: short chain dehydrogenase
MSGKKERNKERREKRLQEISLLRTIPYSDHQRWWSQETVAVVTGANRGIGFEIARQLAGHGLTVILTSRNISVGIEATKALQEGGFSYDVHQLDILDGESISAFVEWIKQKYGGIDILVNNAGVNYNLGFDNSVEFARQVVDTNYYGTKNMIKAMIPVMKPSTAGARIVNVSSRLGRLNGRRNRIQDATLREKLTNLETLSEELIDRTVSSFLQQVEDETWQSGGWPQTFTDYSVSKLAVNAYTRLVAKELCDRPQGEKIYINCYCPGWVKTAMTGWAGNISPEVAADTGVWLSLLSDQAITGKFFAERREINF

SEQ ID NO: 4792 - DNA, 1167 bp, Arabidopsis thaliana
  misc_feature (1)..(1167): useful for making plants with increased cold tolerance as described in USSN 12/863,773
  misc_feature (1)..(1167): Ceres CLONE ID no.35974
acacccaaacacgcgacgcgagcgaaagaagacgatgacgaacaaggagaaagctcgagagagaagggagaaaaaaatgcaggagatctctctccttcgaactattccttactctgaccaccataggtggtggtcttgtgaaaatgtagcagtagtgactggttcaaaccgcgggattggattcgagattgcaagacagcttgcggttcacggattgacggttgttcttacagctagaaacgtgaatgctggtcttgaagcagttaaatctttgaggcaccaagaagaaggtctcaaggtttattttcatcaacttgatgtcacagactcttcctcgattagagagtttggttgctggcttaagcaaacatttggaggtttagatattctcgtgaataatgcaggtgttaactacaatctcggctcagataatacggttgaatttgctgaaacagttatatctactaactaccaaggaaccaaaaacatgacaaaagctatgatacccttgatgagaccatctcctcatggcgctcgtgtagtcaatgttagttctcggctaggtagagtaaatggaagacgtaatagactggcaaatgtagagttgagagatcagctaagcagtccagatttgctgaccgaggaacttatagacagaactgtctctaaattcatcaaccaagtaaaagacggaacttgggaatcaggcgggtggcctcagacattcactgactactccatgtctaagcttgcagtcaatgcttacacgagactaatggcaaaagaacttgagagacgaggagaggaagagaagatttatgttaacagcttttgccctggttgggtgaagactgcgatgactggctacgccggaaatatgccacctgaagatgcagctgatactggagtttggcttagcctggtcctttccgaagagtcagtaaccggaaaattcttcgcagagagacgtgagatcaacttctgagggttgttgaatgtttgtaaacgttggaatagattgtgtcgtcttcgtttagtgccatagttttagtcaaaggtttacaaaatcaattgtaattggtaagtgaatggttgtagtcatgatacgcgtcagatttgccacaaaactaggagtttataatttaaatataattaatttttaattgc

SEQ ID NO: 4793 - protein, 316 aa, Arabidopsis thaliana
  misc_feature (1)..(316): useful for making plants with increased cold tolerance as described in USSN 12/863,773
  misc_feature (1)..(316): Ceres CLONE ID no.35974
  misc_feature (1)..(316): Bit score of 817.6 for HMM based on sequences of FIGURE 3 of USSN 12/863,773.
  misc_feature (37)..(174): Pfam Name: adh_short Pfam Description: short chain dehydrogenase
  misc_feature (1)..(316): Functional Homolog Of Full Length   Ceres SEEDLINE ID no.ME17294
MTNKEKARERREKKMQEISLLRTIPYSDHHRWWSCENVAVVTGSNRGIGFEIARQLAVHGLTVVLTARNVNAGLEAVKSLRHQEEGLKVYFHQLDVTDSSSIREFGCWLKQTFGGLDILVNNAGVNYNLGSDNTVEFAETVISTNYQGTKNMTKAMIPLMRPSPHGARVVNVSSRLGRVNGRRNRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEESVTGKFFAERREINF

SEQ ID NO: 4794 - protein, 304 aa, Arabidopsis thaliana
  misc_feature (1)..(304): useful for making plants with increased cold tolerance as described in USSN 12/863,773
  misc_feature (1)..(304): Public GI ID no.10176876
  misc_feature (1)..(304): Bit score of 730.9 for HMM based on sequences of FIGURE 3 of USSN 12/863,773.
  misc_feature (23)..(160): Pfam Name: adh_short Pfam Description: short chain dehydrogenase
  misc_feature (1)..(304): Functional Homolog Of Full Length   Ceres SEEDLINE ID no.ME17294
MQEISLLRTIPYSDHHRWWSCENVAVVTGSNRGIGFEIARQLAVHGLTVVLTARNVNAGLEAVKSLRHQEEGLKVYFHQLDVTDSSSIREFGCWLKQTFGGLDILVNNAGVNYNLGSDNTVEFAETVISTNYQGTKNMTKAMIPLMRPSPHGARVVNVSSRLENLVEIHELQRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEEAVTGKFFAERREINF

SEQ ID NO: 4795 - DNA, 1164 bp, Glycine max
  misc_feature (1)..(1164): useful for making plants with increased cold tolerance as described in USSN 12/863,773
  misc_feature (1)..(1164): Ceres CLONE ID no.473040
acttcttaaaactggtatctgatttacaaaaggttacaaacttctcttgcataaagaatggcatcagcaacaataaggaatgcagttgtcacgggagcaaacaaagggataggatttggaatatgcaagcaattggtttctaatggcatcacagtggtgctaacagcaagggatgagaaaaggggtcttgaagctgttgaaaagctgaaagagtttggtgtgtctgatcaagtggtgtttcatcagcttgatgtgactgaccctaaaagcattgaatcccttgcaaatttcatcaaaacccagtttggaaaacttgatatcttggtgaataatgcaggaattcatggagcatatgttgaccgtgatgctttagctgctgctggggaaaaagttgccaatgttgattggagaaaaatctcaactgaaaattttgaagctgccgaagcaggcattagaacaaattactatggagtcaaattaatgtgtgaagcacttattccccttctagaattgtcaggcacaccaaggattgtcaatgtttcctcctccatggggaagttggagaaaataccaaatgcatgggctagaggagccctaagtgatgctgagagcctaacagaagaaaaggtggatgaggttttgaatcagtttctaaaagattttaaagagggttcattagaaaccaaagggtggccacatgctttttctgcatatatagtctcaaaagctgctttgactgcctacacaaggattcttgctaagaagtacccatctttctgcatcaatgctgtttgccctggctttgtgaaaacagatctcaactacaatactggctatcttagtgttgatgaaggtgctgaaagtgttgtaaggttggctctgctacctaatggaggtccttctggtctattcttttctcgaagtgaagtggcaccattctgatccaaagactgttgtgtacttgaagaggataaataataagcatggtttcatgataagacatgtatcaaatttgtacctagcacaacaagaaaataagccacatgtctgatcactgatggctgcccatcattgatgagaacaaccctatagtgaattctagatattacaatgacattactaatttgagaaatctaattttggatataaagatatctgtttgtc

SEQ ID NO: 4796 - protein, 294 aa, Glycine max
  misc_feature (1)..(294): useful for making plants with increased cold tolerance as described in USSN 12/863,773
  misc_feature (1)..(294): Ceres CLONE ID no.473040
  misc_feature (1)..(294): Bit score of 656.1 for HMM based on sequences of FIGURE 3 of USSN 12/863,773.
  misc_feature (7)..(168): Pfam Name: adh_short Pfam Description: short chain dehydrogenase
  misc_feature (1)..(294): Functional Homolog Of Full Length   Ceres SEEDLINE ID no.ME17294
MASATIRNAVVTGANKGIGFGICKQLVSNGITVVLTARDEKRGLEAVEKLKEFGVSDQVVFHQLDVTDPKSIESLANFIKTQFGKLDILVNNAGIHGAYVDRDALAAAGEKVANVDWRKISTENFEAAEAGIRTNYYGVKLMCEALIPLLELSGTPRIVNVSSSMGKLEKIPNAWARGALSDAESLTEEKVDEVLNQFLKDFKEGSLETKGWPHAFSAYIVSKAALTAYTRILAKKYPSFCINAVCPGFVKTDLNYNTGYLSVDEGAESVVRLALLPNGGPSGLFFSRSEVAPF

SEQ ID NO: 4797 - DNA, 2073 bp, Triticum aestivum
  misc_feature (1)..(2073): useful for making plants with increased cold tolerance as described in USSN 12/863,773
  misc_feature (1)..(2073): Ceres CLONE ID no.922223
gtaaacaagcccatggactcttattttctctttatgttgggcttaatgttcttggggctatggttccgagttctcaaaaaaaaaagttcgattccggcgaacacagtacagcagagggagcgagagatggggaagaagggcaaggcggcggcaagggagcgccgggaggagcggcggcgggaagtcacgctcctccgcgccgtaccctacgagccccaccagcggtggtgggacggcctcgcgccggcgcgcgccgtggcggtggtgacgggggccagccgcggcatcggctacgagatctcccgccagctcgcgcgccacggcctccacgtcgtcctcgcctcgcgcgacgccgcgcggggcagggacgccgcggaggggatcctccgcgaggagggcacgagcgcggagtggcggcagctcgacgtggcggacgccgcgtcggtcgaggccttcgccgcctggacggcgcggacccacggcggcatccatgtccttattaacaatgcaggtgtaaacttcaacagaggagcagataactctgttgaatttgcagagcaagtaattgagacaaattattttggtacaaggcggatgattgaagccatgctaccattactgaaaccttctccgtatggtggccggatagtgaatgtgagctcaaggcttggcagggccaatggcagacgcaataaaatcggcgatgcgatcctaagagagcaactattaactgatgattgcttatctgaggaattgattgatgggatggtcactaaattccttgaacaagtgaagcaaaatagttggtcctccattgagtggcctcagatgtacacggactattcggtctcaaagtttgctgttaatgtgtatacaagactcatggcaaggaggttatctgacaggtctgaaggccaaaagatttacattaactgtttctgtcctggctgggtaaagactgccatgactgattgggaagggaacatttcagccgaagaaggtgctgatactggagtgtggcttgctctgttaccccaggaacaagcaacaattggaaagttctatgctgagagacgcgagataagcttctgaggtgatcggaatggtggatatgcgagtgggagtggtacatttaaccatatgtatttaattaaagttttaaactatgtaggtgatcggaatggtggatatgcgagtgggagtggcatgttcatgaagagcaatccacatgattggcagactccagcatggttttcgagtcgcgactcatgcgagttgctctggggcagcgactcggaagaagtcgagcctgcgttgtgactagtcatgactcagagtcgcgagtcgatactaagctgagttgaccatatttttgcgactcatagactagtcgtcgactagtcgcaactagtcgagcgactcgaaatccatggactccagtcggtcaaagagcattgagtcttcacactgatggaaggccatgctctctaattttgtcaataaatgatgcagtaccagatgctttcagacgatactcagacgacgttgcccatcagaccgtttgttaattagattcacgtcaatctcatggtgtagagtctgcgtcggctgcacatcggccataccatgtcgtgtgtacatcaatttcgtgaagttgctggaaacagggaaatgttcaccaggcccaccaccactagtccacaacggcagtaagcaggcatggcatgctggactgctgcaccgaatatatgattaggctggatctcaagcaactccactgtcagattctctcattatcttccaagtagaggtggaatccttatgacccaatggatgagagcgatgcaacgctgcctcacccacgcatgcagaagatcgatatgtttgggaacgaaccggtcggcctaccttgggaattctggagctatagtcatggctaggccgccattcatggaccggagactacatgtcttgcagtatattgttctgattttgccgccacctgcatatgtgtggtacatactttgttatgttcgtgtttgtatgcaatggttggatcgtgtgatttgctgg

SEQ ID NO: 4798 - protein, 321 aa, Triticum aestivum
  misc_feature (1)..(321): useful for making plants with increased cold tolerance as described in USSN 12/863,773
  misc_feature (1)..(321): Ceres CLONE ID no.922223
  misc_feature (1)..(321): Bit score of 823.6 for HMM based on sequences of FIGURE 3 of USSN 12/863,773.
  misc_feature (43)..(179): Pfam Name: adh_short Pfam Description: short chain dehydrogenase
  misc_feature (1)..(321): Functional Homolog Of Full Length   Ceres SEEDLINE ID no.ME17294
MGKKGKAAARERREERRREVTLLRAVPYEPHQRWWDGLAPARAVAVVTGASRGIGYEISRQLARHGLHVVLASRDAARGRDAAEGILREEGTSAEWRQLDVADAASVEAFAAWTARTHGGIHVLINNAGVNFNRGADNSVEFAEQVIETNYFGTRRMIEAMLPLLKPSPYGGRIVNVSSRLGRANGRRNKIGDAILREQLLTDDCLSEELIDGMVTKFLEQVKQNSWSSIEWPQMYTDYSVSKFAVNVYTRLMARRLSDRSEGQKIYINCFCPGWVKTAMTDWEGNISAEEGADTGVWLALLPQEQATIGKFYAERREISF

SEQ ID NO: 4799 - protein, 331 aa, Oryza sativa subsp. indica
  misc_feature (1)..(331): useful for making plants with increased cold tolerance as described in USSN 12/863,773
  misc_feature (1)..(331): Public GI ID no.125528967
  misc_feature (1)..(331): Bit score of 831.3 for HMM based on sequences of FIGURE 3 of USSN 12/863,773.
  misc_feature (49)..(188): Pfam Name: adh_short Pfam Description: short chain dehydrogenase
  misc_feature (1)..(331): Functional Homolog Of Full Length   Ceres SEEDLINE ID no.ME17294
MGKKGKEAARERREQRRREVTLLRAVPYEPHQRWWDGLAPPPPPPPGRAVAVVTGANRGIGYEAARQLATHGLHVVLTSRDAARGRDAAEQIRAAAGKPGVSVEWRQLDVTDAASVEGFATWVERTHGGVHVLVNNAGVNFNRGADNSVEFAEQVTETNYFGTKRMIEAMMPLMITSPHGGRIVNVSSRLGRVNGRRNRIGDPSLRERLLNDDHLSEELINEMVMKFLEQTKQDNWSSSNEWPQMYTDYSISKLAVNAYTRLLARRLLDRPEGQKIYINCFCPGWVKTAMTGWEGNISAEEGADTGVWLALVPQEQATIGKFFAERREISF

SEQ ID NO: 4800 - protein, 330 aa, Oryza sativa subsp. japonica
  misc_feature (1)..(330): useful for making plants with increased cold tolerance as described in USSN 12/863,773
  misc_feature (1)..(330): Public GI ID no.125573200
  misc_feature (1)..(330): Bit score of 834.6 for HMM based on sequences of FIGURE 3 of USSN 12/863,773.
  misc_feature (48)..(187): Pfam Name: adh_short Pfam Description: short chain dehydrogenase
  misc_feature (1)..(330): Functional Homolog Of Full Length   Ceres SEEDLINE ID no.ME17294
MGKKGKEAARERREQRRREVTLLRAVPYEPHQRWWDGLAPPPPPPGRAVAVVTGANRGIGYEAARQLATHGLHVVLTSRDAARGRDATEQIRAAAGKPGVSVEWRQLDVTDAASVEGFATWVERTHGGVHVLVNNAGVNFNRGADNSVEFAEQVIETNYFGTKRMIEAMMPLMITSPHGGRIVNVSSRLGRVNGRRNRIGDPSLRERLLNDDHLSEELINEMVMKFLEQTKQDNWSSGNEWPQMYTDYSISKLAVNAYTRLLARRLLDRPEGQKIYINCFCPGWVKTAMTGWEGNISAEEGADTGVWLALVPQEQATIGKFFAERREISF

SEQ ID NO: 4801 - DNA, 942 bp, Populus balsamifera subsp. trichocarpa
  misc_feature (1)..(942): useful for making plants with increased cold tolerance as described in USSN 12/863,773
  misc_feature (1)..(942): Ceres ANNOT ID no.1527409
atgggaagtaaagagccagcaaaggaaaagagagaaaaaagactccaagaaatttctcttctccgtaccattccttactctgatcatcaaaggtggtggtcatcagaaactgttgctgtggtgaccggtggaaatagaggaataggatttgagattgcgaggcaacttgcagaccatggattgtctgttatcctgacatcacgagaaagtagcgcaggccttgaagctgccaatgtcttgcgagagttgggtttgagtgtggacttccatcaacttgatgtcttagattctttatccatcaaaacgtttgctgagtggatacaacaaacttacggcggattagatgttttggtgaataatgctggtgttaattacaatatggggtctgacaattctgttgaaaatgccaagaatgttgttgatacaaactattatggtatcaaaaatgtcactgaagctctgattcctttgatgagaccttcttctgtaggtgctcgtattgttaatgtaagttcacggcttggaagactaaatggcaaacgaaacagacttgaagacaaagatttgagagagcaactggctaacctggaaacactttcagaggaactcattgataggacggtgtctactttcctacaacaagtagaagaccgcacatatacatcaggtggatggcctcaggtgaacactgattactcggtgtcaaaacttgcagttaatgcttatactaggctaatggcaaagaaactgtccgatcggcctaatggtcagaagatctatataaactgctactgcccagggtgggtgaagacagctatgacaggctgggctggtaatgtatcagctgaggatggagctgacacaggagtatggctggccctgcttccagaccaagcaatcacagggaaattttttgctgagagacgtgaggtaaacttctga

SEQ ID NO: 4802 - protein, 313 aa, Populus balsamifera subsp. trichocarpa
  misc_feature (1)..(313): useful for making plants with increased cold tolerance as described in USSN 12/863,773
  misc_feature (1)..(313): Ceres ANNOT ID no.1527409
  misc_feature (1)..(313): Bit score of 836.2 for HMM based on sequences of FIGURE 3 of USSN 12/863,773.
  misc_feature (37)..(172): Pfam Name: adh_short Pfam Description: short chain dehydrogenase
  misc_feature (1)..(313): Functional Homolog Of Full Length   Ceres SEEDLINE ID no.ME17294
MGSKEPAKEKREKRLQEISLLRTIPYSDHQRWWSSETVAVVTGGNRGIGFEIARQLADHGLSVILTSRESSAGLEAANVLRELGLSVDFHQLDVLDSLSIKTFAEWIQQTYGGLDVLVNNAGVNYNMGSDNSVENAKNVVDTNYYGIKNVTEALIPLMRPSSVGARIVNVSSRLGRLNGKRNRLEDKDLREQLANLETLSEELIDRTVSTFLQQVEDRTYTSGGWPQVNTDYSVSKLAVNAYTRLMAKKLSDRPNGQKIYINCYCPGWVKTAMTGWAGNVSAEDGADTGVWLALLPDQAITGKFFAERREVNF

SEQ ID NO: 4803 - protein, 311 aa, Medicago truncatula
  misc_feature (1)..(311): useful for making plants with increased cold tolerance as described in USSN 12/863,773
  misc_feature (1)..(311): Public GI ID no.92871098
  misc_feature (1)..(311): Bit score of 828.1 for HMM based on sequences of FIGURE 3 of USSN 12/863,773.
  misc_feature (35)..(170): Pfam Name: adh_short Pfam Description: short chain dehydrogenase
  misc_feature (1)..(311): Functional Homolog Of Full Length   Ceres SEEDLINE ID no.ME17294
MGHKEKSRKDKRLQEISLLRTIPYSDHQRWWSKETIAVVTGGNRGIGFEISRQLADHGVTVVLTSRDASVGVESIKVLQEGGLDVHCHQLDILDSSSVNEFAEWLKEEYGGLDILVNNAGVNSNMGSDNSVENARKCIETNYYGTKRMIEAMIPLMKPSAAGGRIVNVSSRLGRLNGKRNRIENEELREKLSDVESLSEELIDETINNFLQQIEDGSWKTGGWPQTFTDYSVSKLAVNTYTRYMAKKLSDRPEGEKIYINCYCPGWVKTALTGYAGSVTVEQGADTGVWIALVPDQEITGKFFAERREINF

SEQ ID NO: 4804 - DNA, 1171 bp, Panicum virgatum
  misc_feature (1)..(1171): useful for making plants with increased cold tolerance as described in USSN 12/863,773
  misc_feature (1)..(1171): Ceres CLONE ID no.1831117
ctcccacccgcgctcccagcacgcccaccgtcgcctaccccgtctccagctcgatggactactcgagcaccaaggagttacctccggccggggcctggtggtcgagggagacggtggccgtggtgacgggcgcgaaccggggcatcgggcacgccctcgccgcgcgcctggcggagcacgggctcaccgtggtgctcaccgcgcgggacggcgcgcgcggggaggccgccgcggccccgctccgcgcgcgcgggctcgccgtcgccttccgcaggctcgacgtctccgacgccgcctccgtcgccgagttcgccgcctggctccgcgacgccgtcggcggcctcgacatcctggtgaacaacgccgccgtgtccttcaacgagatcgacaccaactcggtggagcacgccgagacggtcctccggaccaacttctacggcgccaagatgctcacggaagcgctcctgccgctgttccggcagtccccggccaccagcaggatcctcaacatcagctcgcagctcggccttctcaacaaggtgagcgacccgtccctgaaggcgttgctgctggacgaggagaccctgacggaggcggcgatcgacgccatggtgtcgcggttcctggcgcaggtgaaggacgggacgtggggcgcgcagggttggcccaaggtgtggacggactactcggtctccaagctggccctgaacgcctactcccggctgctggcgcggcggctgcaggcgcgcggcgcccgcgtgagcgtcaactgcttctgccccgggttcacgcgcaccgacatgaccaggggctgggggaagcgcaccgccgaggaggcggccgacgtcggcgcgcggctcgcgctgctgccgcccggcgagctccccacgggggccttcttcaagtggtgcacgccgcagccctactccaagctgtgacctgccgagccacgccgccggcccgcgcgccccggccatggcggccgcaggagtatgtagcgttggtttagctgcttctagttactttcaatgcagacaagaagccgatcgagtagtgtctcttagcagtctggctttctgccaaggtgctttggttgagcaatgcaaccaaaccatgtcagcgatcaatgtactatgcgtgcttagccgtgcaagatttaggtcaacttccg

SEQ ID NO: 4805 - protein, 294 aa, Panicum virgatum
  misc_feature (1)..(294): useful for making plants with increased cold tolerance as described in USSN 12/863,773
  misc_feature (1)..(294): Ceres CLONE ID no.1831117
  misc_feature (1)..(294): Bit score of 671.6 for HMM based on sequences of FIGURE 3 of USSN 12/863,773.
  misc_feature (20)..(160): Pfam Name: adh_short Pfam Description: short chain dehydrogenase
  misc_feature (1)..(294): Functional Homolog Of Full Length   Ceres SEEDLINE ID no.ME17294
MDYSSTKELPPAGAWWSRETVAVVTGANRGIGHALAARLAEHGLTVVLTARDGARGEAAAAPLRARGLAVAFRRLDVSDAASVAEFAAWLRDAVGGLDILVNNAAVSFNEIDTNSVEHAETVLRTNFYGAKMLTEALLPLFRQSPATSRILNISSQLGLLNKVSDPSLKALLLDEETLTEAAIDAMVSRFLAQVKDGTWGAQGWPKVWTDYSVSKLALNAYSRLLARRLQARGARVSVNCFCPGFTRTDMTRGWGKRTAEEAADVGARLALLPPGELPTGAFFKWCTPQPYSKL

SEQ ID NO: 4806 - DNA, 951 bp, Arabidopsis thaliana
  misc_feature (1)..(951): useful for making plants with increased cold tolerance as described in USSN 12/863,773
  misc_feature (1)..(951): Ceres ANNOT ID no.857222
atgacgaacaaggagaaagctcgagagagaagggagaaaagaatgcaggagatctctctccttcgaactattccttactctgaccaccataggtggtggtcttgtgaaaatgtagcagtagtgactggttcaaaccgcgggattggattcgagattgcaagacagcttgcggttcacggattgacggttgttcttacagctagaaacgtgaatgctggtcttgaagcagttaaatctttgaggcaccaagaagaaggtctcaaggtttattttcatcaacttgatgtcacagactcttcgtcgattagagagtttggttgctggcttaagcaaacatttggaggtttagatattctcgtgaataatgcaggtgttaactacaatctcggctcagataatacggttgaatttgctgaaacagttatatctactaactaccaaggaaccaaaaacatgacaaaagctatgatacccttgatgagaccatctcctcatggcgctcgtgtagtcaatgttagttctcggctaggtagagtaaatggaagacgtaatagactggcaaatgtagagttgagagatcagctaagcagtccagatttgctgaccgaggaacttatagacagaactgtctctaaattcatcaaccaagtaaaagacggaacttgggaatcaggcgggtggcctcagacattcactgactactccatgtctaagcttgcagtcaatgcttacacgagactaatggcaaaagaacttgagagacgaggagaggaagagaagatttatgttaacagcttttgccctggttgggtgaagactgcgatgactggctacgccggaaatatgccacctgaagatgcagctgatactggagtttggcttagcctggtcctttccgaagaggcagtaaccggaaaattcttcgcagagagacgtgagatcaacttctga

SEQ ID NO: 4807 - protein, 316 aa, Arabidopsis thaliana
  misc_feature (1)..(316): useful for making plants with increased cold tolerance as described in USSN 12/863,773
  misc_feature (1)..(316): Ceres ANNOT ID no.857222
  misc_feature (1)..(316): Bit score of 823.3 for HMM based on sequences of FIGURE 3 of USSN 12/863,773.
  misc_feature (37)..(174): Pfam Name: adh_short Pfam Description: short chain dehydrogenase
  misc_feature (1)..(316): Functional Homolog Of Full Length   Ceres SEEDLINE ID no.ME17294
MTNKEKARERREKRMQEISLLRTIPYSDHHRWWSCENVAVVTGSNRGIGFEIARQLAVHGLTVVLTARNVNAGLEAVKSLRHQEEGLKVYFHQLDVTDSSSIREFGCWLKQTFGGLDILVNNAGVNYNLGSDNTVEFAETVISTNYQGTKNMTKAMIPLMRPSPHGARVVNVSSRLGRVNGRRNRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEEAVTGKFFAERREINF

SEQ ID NO: 4808 - DNA, 1213 bp, Triticum aestivum
  misc_feature (1)..(1213): useful for making plants with increased cold tolerance as described in USSN 12/863,773
  misc_feature (1)..(1213): Expected Sequence
  misc_feature (675)..(675): y is t/u or c
  misc_feature (734)..(734): y is t/u or c
  misc_feature (815)..(815): m is a or c
  misc_feature (818)..(818): y is t/u or c
  misc_feature (851)..(851): m is a or c
acacggctgtggtttcaattttatttcatctctatccaattgagtgatggaacggctgagagtagtggtgcctaattgcctgagctgtattgagttctgaatattcatgttcaaaaaattcctactaccatgcatagaagtctgaatatttagcagaaaatagcttggacatgggcagtctaaaaatgatattcagtttcatacatgtgagactatgatacataggttctgcacaaagcaaggaggaaaccgatatgcaatgagtggttaggtgctgatactggcagatttttgtctgaatatctctggtaacccagctacagattaacaatgcaggtgtaaacttcaacagaggagcagataactctgttgaatttgcagagcaagtaattgagacaaattattttggtacaaagcggatgattgaagccatgctaccattactgaaaccttctccgtatggtggccggatagtgaatgtaagctcaaggcttggtagggccaatggcaggcgcaataaaatcggcgatgcgatcctaagagagcaactattaactgatgattgcttatctgaagaattgatttgatgggattgtcactaaattccttgaacaagtgaagcaaaatagttggtcctccattgagtggcctcagatgtacacggactattctatytcaaagcttgctgttaatgtgtatacaagactcatggctaagaggcttgctgacaggtytgaaggccaaaagatttacattaactgtttctgtcctggctgggtaaagactgccatgactgattgggaagggaacatttmagycgaagaaggtgctgatactggagtgtggcttgmtctgttaccccaggcacaagcaacaattggaaagttctatgctgagagacgcgagataagcttctgaggtgactagtcttgtccatacttttgctccagctagacagctacaagttgaaattttccatagttttgcccccagctataagtagagaaaagccatgacccaaggttcgtatgttcaaattgctttgtgttacttgcacctattggcatagaagtgatacatgcttacttttatctatgtcctcttaaagggcttgtggtttgctttttattttgcacgttagctgaagagcagtagaactgagatgtgttcccatttcctctgatatttaatgcagtaacggatccatctttct

SEQ ID NO: 4809 - DNA, 1212 bp, Triticum aestivum
  misc_feature (1)..(1212): useful for making plants with increased cold tolerance as described in USSN 12/863,773
  misc_feature (1)..(1212): Inplanta Sequence
acacggctgtggtttcaattttatttcatctctatccaattgagtgatggaacggctgagagtagtggtgcctaattgcctgagctgtattgagttctgaatattcatgttcaaaaaattcctactaccatgcatagaagtctgaatatttagcagaaaatagcttggacatgggcagtctaaaaatgatattcagtttcatacatgtgagactatgatacataggttctgcacaaagcaaggaggaaaccgatatgcaatgagtggttaggtgctgatactggcagatttttgtctgaatatctctggtaacccagctacagattaacaatgcaggtgtaaacttcaacagaggagcagataactctgttgaatttgcagagcaagtaattgagacaaattattttggtacaaagcggatgattgaagccatgctaccattactgaaaccttctccgtatggtggccggatagtgaatgtaagctcaaggcttggtagggccaatggcaggcgcaataaaatcggcgatgcgatcctaagagagcaactattaactgatgattgcttatctgaggaattgattggtgggattgtcactaaattccttgaacaagtgaagcaaaatagttggtcctccattgagtggcctcagatgtacacggactattctatctcaaagcttgctgttaatgtgtatacaagactcatggctaagaggcttgctgacaggtctgaaggccaaaagatttacattaactgtttctgtcctggctgggtaaagactgccatgactgattgggaagggaacatttcagccgaagaaggtgctgatactggagtgtggcttgctctgttaccccaggcacaagcaacaattggaaagttctatgctgagagacgcgagataagcttctgaggtgactagtcttgtccatacttttactccagctagacagctacaagttgaaattttccatagttttgcccccagctataagtagagaaaagccatgacccaaggttcgtatgttcaaattgctttgtgttacttgcacctattggcatagaagtgatacatgcttacttttatctatgtcctcttaaagggcttgtggtttgctttttattttgcacgttagctgaagagcagtagaactgagatgtgttcccatttcctctgatatttaatgcagtaacggatccatctttct

SEQ ID NO: 4810 - protein, 165 aa, Triticum aestivum
  misc_feature (1)..(165): useful for making plants with increased cold tolerance as described in USSN 12/863,773
  misc_feature (1)..(165): Functional Homolog Of   Ceres SEEDLINE ID no.ME17294
  misc_feature (1)..(165): Bit score of 449.7 for HMM based on sequences of FIGURE 4 of USSN 12/863,773.
MIEAMLPLLKPSPYGGRIVNVSSRLGRANGRRNKIGDAILREQLLTDDCLSEELIGGIVTKFLEQVKQNSWSSIEWPQMYTDYSISKLAVNVYTRLMAKRLADRSEGQKIYINCFCPGWVKTAMTDWEGNISAEEGADTGVWLALLPQAQATIGKFYAERREISF

SEQ ID NO: 4811 - DNA, 1171 bp, Panicum virgatum; identical to SEQ ID NO: 4804
  misc_feature (1)..(1171): useful for making plants with increased cold tolerance as described in USSN 12/863,773
  misc_feature (1)..(1171): Ceres CLONE ID no.1831117

SEQ ID NO: 4812 - protein, 163 aa, Panicum virgatum
  misc_feature (1)..(163): useful for making plants with increased cold tolerance as described in USSN 12/863,773
  misc_feature (1)..(163): Ceres CLONE ID no.1831117
  misc_feature (1)..(163): Bit score of 411.8 for HMM based on sequences of FIGURE 4 of USSN 12/863,773.
  misc_feature (1)..(163): Functional Homolog Of   Ceres SEEDLINE ID no.ME17294
MLTEALLPLFRQSPATSRILNISSQLGLLNKVSDPSLKALLLDEETLTEAAIDAMVSRFLAQVKDGTWGAQGWPKVWTDYSVSKLALNAYSRLLARRLQARGARVSVNCFCPGFTRTDMTRGWGKRTAEEAADVGARLALLPPGELPTGAFFKWCTPQPYSKL

SEQ ID NO: 4813 - protein, 164 aa, Medicago truncatula
  misc_feature (1)..(164): useful for making plants with increased cold tolerance as described in USSN 12/863,773
  misc_feature (1)..(164): Public GI ID no.92871098
  misc_feature (1)..(164): Truncated
  misc_feature (1)..(164): Bit score of 389.1 for HMM based on sequences of FIGURE 4 of USSN 12/863,773.
  misc_feature (1)..(164): Functional Homolog Of   Ceres SEEDLINE ID no.ME17294
MIEAMIPLMKPSAAGGRIVNVSSRLGRLNGKRNRIENEELREKLSDVESLSEELIDETINNFLQQIEDGSWKTGGWPQTFTDYSVSKLAVNTYTRYMAKKLSDRPEGEKIYINCYCPGWVKTALTGYAGSVTVEQGADTGVWIALVPDQEITGKFFAERREINF

SEQ ID NO: 4814 - DNA, 1243 bp, Gossypium hirsutum
  misc_feature (1)..(1243): useful for making plants with increased cold tolerance as described in USSN 12/863,773
  misc_feature (1)..(1243): Ceres CLONE ID no.1844076
  misc_feature (1)..(1243): Truncated
atttcagtccaataactttcctagaccttatttgcgtttcagctccgtgcatccatttactttctccttctccattttgactcgtcacctcaaaattgccccacacctgaaagacggagcaaacactaggatatgtcagggaaaaaggaaagaaacaaggagagaagagaaaagagactccaagagatttcacttctcaggaccattccttattctgatcatcaaaggtggtggtcacaagaaactgttgcagttgtaactggtgctaatagaggaatcgggtttgagattgcaagacaacttgccgggcatggattgacagtaatactaacatcaaggaacattagtgtcggcattgaagcaaccaaggccttacaagaagggggtttcagttatgatgttcatcagcttgatatcttggatggtgaatcaatttcagcgtttgttgaatggataaaacaaaaatacggtggcattgatatcctggtgaataatgcaggtgttaactacaacctcgggttcgataattctgtggaattcgcacgacaggtagttgacaccaattattatggcactaaaaatatgattaaagcaatgataccagtaatgaaaccttccactgctggtgctcgtatcgttaatgtaagctcacggctaggcagactaaacggccgccgcaatagaattcaagatgcaactttgagagaaaaactaactaatttggaaactctctcagaggaattgattgatagaacagtgtctagtttcttacaacaagttgaagatgaaacttggcaatcaggcggatggcctcaaacattcactgattactctgtatctaaacttgctgtcaatgcttacaccagactggtggccaaagaactctgcgatcgaccacaaggcgaaaagatatatatcaactgttattgtccaggatgggtgaagactgcaatgacaggttgggcaggcaatatttctcctgaggttgcagctgacactggagtctggctttccttgctttctgaccaagcaataactggaaagttttttgcagagagacgagaaatcaacttttgagtaaattaagttctgcattgtagagtcaaaaatttgttctattcttgaagattcgatgaaacagttgaaagtaacttgttttagaagcaatttggcccatacgtagcaccaaactaaaaccgaacatatgaatcaatgctgctttctgtctaaccttaaaagaccc

SEQ ID NO: 4815 - protein, 164 aa, Gossypium hirsutum
  misc_feature (1)..(164): useful for making plants with increased cold tolerance as described in USSN 12/863,773
  misc_feature (1)..(164): Ceres CLONE ID no.1844076
  misc_feature (1)..(164): Bit score of 438.0 for HMM based on sequences of FIGURE 4 of USSN 12/863,773.
  misc_feature (1)..(164): Truncated
  misc_feature (1)..(164): Functional Homolog Of   Ceres SEEDLINE ID no.ME17294
MIKAMIPVMKPSTAGARIVNVSSRLGRLNGRRNRIQDATLREKLTNLETLSEELIDRTVSSFLQQVEDETWQSGGWPQTFTDYSVSKLAVNAYTRLVAKELCDRPQGEKIYINCYCPGWVKTAMTGWAGNISPEVAADTGVWLSLLSDQAITGKFFAERREINF

SEQ ID NO: 4816 - DNA, 1167 bp, Arabidopsis thaliana; identical to SEQ ID NO: 4792
  misc_feature (1)..(1167): useful for making plants with increased cold tolerance as described in USSN 12/863,773
  misc_feature (1)..(1167): Ceres CLONE ID no.35974

SEQ ID NO: 4817 - protein, 165 aa, Arabidopsis thaliana
  misc_feature (1)..(165): useful for making plants with increased cold tolerance as described in USSN 12/863,773
  misc_feature (1)..(165): Ceres CLONE ID no.35974
  misc_feature (1)..(165): Bit score of 357.4 for HMM based on sequences of FIGURE 4 of USSN 12/863,773.
  misc_feature (1)..(165): Truncated
  misc_feature (1)..(165): Functional Homolog Of   Ceres SEEDLINE ID no.ME17294
MTKAMIPLMRPSPHGARVVNVSSRLGRVNGRRNRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEESVTGKFFAERREINF

SEQ ID NO: 4818 - protein, 165 aa, Arabidopsis thaliana
  misc_feature (1)..(165): useful for making plants with increased cold tolerance as described in USSN 12/863,773
  misc_feature (1)..(165): Public GI ID no.110737329
  misc_feature (1)..(165): Bit score of 355.4 for HMM based on sequences of FIGURE 4 of USSN 12/863,773.
  misc_feature (1)..(165): Functional Homolog Of   Ceres SEEDLINE ID no.ME17294
MTKAMIPLMRPSPHGARVVNVSSRLGRVNGRRNRLANVELRDQLSSPDLLTEELIDRTVSKFINQVKDGTWESGGWPQTFTDYPMSKLAVNAYTRLMAKELERRGEEEKIYVNSFCPGWVKTAMTGYAGNMPPEDAADTGVWLSLVLSEEAVTGKFFAERREINF

SEQ ID NO: 4819 - protein, 167 aa, Arabidopsis thaliana
  misc_feature (1)..(167): useful for making plants with increased cold tolerance as described in USSN 12/863,773
  misc_feature (1)..(167): Public GI ID no.10176876
  misc_feature (1)..(167): Bit score of 316.9 for HMM based on sequences of FIGURE 4 of USSN 12/863,773.
  misc_feature (1)..(167): Truncated
  misc_feature (1)..(167): Functional Homolog Of   Ceres SEEDLINE ID no.ME17294
MTKAMIPLMRPSPHGARVVNVSSRLENLVEIHELQRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEEAVTGKFFAERREINF

SEQ ID NO: 4820 - DNA, 1164 bp, Glycine max; identical to SEQ ID NO: 4795
  misc_feature (1)..(1164): useful for making plants with increased cold tolerance as described in USSN 12/863,773
  misc_feature (1)..(1164): Ceres CLONE ID no.473040

SEQ ID NO: 4821 - protein, 153 aa, Glycine max
  misc_feature (1)..(153): useful for making plants with increased cold tolerance as described in USSN 12/863,773
  misc_feature (1)..(153): Ceres CLONE ID no.473040
  misc_feature (1)..(153): Bit score of 360.8 for HMM based on sequences of FIGURE 4 of USSN 12/863,773.
  misc_feature (1)..(153): Truncated
  misc_feature (1)..(153): Functional Homolog Of   Ceres SEEDLINE ID no.ME17294
MCEALIPLLELSGTPRIVNVSSSMGKLEKIPNAWARGALSDAESLTEEKVDEVLNQFLKDFKEGSLETKGWPHAFSAYIVSKAALTAYTRILAKKYPSFCINAVCPGFVKTDLNYNTGYLSVDEGAESVVRLALLPNGGPSGLFFSRSEVAPF

SEQ ID NO: 4822 - DNA, 2073 bp, Triticum aestivum; identical to SEQ ID NO: 4797
  misc_feature (1)..(2073): useful for making plants with increased cold tolerance as described in USSN 12/863,773
  misc_feature (1)..(2073): Ceres CLONE ID no.922223

SEQ ID NO: 4823 - protein, 165 aa, Triticum aestivum
  misc_feature (1)..(165): useful for making plants with increased cold tolerance as described in USSN 12/863,773
  misc_feature (1)..(165): Ceres CLONE ID no.922223
  misc_feature (1)..(165): Bit score of 455.9 for HMM based on sequences of FIGURE 4 of USSN 12/863,773.
  misc_feature (1)..(165): Truncated
  misc_feature (1)..(165): Functional Homolog Of   Ceres SEEDLINE ID no.ME17294
MIEAMLPLLKPSPYGGRIVNVSSRLGRANGRRNKIGDAILREQLLTDDCLSEELIDGMVTKFLEQVKQNSWSSIEWPQMYTDYSVSKFAVNVYTRLMARRLSDRSEGQKIYINCFCPGWVKTAMTDWEGNISAEEGADTGVWLALLPQEQATIGKFYAERREISF

SEQ ID NO: 4824 - protein, 166 aa, Oryza sativa subsp. indica
  misc_feature (1)..(166): useful for making plants with increased cold tolerance as described in USSN 12/863,773
  misc_feature (1)..(166): Public GI ID no.125528967
  misc_feature (1)..(166): Bit score of 452.6 for HMM based on sequences of FIGURE 4 of USSN 12/863,773.
  misc_feature (1)..(166): Truncated
  misc_feature (1)..(166): Functional Homolog Of   Ceres SEEDLINE ID no.ME17294
MIEAMMPLMITSPHGGRIVNVSSRLGRVNGRRNRIGDPSLRERLLNDDHLSEELINEMVMKFLEQTKQDNWSSSNEWPQMYTDYSISKLAVNAYTRLLARRLLDRPEGQKIYINCFCPGWVKTAMTGWEGNISAEEGADTGVWLALVPQEQATIGKFFAERREISF

SEQ ID NO: 4825 - protein, 158 aa, Oryza sativa subsp. japonica
  misc_feature (1)..(158): useful for making plants with increased cold tolerance as described in USSN 12/863,773
  misc_feature (1)..(158): Public GI ID no.115442007
  misc_feature (1)..(158): Truncated
  misc_feature (1)..(158): Bit score of 417.1 for HMM based on sequences of FIGURE 4 of USSN 12/863,773.
  misc_feature (1)..(158): Functional Homolog Of   Ceres SEEDLINE ID no.ME17294
MITSPHGGRIVNVSSRLGRVNGRRNRIGDPSLRERLLNDDHLSEELINEMVMKFLEQTKQDNWSSGNEWPQMYTDYSISKLAVNAYTRLLARRLLDRPEGQKIYINCFCPGWVKTAMTGWEGNISAEEGADTGVWLALVPQEQATIGKFFAERREISF

SEQ ID NO: 4826 - DNA, 951 bp, Arabidopsis thaliana; identical to SEQ ID NO: 4806
  misc_feature (1)..(951): useful for making plants with increased cold tolerance as described in USSN 12/863,773
  misc_feature (1)..(951): Ceres ANNOT ID no.857222

SEQ ID NO: 4827 - protein, 165 aa, Arabidopsis thaliana
  misc_feature (1)..(165): useful for making plants with increased cold tolerance as described in USSN 12/863,773
  misc_feature (1)..(165): Ceres ANNOT ID no.857222
  misc_feature (1)..(165): Truncated
  misc_feature (1)..(165): Bit score of 401.6 for HMM based on sequences of FIGURE 4 of USSN 12/863,773.
  misc_feature (1)..(165): Functional Homolog Of   Ceres SEEDLINE ID no.ME17294
MTKAMIPLMRPSPHGARVVNVSSRLGRVNGRRNRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEEAVTGKFFAERREINF

SEQ ID NO: 4828 - DNA, 557 bp, Arabidopsis thaliana
  misc_feature (1)..(557): useful for making plants with increased cold tolerance as described in USSN 12/863,773
  misc_feature (1)..(557): Ceres SEEDLINE ID no. ME00572
  misc_feature (1)..(557): Inplanta Sequence
atcccaccgtttcttaagactctctctctctttctgttttctatttctctctctctcaaatgaaagagagagaagagctcccatggatgaaaatagcgagaccgaagtttctccaaggcattaaggaaaacataacctccgtgatgcatagagattattggatccgctgtgctgagacattgagtttttcttcggcattccagtttcaatgataaaggggtgttatcctatctgagcttttagtcggattttttcttttcaattattgtgttttatctagatgatgcatttcattattctctttttcttgaccttgtaaggccttttcttgaccttgtaagaccccatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcc

SEQ ID NO: 4829 - protein, 859 aa, Arabidopsis thaliana
  misc_feature (1)..(859): useful for making plants with increased cold tolerance as described in USSN 12/863,773
  misc_feature (1)..(859): Ceres LOCUS ID no. AT5G62000
  misc_feature (1)..(859): Is Acted Upon By Ceres SEEDLINE ID no. ME00572
  misc_feature (1)..(859): Bit score of 2157.8 for HMM based on sequences of FIGURE 5 of USSN  12/863,773.
  misc_feature (163)..(268): Pfam Name: B3 Pfam Description: B3 DNA binding domain
  misc_feature (290)..(372): Pfam Name: Auxin_resp Pfam Description: Auxin response factor
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 4830 - DNA, 2538 bp, Populus balsamifera subsp. trichocarpa
  misc_feature (1)..(2538): useful for making plants with increased cold tolerance as described in USSN 12/863,773
  misc_feature (1)..(2538): Ceres ANNOT ID no.1527370
atggcttcttcagagatttcagcgaaagctaacagtggaaacattagaggaggaggagagagcttcacttctggttacagtgaagccatggaagggcagaaaaatcattctactcatccaagttcagctagagttgtagatgctgaaacggcgctgtataatgagctatggcatgcttgtgctggtcctttagtgactgtacctcgtgaaggagatcgtgtgttttatttccctcaaggacatatagagcaggtggaggcatcaacgaatcaggtagcagaccagcagatgccgctgtataatcttctaccgaagatcttatgtcgtgtggttaatgttcagttgaaggctgaaccagatactgatgaggtgtttgcgcaagtgactctgcttcctgagcacaaccaagatgagagtgtgttggagaaggagcctcctccacctccaccaccgcgatttcatgtacattcattttgtaaaaccctgactgcttcggataccagtactcatggtggattttcggttcttagaagacatgcagatgaatgtcttccacctttggatatgtcaaggcagcctccaacacaggaattggttgccaaggatttgcatggaaatgaatggcgtttccgacacatttttcggggccaaccacggaggcacttgcttcagagtggatggagcgtgtttgttagctccaaaaggcttgttgcgggtgatgcgtttatatttctaagaggtgagaatggagaacttcgagttggtgttagacgtgcaatgagacagcagggtaatgttccatcatctgtcatatccagccacagcatgcatcttggggtgcttgctacagcatggcatgctgtttcaacggggaccctgttcactgtttattacaagccaaggacaagtcctgcagagttcattgtcccctttgatcaatacatggagtctgtcaagaataattattccatagggatgaggtttaaaatgagatttgaaggagaagaagctcctgagcaaagatttactggcactattgttggaattgaagatgccgatcccgggaggtggaagaattctaaatggaggtgccttaaggtgagatgggatgaaacttctaccatgcctcggccagagagagtttcaccatggaaaattgagcctgctctagcacctcctgcactaaatcctcttccattgcccaggcctaaaaggcctcgagcaaacatggtgccctcatcccctgactcctcagttcttactagagatgaccctccatcagcaagtggattttcaagggtcttgcaaggtcaagaattctcgaccttgagaggcacttttgcagagagcaatgagtccaatgctgctgaaaagtctgttatgtggccatcctcagcagatgatgagaagatcgatgtgttatctacttcaagaagatttggatcagagaggtggatgtcctctgcgaggcatgaaccaacctgcacagatttgctatctggctttgggacaaattctgattcattccatgggtttggtgccccgtttgttgaccaaactgccgtggctgctaatccaacgaagaaacacttgtcagatcaagggcagtttaacttgcttgccagcccgtggtccataatgtcctcgggtctcttgctaaagttgtcagagtcaaatacaaaggttccagtacaaggcagcgatgtaacatatcaagcacgggcaaatgtgtttagtgagtatcctgtgcttcaaggtcatagagttgagcagtcgcataaaaactggatgatgcatcccccgccatctcattttgataatcatgctaattcgagagagttaatgcccaaacctgttttgatgcaagaacatgattctggaaaatccctggaaggaaactgcaagctctttgggattcctttgaaaattagtaaacctgttgcaccagaggcagcagggaccacaatcacgatgaacgaaccactgagtcatatccaacctgtgagtcaccaacttacatttgaatctgatcagaagtcagaacaatccaaaggttcgaagatgactgatgaaaatgaaaacgagaaaccattccaagctggtcatttgcgaacaaaggacaaccatggaaaagcacaaaatggctcaaccaggagttgtacgaaggttcacaagcaggggattgcacttggtaggtctgttgatcttgccaagttcaataactatgatgagttgattgctgaattggacaggctgtttgaatttaatggtgaattaatggctccccaaaagaattggctgattgtgtacacagacgatgaggatgatatgatgcttgttggagatgatccctggcaggaatttgttggcatggttaggaagatagttatttacaccaaagaggaggcacagaagattaaaccaggcgccttgaattcaaagggcgttgagaatccaatggatatggagggtgaggatgatgccaaggaagccaaacatctgccacttccttcagcatgtagccctatgaattgttag

SEQ ID NO: 4831 - protein, 845 aa, Populus balsamifera subsp. trichocarpa
  misc_feature (1)..(845): useful for making plants with increased cold tolerance as described in USSN 12/863,773
  misc_feature (1)..(845): Ceres ANNOT ID no.1527370
  misc_feature (1)..(845): Bit score of 2089.3 for HMM based on sequences of FIGURE 5 of USSN  12/863,773.
  misc_feature (157)..(262): Pfam Name: B3 Pfam Description: B3 DNA binding domain
  misc_feature (284)..(366): Pfam Name: Auxin_resp Pfam Description: Auxin response factor
  misc_feature (1)..(845): Is Acted Upon By Ceres SEEDLINE ID no. ME00572
MASSEISAKANSGNIRGGGESFTSGYSEAMEGQKNHSTHPSSARVVDAETALYNELWHACAGPLVTVPREGDRVFYFPQGHIEQVEASTNQVADQQMPLYNLLPKILCRVVNVQLKAEPDTDEVFAQVTLLPEHNQDESVLEKEPPPPPPPRFHVHSFCKTLTASDTSTHGGFSVLRRHADECLPPLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAVSTGTLFTVYYKPRTSPAEFIVPFDQYMESVKNNYSIGMRFKMRFEGEEAPEQRFTGTIVGIEDADPGRWKNSKWRCLKVRWDETSTMPRPERVSPWKIEPALAPPALNPLPLPRPKRPRANMVPSSPDSSVLTRDDPPSASGFSRVLQGQEFSTLRGTFAESNESNAAEKSVMWPSSADDEKIDVLSTSRRFGSERWMSSARHEPTCTDLLSGFGTNSDSFHGFGAPFVDQTAVAANPTKKHLSDQGQFNLLASPWSIMSSGLLLKLSESNTKVPVQGSDVTYQARANVFSEYPVLQGHRVEQSHKNWMMHPPPSHFDNHANSRELMPKPVLMQEHDSGKSLEGNCKLFGIPLKISKPVAPEAAGTTITMNEPLSHIQPVSHQLTFESDQKSEQSKGSKMTDENENEKPFQAGHLRTKDNHGKAQNGSTRSCTKVHKQGIALGRSVDLAKFNNYDELIAELDRLFEFNGELMAPQKNWLIVYTDDEDDMMLVGDDPWQEFVGMVRKIVIYTKEEAQKIKPGALNSKGVENPMDMEGEDDAKEAKHLPLPSACSPMNC

SEQ ID NO: 4832 - DNA, 2637 bp, Populus balsamifera subsp. trichocarpa
  misc_feature (1)..(2637): useful for making plants with increased cold tolerance as described in USSN 12/863,773
  misc_feature (1)..(2637): Ceres ANNOT ID no.1473961
atggcttcttcagagatttcagcgaaagctaacagtggaaacattagaggaggaggagagagcttcacttctggttacagtgaagccatggaagggcagaaaaatcattctactcatccaagttcagctagagttgtagatgctgaaacggcgctgtataatgagctatggcatgcttgtgctggtcctttagtgactgtacctcgtgaaggagatcgtgtgttttatttccctcaaggacatatagagcaggtggaggcatcaacgaatcaggtagcagaccagcagatgccgctgtataatcttctaccgaagatcttatgtcgtgtggttaatgttcagttgaaggctgaaccagatactgatgaggtgtttgcgcaagtgactctgcttcctgagcacaaccaagatgagagtgtgttggagaaggagcctcctccacctccaccaccgcgatttcatgtacattcattttgtaaaaccctgactgcttcggataccagtactcatggtggattttcggttcttagaagacatgcagatgaatgtcttccacctttggatatgtcaaggcagcctccaacacaggaattggttgccaaggatttgcatggaaatgaatggcgtttccgacacatttttcggggtaatcatctcatactcgaacaatcaacttgcattcaagatgccagttgcttaatatgcacaatgatttcaatgccaggccaaccacggaggcacttgcttcagagtggatggagcgtgtttgttagctccaaaaggcttgttgcgggtgatgcgtttatatttctaagaggtgagaatggagaacttcgagttggtgttagacgtgcaatgagacagcagggtaatgttccatcatctgtcatatccagccacagcatgcatcttggggtgcttgctacagcatggcatgctgtttcaacggggaccctgttcactgtttattacaagccaaggacaagtcctgcagagttcattgtcccctttgatcaatacatggagtctgtcaagaataattattccatagggatgaggtttaaaatgagatttgaaggagaagaagctcctgagcaaagatttactggcactattgttggaattgaagatgccgatcccgggaggtggaagaattctaaatggaggtgccttaaggtgagatgggatgaaacttctaccatgcctcggccagagagagtttcaccatggaaaattgagcctgctctagcacctcctgcactaaatcctcttccattgcccaggcctaaaaggcctcgagcaaacatggtgccctcatcccctgactcctcagttcttactagagatggttcattcaaagtaactgcagaccctccatcagcaagtggattttcaagggtcttgcaaggtcaagaattctcgaccttgagaggcacttttgcagagagcaatgagtccaatgctgctgaaaagtctgttatgtggccatcctcagcagatgatgagaagatcgatgtgttatctacttcaagaagatttggatcagagaggtggatgtcctctgcgaggcatgaaccaacctgcacagatttgctatctggctttgggacaaattctgattcattccatgggtttggtgccccgtttgttgaccaaactgccgtggctgctaatccaacgaagaaacacttgtcagatcaagggcagtttaacttgcttgccagcccgtggtccataatgtcctcgggtctcttgctaaagttgtcagagtcaaatacaaaggttccagtacaaggcagcgatgtaacatatcaagcacgggcaaatgtgtttagtgagtatcctgtgcttcaaggtcatagagttgagcagtcgcataaaaactggatgatgcatcccccgccatctcattttgataatcatgctaattcgagagagttaatgcccaaacctgttttgatgcaagaacatgattctggaaaatccctggaaggaaactgcaagctctttgggattcctttgaaaattagtaaacctgttgcaccagaggcagcagggaccacaatcacgatgaacgaaccactgagtcatatccaacctgtgagtcaccaacttacatttgaatctgatcagaagtcagaacaatccaaaggttcgaagatgactgatgaaaatgaaaacgagaaaccattccaagctggtcatttgcgaacaaaggacaaccatggaaaagcacaaaatggctcaaccaggagttgtacgaaggttcacaagcaggggattgcacttggtaggtctgttgatcttgccaagttcaataactatgatgagttgattgctgaattggacaggctgtttgaatttaatggtgaattaatggctccccaaaagaattggctgattgtgtacacagacgatgaggatgatatgatgcttgttggagatgatccctggcaggaatttgttggcatggttaggaagatagttatttacaccaaagaggaggcacagaagattaaaccaggcgccttgaattcaaagggcgttgagaatccaatggatatggagggtgaggatgatgccaaggaagccaaacatctgccacttccttcagcatgtagccctatgaattgttag

SEQ ID NO: 4833 - protein, 852 aa, Populus balsamifera subsp. trichocarpa
  misc_feature (1)..(852): useful for making plants with increased cold tolerance as described in USSN 12/863,773
  misc_feature (1)..(852): Ceres ANNOT ID no.1473961
  misc_feature (1)..(852): Bit score of 2110.3 for HMM based on sequences of FIGURE 5 of USSN  12/863,773.
  misc_feature (157)..(262): Pfam Name: B3 Pfam Description: B3 DNA binding domain
  misc_feature (284)..(366): Pfam Name: Auxin_resp Pfam Description: Auxin response factor
  misc_feature (1)..(852): Is Acted Upon By Ceres SEEDLINE ID no. ME00572
MASSEISAKANSGNIRGGGESFTSGYSEAMEGQKNHSTHPSSARVVDAETALYNELWHACAGPLVTVPREGDRVFYFPQGHIEQVEASTNQVADQQMPLYNLLPKILCRVVNVQLKAEPDTDEVFAQVTLLPEHNQDESVLEKEPPPPPPPRFHVHSFCKTLTASDTSTHGGFSVLRRHADECLPPLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAVSTGTLFTVYYKPRTSPAEFIVPFDQYMESVKNNYSIGMRFKMRFEGEEAPEQRFTGTIVGIEDADPGRWKNSKWRCLKVRWDETSTMPRPERVSPWKIEPALAPPALNPLPLPRPKRPRANMVPSSPDSSVLTRDGSFKVTADPPSASGFSRVLQGQEFSTLRGTFAESNESNAAEKSVMWPSSADDEKIDVLSTSRRFGSERWMSSARHEPTCTDLLSGFGTNSDSFHGFGAPFVDQTAVAANPTKKHLSDQGQFNLLASPWSIMSSGLLLKLSESNTKVPVQGSDVTYQARANVFSEYPVLQGHRVEQSHKNWMMHPPPSHFDNHANSRELMPKPVLMQEHDSGKSLEGNCKLFGIPLKISKPVAPEAAGTTITMNEPLSHIQPVSHQLTFESDQKSEQSKGSKMTDENENEKPFQAGHLRTKDNHGKAQNGSTRSCTKVHKQGIALGRSVDLAKFNNYDELIAELDRLFEFNGELMAPQKNWLIVYTDDEDDMMLVGDDPWQEFVGMVRKIVIYTKEEAQKIKPGALNSKGVENPMDMEGEDDAKEAKHLPLPSACSPMNC

SEQ ID NO: 4834 - protein, 859 aa, Arabidopsis thaliana
  misc_feature (1)..(859): useful for making plants with increased cold tolerance as described in USSN 12/863,773
  misc_feature (1)..(859): Public GI ID no.62319853
  misc_feature (1)..(859): Bit score of 2155.3 for HMM based on sequences of FIGURE 5 of USSN  12/863,773.
  misc_feature (163)..(268): Pfam Name: B3 Pfam Description: B3 DNA binding domain
  misc_feature (290)..(372): Pfam Name: Auxin_resp Pfam Description: Auxin response factor
  misc_feature (1)..(859): Is Acted Upon By Ceres SEEDLINE ID no. ME00572
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTVSCRSEEEAVVGEGSDAKDAKSASNPSLSSAGNS

SEQ ID NO: 4835 - protein, 859 aa, Arabidopsis thaliana
  misc_feature (1)..(859): useful for making plants with increased cold tolerance as described in USSN 12/863,773
  misc_feature (1)..(859): Public GI ID no.62319903
  misc_feature (1)..(859): Bit score of 2157 for HMM based on sequences of FIGURE 5 of USSN 12/863,773.
  misc_feature (163)..(268): Pfam Name: B3 Pfam Description: B3 DNA binding domain
  misc_feature (290)..(372): Pfam Name: Auxin_resp Pfam Description: Auxin response factor
  misc_feature (1)..(859): Is Acted Upon By Ceres SEEDLINE ID no. ME00572
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPALNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 4836 - protein, 848 aa, Brassica napus
  misc_feature (1)..(848): useful for making plants with increased cold tolerance as described in USSN 12/863,773
  misc_feature (1)..(848): Public GI ID no.47716275
  misc_feature (1)..(848): Bit score of 2099.9 for HMM based on sequences of FIGURE 5 of USSN  12/863,773.
  misc_feature (158)..(263): Pfam Name: B3 Pfam Description: B3 DNA binding domain
  misc_feature (285)..(367): Pfam Name: Auxin_resp Pfam Description: Auxin response factor
  misc_feature (1)..(848): Is Acted Upon By Ceres SEEDLINE ID no. ME00572
MASSEVSMKGNRGRGENFSSAGYSDPTVAGEAQKTQSNRSVAAERVVDPEAALYRELWHACAGPLVTVPRQDDRVFYFPQGHIEQVEASTNQAAEQQMPLYDLPSKILCRVINVDLKAEADTDEVYAQITLLPEPVQDENSIEKEAPPPPPPRFQVHSFCKTLTASDTSTHGGFSVLRRHADECLPPLDMSRQPPTQELVAKDLHASEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYTESVKINYSIGMRFKMRFEGEEAPEQRFTGTIVGIEDSDPTRWAKSKWRSLKVRWDETTSIPRPDRVSPWKIEPALSPPALSPVPMPRPKRPRSNLASSTPDSSMRIREGSSKANMDPLPASGLSRVLQGQEYPTLRTKHVESVECDAPENSVVWQSSTDDDKVDVISASRRYENWISSGRHGPTCTDLLSGFGTNIEPPHGHQIPFYDRLSSPPSVAARKILSDQDGKFEYLANQWMMHSGLSLKLHESPKVPAASDASFQGIGNPNYGEYALPRAVTTENAAGNWPIRPRALNYFEEAVHAQAREHVTKRPAVVQEEAAKPRDGNCRLFGIPLVNNVNGTDTTLSQRNNLNDPAGPTQMASPKVQDLSDQSKGSKSTNDHREQGRPFPVSKPHPKDVQTKTNSCRSCTKVQKQGIALGRSVDLSKFQNYEELVTELDRLFEFNGELMAPKKDWLIVYTDDENDMMLVGDDPWQEFCCMVRKIFIYTKEEVRKMNPGTLCCRNEEEPVVGEGSDAKDAKSASNPSLSSAGNS

SEQ ID NO: 4837 - protein, 853 aa, Oryza sativa subsp. indica
  misc_feature (1)..(853): useful for making plants with increased cold tolerance as described in USSN 12/863,773
  misc_feature (1)..(853): Public GI ID no.125534572
  misc_feature (1)..(853): Bit score of 2096 for HMM based on sequences of FIGURE 5 of USSN 12/863,773.
  misc_feature (148)..(253): Pfam Name: B3 Pfam Description: B3 DNA binding domain
  misc_feature (275)..(357): Pfam Name: Auxin_resp Pfam Description: Auxin response factor
  misc_feature (1)..(853): Is Acted Upon By Ceres SEEDLINE ID no. ME00572
MATAEVGGGGGEGDAAAAAVARAGGGGGGGGGGGEDALFTELWSACAGPLVTVPRVGEKVFYFPQGHIEQVEASTNQVGEQRMQLYNLPWKILCEVMNVELKAEPDTDEVYAQLTLLPELKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKRNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGWMQMSKPESYSEMLSGFQPPKDVQTPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 4838 - protein, 857 aa, Oryza sativa subsp. indica
  misc_feature (1)..(857): useful for making plants with increased cold tolerance as described in USSN 12/863,773
  misc_feature (1)..(857): Public GI ID no.26251300
  misc_feature (1)..(857): Bit score of 2070.6 for HMM based on sequences of FIGURE 5 of USSN  12/863,773.
  misc_feature (147)..(252): Pfam Name: B3 Pfam Description: B3 DNA binding domain
  misc_feature (274)..(356): Pfam Name: Auxin_resp Pfam Description: Auxin response factor
  misc_feature (1)..(857): Is Acted Upon By Ceres SEEDLINE ID no. ME00572
MATAEVGGGGGEGDAAAAAVARAGGGGGGGGGGEDALFTELWSACAGPLVTVPRVGEKEFYFPQGHIEQVEASTNQVGEQRMQLYNLPWKILCEVMNVELKAEPDTDEVYAQLTLLPELKRQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKRNYSIGMRFKMRFESEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQTPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGLMMPNSHMDDTQPRLIKPKPLVVAHGDVQKAKGASCKLFGIHLDSPAKSEPSKSPSSVVYDGTPQTPGATEWRRPDVTEVEKCSDPSKAMKPLDTPQPDSVPEKPSSQQASSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNLRSEDSHANSMERGSVGREMRGCLSTSSLNSENC

SEQ ID NO: 4839 - protein, 853 aa, Oryza sativa subsp. indica
  misc_feature (1)..(853): useful for making plants with increased cold tolerance as described in USSN 12/863,773
  misc_feature (1)..(853): Public GI ID no.125528952
  misc_feature (1)..(853): Bit score of 1880.3 for HMM based on sequences of FIGURE 5 of USSN  12/863,773.
  misc_feature (123)..(228): Pfam Name: B3 Pfam Description: B3 DNA binding domain
  misc_feature (250)..(331): Pfam Name: Auxin_resp Pfam Description: Auxin response factor
  misc_feature (1)..(853): Is Acted Upon By Ceres SEEDLINE ID no. ME00572
MAPPPPPQGSSTGDPLYDELWHACAGPLVTVPRVGDLVFYFPQGHIEQVEASMNQVADSQMRLYDLPSKLLCRVLNVELKAEQDTDEVYAQVMLMPEPEQNEMAVEKTTPTSGPVQARPPVRSFCKTLTASDTSTHGGFSVLRRHADECLPPLDMTQSPPTQELVAKDLHSMDWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSVGMRFRMRFEGEEAPEQRFTGTIIGSENLDPVWPESSWRSLKVRWDEPSTIPRPDRVSPWKIEPASSPPVNPLPLSRVKRPRPNAPPASPESPILTKEAATKVDTDPAQAQRSQNSTVLQGQEQMTLRSNLTESNDSDVTAHKPMMWSPSPNAAKAHPLTFQQRPPMDNWMQLGRRETDFKDVRSGSQSFGDSPGFFMQNFDEAPNRLTSFKNQFQDQGSARHFSDPYYYVSPQPSLTVESSTQMHTDSKELHFWNGQSTVYGNSRDRPQNFRFEQNSSSWLNQSFARPEQPRVIRPHASIAPVELEKTEGSGFKIFGFKVDTTNAPNNHLSSPMAATHEPMLQTPSSLNQLQPVQTDCIPEVSVSTAGTATENEKSGQQAQQSSKDVQSKTQVASTRSCTKHMKFFLLVVDMLKFSFCKFLAKSQFYPLCGMVHKQGVALGRSVDLSKFSNYDELKAELDKMFEFDGELVSSNKNWQIVYTDNEGDMMLVGDDPWEEFCSIVRKIYIYTKEEVQKMNSKSNAPRKDDSSENEKGSVKRDDTRDGGVLQKAASASVLSILRYSS

SEQ ID NO: 4840 - protein, 808 aa, Oryza sativa subsp. japonica
  misc_feature (1)..(808): useful for making plants with increased cold tolerance as described in USSN 12/863,773
  misc_feature (1)..(808): Public GI ID no.115441981
  misc_feature (1)..(808): Bit score of 1951.3 for HMM based on sequences of FIGURE 5 of USSN  12/863,773.
  misc_feature (128)..(233): Pfam Name: B3 Pfam Description: B3 DNA binding domain
  misc_feature (255)..(336): Pfam Name: Auxin_resp Pfam Description: Auxin response factor
  misc_feature (1)..(808): Is Acted Upon By Ceres SEEDLINE ID no. ME00572
MPPAAMAPPPPPQGSSTGDPLYDELWHACAGPLVTVPRVGDLVFYFPQGHIEQVEASMNQVADSQMRLYDLPSKLLCRVLNVELKAEQDTDEVYAQVMLMPEPEQNEMAVEKTTPTSGPVQARPPVRSFCKTLTASDTSTHGGFSVLRRHADECLPPLDMTQSPPTQELVAKDLHSMDWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSVGMRFRMRFEGEEAPEQRFTGTIIGSENLDPVWPESSWRSLKVRWDEPSTIPRPDRVSPWKIEPASSPPVNPLPLSRVKRPRPNAPPASPESPILTKEAATKVDTDPAQAQRSQNSTVLQGQEQMTLRSNLTESNDSDVTAHKPMMWSPSPNAAKAHPLTFQQRPPMDNWMQLGRRETDFKDVRSGSQSFGDSPGFFMQNFDEAPNRLTSFKNQFQDQGSARHFSDPYYYVSPQPSLTVESSTQMHTDSKELHFWNGQSTVYGNSRDRPQNFRFEQNSSSWLNQSFARPEQPRVIRPHASIAPVELEKTEGSGFKIFGFKVDTTNAPNNHLSSPMAATHEPMLQTPSSLNQLQPVQTDCIPEVSVSTAGTATENEKSGQQAQQSSKDVQSKTQVASTRSCTKVHKQGVALGRSVDLSKFSNYDELKAELDKMFEFDGELVSSNKNWQIVYTDNEGDMMLVGDDPWEEFCSIVRKIYIYTKEEVQKMNSKSNAPRKDDSSENEKGHLPMPNKSDN

SEQ ID NO: 4841 - protein, 836 aa, Oryza sativa subsp. japonica
  misc_feature (1)..(836): useful for making plants with increased cold tolerance as described in USSN 12/863,773
  misc_feature (1)..(836): Public GI ID no.23893346
  misc_feature (1)..(836): Bit score of 2065.7 for HMM based on sequences of FIGURE 5 of USSN  12/863,773.
  misc_feature (131)..(236): Pfam Name: B3 Pfam Description: B3 DNA binding domain
  misc_feature (258)..(340): Pfam Name: Auxin_resp Pfam Description: Auxin response factor
  misc_feature (1)..(836): Is Acted Upon By Ceres SEEDLINE ID no. ME00572
MATAEVGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFWSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 4842 - protein, 852 aa, Oryza sativa subsp. japonica
  misc_feature (1)..(852): useful for making plants with increased cold tolerance as described in USSN 12/863,773
  misc_feature (1)..(852): Public GI ID no.115485689
  misc_feature (1)..(852): Bit score of 2092.5 for HMM based on sequences of FIGURE 5 of USSN  12/863,773.
  misc_feature (147)..(252): Pfam Name: B3 Pfam Description: B3 DNA binding domain
  misc_feature (274)..(356): Pfam Name: Auxin_resp Pfam Description: Auxin response factor
  misc_feature (1)..(852): Is Acted Upon By Ceres SEEDLINE ID no. ME00572
MATAEVGGGGGEGDAAAAAVARGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 4843 - protein, 853 aa, Oryza sativa subsp. japonica
  misc_feature (1)..(853): useful for making plants with increased cold tolerance as described in USSN 12/863,773
  misc_feature (1)..(853): Public GI ID no.108864435
  misc_feature (1)..(853): Bit score of 2094.3 for HMM based on sequences of FIGURE 5 of USSN  12/863,773.
  misc_feature (148)..(253): Pfam Name: B3 Pfam Description: B3 DNA binding domain
  misc_feature (275)..(357): Pfam Name: Auxin_resp Pfam Description: Auxin response factor
  misc_feature (1)..(853): Is Acted Upon By Ceres SEEDLINE ID no. ME00572
MATAEVGGGGGEGDAAAAAVARAGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 4844 - protein, 719 aa, Oryza sativa subsp. japonica
  misc_feature (1)..(719): useful for making plants with increased cold tolerance as described in USSN 12/863,773
  misc_feature (1)..(719): Public GI ID no.50511471
  misc_feature (1)..(719): Bit score of 1618.2 for HMM based on sequences of FIGURE 5 of USSN  12/863,773.
  misc_feature (141)..(246): Pfam Name: B3 Pfam Description: B3 DNA binding domain
  misc_feature (268)..(349): Pfam Name: Auxin_resp Pfam Description: Auxin response factor
  misc_feature (1)..(719): Is Acted Upon By Ceres SEEDLINE ID no. ME00572
MTGIDLNTVEEDEEEAAEEVAANGSSPAPARAGAVCLELWHACAGPVAPLPRKGGVVVYLPQGHLEHLGDAPAAAAAAAAVPPHVFCRVVDVTLLADAATDEVYAQLSLVPEKEEVARRADDGEGEDGDGMKQRFARMPHMFCKTLTASDTSTHGGFSVPRRAAEDCFPPLDYSQQRPSQELVAKDLHSTEWRFRHIYRGQPRRHLLTTGWSAFVNKKKLVSGDAVLFLRGDDGELRLGVRRAAQLKNGSAFPALYNQCSNLGTLANVAHAVATESVFNIYYNPRLSQSEFIVPYWKFMKSLSQPFSVGLRFKMRYESEDATERRYTGIITGSGDTDPMWHGSKWKCLLVRWDDDAEFRRPNRVSPWEIELTSSVSGSHLSTPHSKRLKPCLPHVNPEYMVPRGGGCPDFAESAQFHKVLQGQELLGFKSHGGTAAATSQPCEARHLQYIDERSCSSDASNSILGVPRLGDRAPLGNPGFSYHCSGFGESHRLQKVLQGQELFRPYRGTLVDASMGSNGFHQQDSPRAPGVVNKWQAQLHGRAAFHGPPALALPSQSSSPPSVLMFQQANSKMPRLEFGHGQLDKHENDRRVRFGPSEGIERREQRIPLQPYPTSGEVIDGQVTVEKSHSPGRHGKDGPDNKAVGTNSCKIFGISLTEKVPAREELDDGDANYSLQSLKQVPKSLGNSCATMVAEYQGDGGTDDSDIFILDVGVGALIM

SEQ ID NO: 4845 - protein, 608 aa, Arabidopsis thaliana
  misc_feature (1)..(608): useful for making plants with increased cold tolerance as described in USSN 12/863,773
  misc_feature (1)..(608): Ceres LOCUS ID no. At2g33860
  misc_feature (1)..(608): Bit score of 1320.6 for HMM based on sequences of FIGURE 5 of USSN  12/863,773.
  misc_feature (158)..(263): Pfam Name: B3 Pfam Description: B3 DNA binding domain
  misc_feature (285)..(367): Pfam Name: Auxin_resp Pfam Description: Auxin response factor
  misc_feature (1)..(608): Is Acted Upon By Ceres SEEDLINE ID no. ME00572
MGGLIDLNVMETEEDETQTQTPSSASGSVSPTSSSSASVSVVSSNSAGGGVCLELWHACAGPLISLPKRGSLVLYFPQGHLEQAPDFSAAIYGLPPHVFCRILDVKLHAETTTDEVYAQVSLLPESEDIERKVREGIIDVDGGEEDYEVLKRSNTPHMFCKTLTASDTSTHGGFSVPRRAAEDCFPPLDYSQPRPSQELLARDLHGLEWRFRHIYRGQPRRHLLTTGWSAFVNKKKLVSGDAVLFLRGDDGKLRLGVRRASQIEGTAALSAQYNQNMNHNNFSEVAHAISTHSVFSISYNPKASWSNFIIPAPKFLKVVDYPFCIGMRFKARVESEDASERRSPGIISGISDLDPIRWPGSKWRCLLVRWDDIVANGHQQRVSPWEIEPSGSISNSGSFVTTGPKRSRIGFSSGKPDIPVSEGIRATDFEESLRFQRVLQGQEIFPGFINTCSDGGAGARRGRFKGTEFGDSYGFHKVLQGQETVPAYSITDHRQQHGLSQRNIWCGPFQNFSTRILPPSVSSSPSSVLLTNSNSPNGRLEDHHGGSGRCRLFGFPLTDETTAVASATAVPCVEGNSMKGASAVQSNHHHSQGRDIYAMRDMLLDIAL

SEQ ID NO: 4846 - DNA, 1995 bp, Populus balsamifera subsp. trichocarpa
  misc_feature (1)..(1995): useful for making plants with increased cold tolerance as described in USSN 12/863,773
  misc_feature (1)..(1995): Ceres ANNOT ID no.1536494
atggtgggtatgatagatctcaacactattgaagaagatgaaactacaccgtcttgtgggtctttatcttctccatcatcatcctctgctgcttctgctttgagtgcttctggctctggttctagtacctcttctgtttgtttggagctttggcatgcttgtgctggcccactaatatctttgccaaagagagggagtgttgttgtgtatttccctcaaggccacttggaacaactccctgatttgcctcttgcagtttatgatctcccttctcatgtcttctgtcgagttgttgatgtcaagctccatgtctccctggttcctgagagtgaggaaattgagcagaagttgagggaggggatatttgagggggatggtgaggaggaggatggtgaagccactgtgaagatgacaacaccccatatgttctgtaagaccctaactgcttctgacactagcactcatggaggcttttcagtccctcgtcgagctgctgaggactgcttccctcctctggattatactcaacaaaggccttcacaagagcttgtggcaaaggatcttcatggctctgagtggaagtttcgacatatctacaggggtcagccacggaggcatttgctcactactggatggagtgcgtttgtcaataagaaaaaacttgtctctggggatgccgttctctttctcaggggtgaggatggggaattgagactgggagttcgaagagcagcacaagttaaatgtggccctacatttccagctcaatggaatcatcagctgaatcagatctctcctggggatgtagctaatgctatttctactagaagttttttccacatttactacaatccaagggccagctcatcagagttcataataccttttaataaattcttgaagagccttgatcaatccttctcttctggaatgagattcaaaatgcgttttgaaacagaagatgcagcagagagaagatacactggaataataactggagtcagtgagctagatcctgctagatggcctggttcaaaatggaaatgcctgttggtaaggtgggatgatagggaggctaacaggctcagcagggtttctccttgggaagttgagccttctggttctggttctatttccagctccaataactttatggcacctggtttgaagaggagcaggtctggattgccttcatcaaaggcagaatttccaattcctgatgggataggagcaccaggctttagggaatcttcaaggtcccaggaggtcttgcaaggaagtggtatcagagactcgattgccacttcaaataactcctacaagggcataggctttaacgaatcttatagattccataaggtcttccaaggtcaagaaatttttccaagctcaccatatggaagaatcccaaatgctaatgaggctcgtgaaaattgtagtcttggattctctgatggtgtccaaaggtcaagctcaagaaatggatggtctacattgatgcagggctataatactcaaattcgacctcctgcacaagtatcatcaccatcttcggtgttaatgtttcaacatgccagcaatccagttccaaagcgatcttccaattttaatttcaatgatcatgtgcagcagacagctaccacccgaagttggttttgtggtcctgaaatgcagggggggaatttcaagttgtctgcacattctgagcccagtgtaaaaagagacggccaatggagcaatagtccttttggtctgtcccatgagcatcttcaacatggcgtttcacaacctattgtagctcaatcagcctttaggggtagtcaagatttggtgtcgtgcaaaagcagctgcagactctttggtttctcattgactgaggataaatgccttgttaataaggaggacaatatgaccttaataacatctccattgaatcctggatcctcctttctgcctcgcgccggagagcacttccatcaaagcctccagcaataa

SEQ ID NO: 4847 - protein, 664 aa, Populus balsamifera subsp. trichocarpa
  misc_feature (1)..(664): useful for making plants with increased cold tolerance as described in USSN 12/863,773
  misc_feature (1)..(664): Ceres ANNOT ID no.1536494
  misc_feature (1)..(664): Bit score of 802.9 for HMM based on sequences of FIGURE 5 of USSN 12/863,773.
  misc_feature (142)..(247): Pfam Name: B3 Pfam Description: B3 DNA binding domain
  misc_feature (269)..(351): Pfam Name: Auxin_resp Pfam Description: Auxin response factor
  misc_feature (1)..(664): Is Acted Upon By Ceres SEEDLINE ID no. ME00572
MVGMIDLNTIEEDETTPSCGSLSSPSSSSAASALSASGSGSSTSSVCLELWHACAGPLISLPKRGSVVVYFPQGHLEQLPDLPLAVYDLPSHVFCRVVDVKLHVSLVPESEEIEQKLREGIFEGDGEEEDGEATVKMTTPHMFCKTLTASDTSTHGGFSVPRRAAEDCFPPLDYTQQRPSQELVAKDLHGSEWKFRHIYRGQPRRHLLTTGWSAFVNKKKLVSGDAVLFLRGEDGELRLGVRRAAQVKCGPTFPAQWNHQLNQISPGDVANAISTRSFFHIYYNPRASSSEFIIPFNKFLKSLDQSFSSGMRFKMRFETEDAAERRYTGIITGVSELDPARWPGSKWKCLLVRWDDREANRLSRVSPWEVEPSGSGSISSSNNFMAPGLKRSRSGLPSSKAEFPIPDGIGAPGFRESSRSQEVLQGSGIRDSIATSNNSYKGIGFNESYRFHKVFQGQEIFPSSPYGRIPNANEARENCSLGFSDGVQRSSSRNGWSTLMQGYNTQIRPPAQVSSPSSVLMFQHASNPVPKRSSNFNFNDHVQQTATTRSWFCGPEMQGGNFKLSAHSEPSVKRDGQWSNSPFGLSHEHLQHGVSQPIVAQSAFRGSQDLVSCKSSCRLFGFSLTEDKCLVNKEDNMTLITSPLNPGSSFLPRAGEHFHQSLQQ

SEQ ID NO: 4848 - protein, 608 aa, Arabidopsis thaliana
  misc_feature (1)..(608): useful for making plants with increased cold tolerance as described in USSN 12/863,773
  misc_feature (1)..(608): Public GI ID no.2245390
  misc_feature (1)..(608): Bit score of 1323.9 for HMM based on sequences of FIGURE 5 of USSN  12/863,773.
  misc_feature (158)..(263): Pfam Name: B3 Pfam Description: B3 DNA binding domain
  misc_feature (285)..(367): Pfam Name: Auxin_resp Pfam Description: Auxin response factor
  misc_feature (1)..(608): Is Acted Upon By Ceres SEEDLINE ID no. ME00572
MGGLIDLNVMETEEDETQTQTPSSASGSVSPTSSSSASVSVVSSNSAGGGVCLELWHACAGPLISLPKRGSLVLYFPQGHLEQAPDFSAAIYGLPPHVFCRILDVKLHAETTTDEVYAQVSLLPESEDIERKVREGIIDVDGGEEDYEVLKRSNTPHMFCKTLTASDTSTHGGFSVPRRAAEDCFPPLDYSQPRPSQELLARDLHGLEWRFRHIYRGQPRRHLLTTGWSAFVNKKKLVSGDAVLFLRGDDGKLRLGVRRASQIEGTAALSAQYNQNMNHNNFSEVAHAISTHSVFSISYNPKASWSNFIIPAPKFLKVVDYPFCIGMRFKARVESEDASERRSPGIISGISDLDPIRWPGSKWRCLLVRWDDIVANGHQQRVSPWEIEPSGSISNSGSFVTTGPKRSRIGFSSGKPDIPVSEGIRATDFEESLRFQRVLQGQEIFPGFINTCSDGGAGARRGRFKGTEFGDSYGFHKVLQGQETVPAYSITDHRQQHGLSQRNIWCGPFQNFSTRILPPSVSSSPSSVLFTNSNSPNGRLEDHHGGSGRCRLFGFPLTDETTAVASATAVPCVEGNSMKGASAVQSNHHHSQGRDIYAMRDMLLDIAL

SEQ ID NO: 4849 - protein, 608 aa, Arabidopsis thaliana
  misc_feature (1)..(608): useful for making plants with increased cold tolerance as described in USSN 12/863,773
  misc_feature (1)..(608): Public GI ID no.3228517
  misc_feature (1)..(608): Bit score of 1320.4 for HMM based on sequences of FIGURE 5 of USSN  12/863,773.
  misc_feature (158)..(263): Pfam Name: B3 Pfam Description: B3 DNA binding domain
  misc_feature (285)..(367): Pfam Name: Auxin_resp Pfam Description: Auxin response factor
  misc_feature (1)..(608): Is Acted Upon By Ceres SEEDLINE ID no. ME00572
MGGLIDLNVMETEEDETQTQTPSSASGSVSPTSSSSASVSVVSSNSAGGGVCLELWHACAGPLISLPKRGSLVLYFPQGHLEQAPDFSAAIYGLPPHVFCRILDVKLHAETTTDEVYAQVSLLPESEDIERKVREGIIDVDGGEEDYEVLKRSNTPHMFCKTLTASDTSTHGGFSVPRRAAEDCFPPLDYSQPRPSQELLARDLHGLEWRFRHIYRGQPRRHLLTTGWSAFVNKKKLVSGDAVLFLRGDDGKLRLGVRRASQIEGTAALSAQYNQNMNHNNFSEVAHAISTHSVFSISYNPKASWSNFIIPAPKFLKVVDYPFCIGMRFKARVESEDASERRSPGIISGISDLDPIRWPGSKWRCLLVRWDDIVANGHQQRVSPWEIEPSGSISNSGSFVTTGPKRSRIGISSGKPDIPVSEGIRATDFEESLRFQRVLQGQEIFPGFINTCSDGGAGARRGRFKGTEFGDSYGFHKVLQGQETVPAYSITDHRQQHGLSQRNIWCGPFQNFSTRILPPSVSSSPSSVLLTNSNSPNGRLEDHHGGSGRCRLFGFPLTDETTAVASATAVPCVEGNSMKGASAVQSNHHHSQGRDIYAMRDMLLDIAL

SEQ ID NO: 4850 - DNA, 2420 bp, Triticum aestivum
  misc_feature (1)..(2420): useful for making plants with increased cold tolerance as described in USSN 12/863,773
  misc_feature (1)..(2420): Ceres CLONE ID no.827306
acgcctcacgcctcacgcccgcgtcataaaatcgtgggcgactcgtgtcccagtcccagcaggctcagccacagcccacagcgacgcggcagcggcagcaggaacagcaacagcgaccttgcttcccgcgcgcggcagccgagggaggggaggaggagatcgaggggggcaagcggggcagggcggcatggggacggggggctagaacaaggagatggctgcagagcgacgccctcgggggcattaatggggccctccctctgctccacatcctgctgctcccacatcctccccgcggccgcggttgattcctcgcccgcctacttttaaccgcgcccccccttttccggacgggacggctgggctgtgggcgggcgccatgggcatcgatctcaacgcggcggacgagcctggcaaggcggcggcggtgtcggtgtgccgggacctgtggcacgcctgcgcggggccggtcgtggcgctgccgcgccggggcagcgccgtcgtctacctgccgcaggcgcacctcgccgcggccggcggcgggggggacgtgccggtggccctgccgccgcatgtggcgtgccgcgtggtggacgtcgagctatgcgcggatccggcgaccgacgaggtctacgcgcggctggctatggtggcggagggcgagatctttgagaagaacatgggaggtggtcggtttgaaggggaagatgacatggaagatggcgatggagaaaggaagtcccggatgctgcacatgttctgcaagacactaacagcctctgacacaagcacacacgggggattctctgttccccgccgtgctgccgaggactgtttccccccactggactaccagcagatcaggccttcccaagagcttgttgcaaaggatttgcatggagcgaagtggaggttccgccatatctatagaggtcaaccacgtaggcatcttttaacgactggatggagttcatttgtcaataaaaagaaacttgtctctggggatgcagtcttatttctccgtggtgatgatggtgaactacgacttggtgtaaggagagccattcagcttaaaaatgaggcccttctgaaagctttcaatagcaacagctcaaagatacacacactgtctgctgtggctaattccttgaaacatagaagtgtttttcacatctgttacaatccaagggctgctgcatccgaatttattgttccgtactggaagttcctgaagagcctgaatcgtccattttgtattggaatgaggtttaagattcagtatgggagtgaagatgttaatgagaggcgatctggaatgattacaggtattaatgaagtagaccccattaggtggactggttcaaaatggaaaagcctgcaggtaagatgggaggatggcaccgactgtaatagccaaaatagactatcgccatgggatatcgagatagttggtggctcggtctctattgcccagtctctgtcagcatccagttctaaacgaactaaactgtgccctcagggcaatgtggacgtcccaactctgtatgggaatgttcgtccggactccgtgggagctgataaactccccagggtcttgcaaggtcaagaattgatgggttctggaactcatcgttttacatgtcctcctcagccaggtggcgccacagaattccggcgttctgatggtacggggttccttactgatacacgaagctgcttgctgagtggtccagcaagcaggcttccacctcaaagctcctatttcgcctaccaacctgtaggcttcggtgaatccgttgggttcccggaggtcttgcaaggtcaagaagtttgtcagacggttcctctgtaccaaggaatggtgtctgatacatgttccgctaaagcgggatacgggatgtacaattacatgcgcacctcgtctgccatgaacggagggttttcatctgcacctcagggttatcctctctccctgtctactccgccccgagcagtggcggcttcgccctcatccgcagcggttccaccacagctttggctggcaagcaagagcaatgaagaagctgcgaatggcagccagcttaacccatttggaattcgaaaggttcctggtgatggtgctgctaagcttggtgatggtgctgctaagcttggatctgatggaaggaaggttgccagaaccagttgcatgcttttcgggttttccttgaccgagaagatgttgccaacggaagaagactctgccaaggaagggaaccatgaagtcgactgtcagaatccgcggatgctagacttgtttggatacaaccgcgccactcccggcactcttcacgccctctgcgccgctcccctgggaatatgatgccactccagttccagtatgatccaagtactttgtagtgctctttctaagaaacttt

SEQ ID NO: 4851 - protein, 660 aa, Triticum aestivum
  misc_feature (1)..(660): useful for making plants with increased cold tolerance as described in USSN 12/863,773
  misc_feature (1)..(660): Ceres CLONE ID no.827306
  misc_feature (1)..(660): Bit score of 1417.6 for HMM based on sequences of FIGURE 5 of USSN  12/863,773.
  misc_feature (126)..(231): Pfam Name: B3 Pfam Description: B3 DNA binding domain
  misc_feature (253)..(334): Pfam Name: Auxin_resp Pfam Description: Auxin response factor
  misc_feature (1)..(660): Is Acted Upon By Ceres SEEDLINE ID no. ME00572
MGIDLNAADEPGKAAAVSVCRDLWHACAGPVVALPRRGSAVVYLPQAHLAAAGGGGDVPVALPPHVACRVVDVELCADPATDEVYARLAMVAEGEIFEKNMGGGRFEGEDDMEDGDGERKSRMLHMFCKTLTASDTSTHGGFSVPRRAAEDCFPPLDYQQIRPSQELVAKDLHGAKWRFRHIYRGQPRRHLLTTGWSSFVNKKKLVSGDAVLFLRGDDGELRLGVRRAIQLKNEALLKAFNSNSSKIHTLSAVANSLKHRSVFHICYNPRAAASEFIVPYWKFLKSLNRPFCIGMRFKIQYGSEDVNERRSGMITGINEVDPIRWTGSKWKSLQVRWEDGTDCNSQNRLSPWDIEIVGGSVSIAQSLSASSSKRTKLCPQGNVDVPTLYGNVRPDSVGADKLPRVLQGQELMGSGTHRFTCPPQPGGATEFRRSDGTGFLTDTRSCLLSGPASRLPPQSSYFAYQPVGFGESVGFPEVLQGQEVCQTVPLYQGMVSDTCSAKAGYGMYNYMRTSSAMNGGFSSAPQGYPLSLSTPPRAVAASPSSAAVPPQLWLASKSNEEAANGSQLNPFGIRKVPGDGAAKLGDGAAKLGSDGRKVARTSCMLFGFSLTEKMLPTEEDSAKEGNHEVDCQNPRMLDLFGYNRATPGTLHALCAAPLGI

SEQ ID NO: 4852 - DNA, 2339 bp, Zea mays
  misc_feature (1)..(2339): useful for making plants with increased cold tolerance as described in USSN 12/863,773
  misc_feature (1)..(2339): Ceres CLONE ID no.1598488
cctgtacgccgtcccgcttcgcttcggagaggtcgctgcctgccatcaacgttccctcgctggtagagtagaggtagacccaccgacccccagtactagtcgggagagagatggggattgatctcaacgccgtgggggaggacgacccggcgggcgcggtgtgcgcggagctgtggcacgcgtgcgcgggggctggagtggcgctgccgcggcggggcagcgccgtggtgtacctgcctcaggcgcacctcgcggcgggcggctgcgacggtggtgggatgtcggcgccggccccgccgcgcgtgccgccgcacgtggtgtgtcgcgtcgtcgacgtcgagctacgcgcggatgcggccacggacgaggtgtacgcgcggcttgcgctggtggcgatggatacgatgtttggccgaaacatcaatgatggtgaaactgaagagaagaatggcgaggaagaggatggcgacggagaaaagaagcacgcatcacacatgttctgcaagacactcacagcttctgataccagcacacatgggggattctctgttccacggcgagctgcagaggactgctttccacccttggactatgagcagcttaggccttcccaagagcttattgccaaggatttgcatggcatgaaatggaggttccgtcatatctatagaggtcaacctcgaaggcatcttctgacaactggatggagttcatttatcaataagaagaaactagtctcaggggatgcagtcttgtttcttagaggtaatgatggtgagctaagattgggtgtgaggagagcagttcaactgaaaaatgaagctctacttgaagctgtcaactgtactgattcgaagctacttatgctgtctgctgtcgccaattctttggacaacagaagtatatttcacatctgtttcaacccaagggttggtgcatcagaatttattgtgccgtattgcaagttcttgaagagtttgaactatcccttttcagttggaaccagatttaaagttggctgcgagaatgaagatgctaacgagaggtcctttggattgatcataggtattagtgaagttgatcccatacactggcctggatcaaaatggaaatctctcctgataaagtgggatggtgctactaagtacagccaccagaatagagtatctccatgggacatcgagggagttggcagctcagtttcagttactcaccgtctttcctcttctgtttcgaagcgaacaaaactgtgcttccctccaagcgatttggacacgccaattctagatggaaatggtcgtccagactccgtggaaactgaacgtttccacagggtcttgcaaggtcaagaattggtgcactctagtattcacggtgctgcatgctctcattcatcagatagccccagatgtcaaggctcttatggcaggagattctctgctgatgcatggaactgcaagatgaatgatgtaatgagtgggcctcgacacctaaatgccactgggtttgcttaccagcccctaggcttcagtgaatctgtcaaattctcagaggtcttgcaaggtcaagaaatgtctcaggcggttccttccttcatgagatctgctttcaactctggcacgcagaatggcagggttcgaccatttgattatgtgcagagatcagatgcaactcaaggatacgctctccagcagtttaatctgccagcaacagaagtgcattcgccctcttctgttcttatgtttaaccaaaccatggtaccacatgctgagctagatggtgcgaccaaccgtgaagaagtacatggcagcaggtacttgtcatccaatgcaatagggagagaagctgaaccatggccatccatggagcagcaaagagcgagtgtaaatggaagcgagcctctcgacacaactgaagcctcagctcctgcaaggaacgctgaatctggatcggtcggcaggggcgtggggcgaagcagctgtaagctttttggtttctccctgactgagaagatccttgcaacggatggtggtggtgtaaaagaaggaaactacgaagtggaccgtcaaactccccgggtgctagacttgtttgggcacggttctacgcctggtgctctgcatgctctctgtgctgctcccttgggaatatgatgctgttctgcctagttttacagcagttagatttatgtaatccttcagccattttcatcgcgttgtacttgaccaatatgtccagcgtatgatttccagttttaattgtatgctgatgctacatatcctctcttgagatccatgcatgagaattctggcagaatgaataaaggtaaattgatgtcc

SEQ ID NO: 4853 - protein, 680 aa, Zea mays
  misc_feature (1)..(680): useful for making plants with increased cold tolerance as described in USSN 12/863,773
  misc_feature (1)..(680): Ceres CLONE ID no.1598488
  misc_feature (1)..(680): Bit score of 1482.2 for HMM based on sequences of FIGURE 5 of USSN  12/863,773.
  misc_feature (129)..(234): Pfam Name: B3 Pfam Description: B3 DNA binding domain
  misc_feature (256)..(337): Pfam Name: Auxin_resp Pfam Description: Auxin response factor
  misc_feature (1)..(680): Is Acted Upon By Ceres SEEDLINE ID no. ME00572
MGIDLNAVGEDDPAGAVCAELWHACAGAGVALPRRGSAVVYLPQAHLAAGGCDGGGMSAPAPPRVPPHVVCRVVDVELRADAATDEVYARLALVAMDTMFGRNINDGETEEKNGEEEDGDGEKKHASHMFCKTLTASDTSTHGGFSVPRRAAEDCFPPLDYEQLRPSQELIAKDLHGMKWRFRHIYRGQPRRHLLTTGWSSFINKKKLVSGDAVLFLRGNDGELRLGVRRAVQLKNEALLEAVNCTDSKLLMLSAVANSLDNRSIFHICFNPRVGASEFIVPYCKFLKSLNYPFSVGTRFKVGCENEDANERSFGLIIGISEVDPIHWPGSKWKSLLIKWDGATKYSHQNRVSPWDIEGVGSSVSVTHRLSSSVSKRTKLCFPPSDLDTPILDGNGRPDSVETERFHRVLQGQELVHSSIHGAACSHSSDSPRCQGSYGRRFSADAWNCKMNDVMSGPRHLNATGFAYQPLGFSESVKFSEVLQGQEMSQAVPSFMRSAFNSGTQNGRVRPFDYVQRSDATQGYALQQFNLPATEVHSPSSVLMFNQTMVPHAELDGATNREEVHGSRYLSSNAIGREAEPWPSMEQQRASVNGSEPLDTTEASAPARNAESGSVGRGVGRSSCKLFGFSLTEKILATDGGGVKEGNYEVDRQTPRVLDLFGHGSTPGALHALCAAPLGI

SEQ ID NO: 4854 - protein, 655 aa, Oryza sativa subsp. indica
  misc_feature (1)..(655): useful for making plants with increased cold tolerance as described in USSN 12/863,773
  misc_feature (1)..(655): Public GI ID no.125527740
  misc_feature (1)..(655): Bit score of 1060.7 for HMM based on sequences of FIGURE 5 of USSN  12/863,773.
  misc_feature (114)..(219): Pfam Name: B3 Pfam Description: B3 DNA binding domain
  misc_feature (241)..(322): Pfam Name: Auxin_resp Pfam Description: Auxin response factor
  misc_feature (1)..(655): Is Acted Upon By Ceres SEEDLINE ID no. ME00572
MGIDLNYTASGGEEDAPAPAPVCRDLWHACAGPVVSLPRRGSAVVYLPQGHLSAAGAGGRIRGEVAVALPPHVACRVVDVELCVFERNLHGGGIEREDDMEDGDEERKSRMLHMFCKTLTASDTSTHGGFSVPRRAAEDCFPPLDHKQLRPSQELVAKDLHGAKWRFRHIYRGQPRRHLLTTGWSSFVNKKKLVSGDAVLFLRGDDGELRLGVRRATQLKNEAIFKAFSSESSKMRTLSAVADSLKHGSVFHICYNPRATASEYVVPYWKFVKSFNHPVCIGMRFKFHYESEDVNERRSGMIAGVSEVDPIRWPGSKWRSLLVRWEDATDCNSQNRVSPWEIEIVGGSISVAHSLSASSSKRTKLCPQGNLDVPALYGNGRPDSVETEKFPRVLQGQELMGSRTHRVTCSPQSIDITKSKSFDAWRFLTDTRSCMLGSSTSRLPVQYSGYTHQSVSFGESIGFPEVLQGQEISQTVPPIQGMLPDACSAKSRYELKNYVCTPATMNGLSSANEGYCLSLSTVPPSPPSSLMLYQTGVPQLELASKNNDKSGNDSQPALRQHKLLSETSWDQFKIGKASTPGNATKPGNGGREVDRTSCRLFGFSLTEKIIPTDKDGEKEVSYETDCQNPRMLDLFGYNCSTPGALHALCAAPLGI

SEQ ID NO: 4855 - protein, 719 aa, Oryza sativa subsp. indica
  misc_feature (1)..(719): useful for making plants with increased cold tolerance as described in USSN 12/863,773
  misc_feature (1)..(719): Public GI ID no.125553314
  misc_feature (1)..(719): Bit score of 1618.5 for HMM based on sequences of FIGURE 5 of USSN  12/863,773.
  misc_feature (141)..(246): Pfam Name: B3 Pfam Description: B3 DNA binding domain
  misc_feature (268)..(349): Pfam Name: Auxin_resp Pfam Description: Auxin response factor
  misc_feature (1)..(719): Is Acted Upon By Ceres SEEDLINE ID no. ME00572
MTGIDLNTVEEDEEEAAEEVAANGSSPAPARAGAVCLELWHACAGPVAPLPRKGGVVVYLPQGHLEHLGDAPAAAAAAAAVPPHVFCRVVDVTLLADAATDEVYAQLSLVPEKEEVARRADDGEGEDGDGMKQRFARMPHMFCKTLTASDTSTHGGFSVPRRAAEDCFPPLDYSQQRPSQELVAKDLHGTEWRFRHIYRGQPRRHLLTTGWSAFVNKKKLVSGDAVLFLRGDDGELRLGVRRAAQLKNGSAFPALYNQCSNLGTLANVAHAVATESVFNIYYNPRLSQSEFIVPYWKFMKSLSQPFSVGLRFKMRYESEDASERRYTGIITGSGDTDPMWHGSKWKCLLVRWDDDAEFRRPNRVSPWEIELTSSVSGSHLSTPHSKRLKPCLPHVNPEYMVPRGGGCPDFAESAQFHKVLQGQELLGFKSHGGTAAATSQPCEARHLQYIDERSCSSDASNSILGVPRLGDRAPLGNPGFSYHCSGFGESQRLQKVLQGQELFRPYRGTLVDASMGSNGFHQQDSPRAPGVVNKWQAQLHGRAAFHGPPALALPSQSSSPPSVLMFQQANSKMPRLEFGHGQLDKHENDRRVRFGPSEGIERREQRIPLQPYPTSGEVIDGQVTVEKSHSPGRHGKDGPDNKAVGTNSCKIFGISLTEKVPAREELDDGDANYSLQSLKQVPKSLGNSCATMVAEYQGDGGTDDSDIFILDVGVGALIM

SEQ ID NO: 4856 - protein, 788 aa, Arabidopsis thaliana
  misc_feature (1)..(788): useful for making plants with increased cold tolerance as described in USSN 12/863,773
  misc_feature (1)..(788): Ceres LOCUS ID no. At5g60450
  misc_feature (1)..(788): Bit score of 808.3 for HMM based on sequences of FIGURE 5 of USSN 12/863,773.
  misc_feature (176)..(281): Pfam Name: B3 Pfam Description: B3 DNA binding domain
  misc_feature (302)..(384): Pfam Name: Auxin_resp Pfam Description: Auxin response factor
  misc_feature (1)..(788): Is Acted Upon By Ceres SEEDLINE ID no. ME00572
MEFDLNTEIAEVEEEENDDVGVGVGGGTRIDKGRLGISPSSSSSCSSGSSSSSSSTGSASSIYSELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDPSVSLPHLSIQSSPRPKRPWAGLLDTTPPGNPITKRGGFLDFEESVRPSKVLQGQENIGSASPSQGFDVMNRRILDFAMQSHANPVLVSSRVKDRFGEFVDATGVNPACSGVMDLDRFPRVLQGQEICSLKSFPQFAGFSPAAAPNPFAYQANKSSYYPLALHGIRSTHVPYQNPYNAGNQSSGPPSRAINFGEETRKFDAQNEGGLPNNVTADLPFKIDMMGKQKGSELNMNASSGCKLFGFSLPVETPASKPQSSSKRICTKVHKQGSQVGRAIDLSRLNGYDDLLMELERLFNMEGLLRDPEKGWRILYTDSENDMMVVGDDPWHDFCNVVWKIHLYTKEEVENANDDNKSCLEQAALMMEASKSSSVSQPDSSPTITRV

SEQ ID NO: 4857 - DNA, 2064 bp, Populus balsamifera subsp. trichocarpa
  misc_feature (1)..(2064): useful for making plants with increased cold tolerance as described in USSN 12/863,773
  misc_feature (1)..(2064): Ceres ANNOT ID no.1515383
atggaaattgatctgaatcatccagtgactgaggtggagaagaattcattttgtaccaatggggactcttcatgttcttctaattcatcttcatctccagtttcctcttcaatttacttggagctttggcatgcttgtgctggtcctctcacttctctccctaagaaagggaatgtggttgtctacttccctcaaggccacttggagcagcttgcctcttcctctcctttctctcatagggacatgcccaattttgatctccacccacaaatattttgcaaagttgtaaatgtgcagctacttgccaatagggaaaatgatgaggtctacactcggcttactttgcttcctcaaccagaggtggtaggacaggatttagaaggcaaagagcttcaagagttaggcgtggatggagagggtgacgacgcatcaccaacaaaatcaaccccacacatgttttgcaaaacactcacagcttctgatactagcacccatggagggttttccgttcctcgaagagctgccgaagactgtttcccttcactggattataaacagcagagaccctctcaagagcttttggccaaagacttgcatggagttgaatggagatttcgtcatatttacagaggtcaaccaagaaggcatcttctaactacgggatggagtatttttgtgagtcaaaagaatcttgtttcaggggatgcagtgctatttctgaggggcgaaggtggagagttgagactggggatcagacgagctgctcgacctagaaatggtcttcctgattctgttactggcaagcagaattcacttcccagtgctctctccttggtgtctaatgcaatatccaccaagagcgtgttcactgtttcatatagtccaagggccactcatgcagtgtttgttgtaccctaccaaaagtatataaaaagcatcaccaatgcagtttgcatcgggacaagattcaaaatgagatttgaaatggatgattctcctgaaagaaggtgtagcggtgtagtaactggaacagctgacttggatccctataagtggcccaactcaaaatggaggtgcttaatggttagatgggatgaagatgtcatcagtgatcatcaagaacgagtttccccatgggaaattgacgcttctgtttcactcccacccttgattattcaatcttcaccaaggttgaagaaactgcggactgggctgcaagcagccccacctgataagcccatagctggagggggtgggtttttggatttcaaggagtctgtaagatcctccaaggtcttgcaaggtcaagaaatatgctcgttgagttctgttggtgctttgggaaagcccaatactggacgcagttctttccagatgtatccaggaccaagacccgctttctatcctgtagcagcagaaagccttagaagtatgtactttccctatggagatgtatacaaaaatggtcaagatcccagaacacaatcttatgctatcttctctagagaaaatgcccatttcaatacatcttctattcagacttgtgtggttagggaagaagttagaaagcctaatcaatcaagcgagtataagacacaagaaagtatttctgctgcaccggctttatgtgcaaatctaagaaaccaaaaggatgacttttttaatgggaatgctactggctgcaaactttttgggttctccttgaatgcagaaacatctccaaattcgcagaacactagtaagaggagttgcacaaaggttcacaagcaaggtagcttggtcggaagagctattgatctttcaaggctgaatggctatagtgatctcttgaatgaactagagcgactatttagcatggagggtcttttacgaaatcctgaggaaggatggcgaatcttgtatactgacagtgagaatgatgttatggttgtcggagatgacccatggcttgagttctgtaatgtggcaaccaagatccatatatatacccaagaagaagtggagaagatgaccgttggaattactggggacgatactcaaagttgtttggatcaagccctgtga

SEQ ID NO: 4858 - protein, 687 aa, Populus balsamifera subsp. trichocarpa
  misc_feature (1)..(687): useful for making plants with increased cold tolerance as described in USSN 12/863,773
  misc_feature (1)..(687): Ceres ANNOT ID no.1515383
  misc_feature (1)..(687): Bit score of 794.3 for HMM based on sequences of FIGURE 5 of USSN 12/863,773.
  misc_feature (152)..(257): Pfam Name: B3 Pfam Description: B3 DNA binding domain
  misc_feature (279)..(361): Pfam Name: Auxin_resp Pfam Description: Auxin response factor
  misc_feature (1)..(687): Is Acted Upon By Ceres SEEDLINE ID no. ME00572
MEIDLNHPVTEVEKNSFCTNGDSSCSSNSSSSPVSSSIYLELWHACAGPLTSLPKKGNVVVYFPQGHLEQLASSSPFSHRDMPNFDLHPQIFCKVVNVQLLANRENDEVYTRLTLLPQPEVVGQDLEGKELQELGVDGEGDDASPTKSTPHMFCKTLTASDTSTHGGFSVPRRAAEDCFPSLDYKQQRPSQELLAKDLHGVEWRFRHIYRGQPRRHLLTTGWSIFVSQKNLVSGDAVLFLRGEGGELRLGIRRAARPRNGLPDSVTGKQNSLPSALSLVSNAISTKSVFTVSYSPRATHAVFVVPYQKYIKSITNAVCIGTRFKMRFEMDDSPERRCSGVVTGTADLDPYKWPNSKWRCLMVRWDEDVISDHQERVSPWEIDASVSLPPLIIQSSPRLKKLRTGLQAAPPDKPIAGGGGFLDFKESVRSSKVLQGQEICSLSSVGALGKPNTGRSSFQMYPGPRPAFYPVAAESLRSMYFPYGDVYKNGQDPRTQSYAIFSRENAHFNTSSIQTCVVREEVRKPNQSSEYKTQESISAAPALCANLRNQKDDFFNGNATGCKLFGFSLNAETSPNSQNTSKRSCTKVHKQGSLVGRAIDLSRLNGYSDLLNELERLFSMEGLLRNPEEGWRILYTDSENDVMVVGDDPWLEFCNVATKIHIYTQEEVEKMTVGITGDDTQSCLDQAL

SEQ ID NO: 4859 - DNA, 2722 bp, Zea mays
  misc_feature (1)..(2722): useful for making plants with increased cold tolerance as described in USSN 12/863,773
  misc_feature (1)..(2722): Ceres CLONE ID no.462443
agacaaccaaacgaaccctcccggagcagcaaagcataggcgctcgagcgctccctcccgagctcctccgcctcacggtcacgcctcgtgtccccccaccccctcctcctcctcctcggccggccgcctcacgccgtcacctccgctcggcgagtctcggctccgaccgctgccgccacgtgcgacctcccctactcctgagagatctgcggggctcggcatggggtgaccagatcgggccgctgctcggtgctttccagctgaattttgcccgcagctcgtgtcggaggcagcgaagatggcggaggccggcgtggcacgcggctcagggagcgctggcgatgctttgttcagggaactctggcatgcttgtgctgggccgttggtcacagtgcctcgccaaggcgagctggtttattacttcccccagggtcatatggaacagcttgaagcgtctacagatcaacaacttgatcagcacttgcctttgtttaatctaccgcacaagatcctctgcaaggtggtcaatgtagaacttagagctgaaactgattctgatgaagtttatgctcaaattatgctgcaaccacaaacagagcaaagtgagcccaccagcccagatcctgaaccacctgagcctgaaagatgcaacattcattccttctgcaagaccttgactgcttcagatacaagtacccatggtctctctgtcctcaggaggcatgctgaagaatgtttgccccaactggacatgactcagaatccaccgtggcaagaactagtggctaaagatctccatggaaatgaatggcatttccgtcacatctttcgagggcaaccaaggaggcatctacttacgacaggctggagtgtttttgttagctcaaaaagattggttgcgggtgacgcgtttatcttcttgagaggtgagaacggagagctgcgagtcggggtaaggaggctcatgagacaactaaataacatgccgtcttcggttatctcaagccacagcatgcatcttggagtcctagcaactgcatctcatgccatctccactggaactctattttctgttttctacaaacccagaacaagtagatctgaatttgtcgttagtgtaaacaagtacctcgaagctaagaatcacaagatgtctgttggtatgaggtttaaaatgagatttgagggtgatgaatcccctgaaagaagattcagtgggataattattggtatgggatgcatgccagctaactcaacatctccatgggctaactctgaatggagatcattgaaggtccaatgggacgagccttctgctattctgcgtccagatagagtttcaccatgggaagtagaaccccttaatcgaacaaatccacagccacctcaacctcctttacggaataagcgagcacggcctcctgcttcaccttcgattgctccagaacttgctccagtttttggtttttggaagtccccagctgagcctgcccaagctttctcattctcaggactgcagcgaactcaggagctataccattcaagccccagttcaatgttctcatcgtcgttgaatgtgggattcaatccaaagtacgagggtcccactccaaacaccaaccatttgtactggacaatgagagagacaagaactgaatcctactccgctagcatcaacaaagctccaactgaaaagaagcaagaatccactacttctggctgcagattgttcggtatcgagataggttcttctgcagtgtcacccgtggttactgttgctagcgtcgggcatgatcctccgccacctgctctctcagtagacgctgaatctgaccagctgtcacagccgtcccatgccaacaaagcaacggatgccccagcggcaagcagcgatcgctctcctaacgagacagagagccggcaagccaggagctgcaccaaggtaatcatgcaaggggtggcggttggcagggcggtggacttgacgaggctagatgggtacgatgacctccgccgcaagttggaggagatgttcgatatcccgggagagctttccgccagcctcaataaatggaaggtgatctacacagatgacgaggacgatatgatgctggtcggggacgatccatggagtgaattttgcaggatggtaaaaaggatatacatttattcctacgaggaggccaagtctttgactcccaaggcgaagctgccggccatcggtggtgacaccggcgtcaagccggacccaagtaaactgtcagcagaatctgacgtgccacagagcgactccgacaacagtgctcccgtttctgctgataaggactgatggacgctagctcggccgtaccttctctttatgttggccatgggaggccagtgcagtgcccatgctccttgagactgctaagaattgatcatctgttccatctgcctcggcttggaccagcgaggatggccgggagggagtgcatgccgctccgtgcgtgtttcgtttgccgtgtttggtaggagccatggcttgttgccggctacttgggttctgtagactgttacactgactgctgccgtctcacctggccgtcggcgcgggccgccccctctcacctctctagtaatatactagggcttatgtacacacagctgttttggtagtggcatatgtatatcgtcggtcatgttgcttgcgacatttagcatcctccgtagctgctatttcctc

SEQ ID NO: 4860 - protein, 676 aa, Zea mays
  misc_feature (1)..(676): useful for making plants with increased cold tolerance as described in USSN 12/863,773
  misc_feature (1)..(676): Ceres CLONE ID no.462443
  misc_feature (1)..(676): Bit score of 1504.3 for HMM based on sequences of FIGURE 5 of USSN  12/863,773.
  misc_feature (121)..(225): Pfam Name: B3 Pfam Description: B3 DNA binding domain
  misc_feature (247)..(332): Pfam Name: Auxin_resp Pfam Description: Auxin response factor
  misc_feature (1)..(676): Is Acted Upon By Ceres SEEDLINE ID no. ME00572
MAEAGVARGSGSAGDALFRELWHACAGPLVTVPRQGELVYYFPQGHMEQLEASTDQQLDQHLPLFNLPHKILCKVVNVELRAETDSDEVYAQIMLQPQTEQSEPTSPDPEPPEPERCNIHSFCKTLTASDTSTHGLSVLRRHAEECLPQLDMTQNPPWQELVAKDLHGNEWHFRHIFRGQPRRHLLTTGWSVFVSSKRLVAGDAFIFLRGENGELRVGVRRLMRQLNNMPSSVISSHSMHLGVLATASHAISTGTLFSVFYKPRTSRSEFVVSVNKYLEAKNHKMSVGMRFKMRFEGDESPERRFSGIIIGMGCMPANSTSPWANSEWRSLKVQWDEPSAILRPDRVSPWEVEPLNRTNPQPPQPPLRNKRARPPASPSIAPELAPVFGFWKSPAEPAQAFSFSGLQRTQELYHSSPSSMFSSSLNVGFNPKYEGPTPNTNHLYWTMRETRTESYSASINKAPTEKKQESTTSGCRLFGIEIGSSAVSPVVTVASVGHDPPPPALSVDAESDQLSQPSHANKATDAPAASSDRSPNETESRQARSCTKVIMQGVAVGRAVDLTRLDGYDDLRRKLEEMFDIPGELSASLNKWKVIYTDDEDDMMLVGDDPWSEFCRMVKRIYIYSYEEAKSLTPKAKLPAIGGDTGVKPDPSKLSAESDVPQSDSDNSAPVSADKD

SEQ ID NO: 4861 - DNA, 329 bp, Arabidopsis thaliana
  misc_feature (1)..(329): useful for making plants with increased cold tolerance as described in USSN 12/863,773
  misc_feature (1)..(329): Public GI No. 21403834
  misc_feature (1)..(329): Homolog Of Ceres SEEDLINE ID no. ME00572
  misc_feature (1)..(329): FRAGMENT
tatctgagcttttagtcggattttttcttttcaattattgtgttttatctagatgatgcatttcattattctctttttcttgaccttgtaaggccttttcttgaccttgtaagaccccatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcc

SEQ ID NO: 4862 - DNA, 350 bp, Solanum lycopersicum
  misc_feature (1)..(350): useful for making plants with increased cold tolerance as described in USSN 12/863,773
  misc_feature (1)..(350): Public GI No. 158087544
  misc_feature (1)..(350): Homolog Of Ceres SEEDLINE ID no. ME00572
  misc_feature (1)..(350): FRAGMENT
cctaacgatgagtgtcgcatcctcatcttaatctcggtgctatcctacctgagctttttctcaccgcttttttttttctgttgtgtattctcttttttgacttgttgcctttcgttcctctacctaccccattcttcttgaccttgtaagaccttttcttgaccttgtaagaccccgtgttatctcttacgtctttatgttttgtttttttgcaaatcttacgtcatgacttcttcatgtaagctttgtttggtctccttcttctttcctactcaactctcgttctccttccttgtctatccctcctgagctgttgattttattccatgtacaattgaacacaacaaaaa

SEQ ID NO: 4863 - DNA, 197 bp, Brassica rapa
  misc_feature (1)..(197): useful for making plants with increased cold tolerance as described in USSN 12/863,773
  misc_feature (1)..(197): Public GI No. 110797273
  misc_feature (1)..(197): Homolog Of Ceres SEEDLINE ID no. ME00572
  misc_feature (1)..(197): FRAGMENT
aaaaaatttctttctcccactgaatgattttttattttcttgaccttgtaaggccttttcttgaccttgtaagaccccatccctttctaagtgtttccttcttctatcatcttacagattttcttttatctctttttggtgtaagatatgtatgtatatctacccctagtttgtctgagtcatcttctcctaccttg

SEQ ID NO: 4864 - DNA, 207 bp, Medicago truncatula
  misc_feature (1)..(207): useful for making plants with increased cold tolerance as described in USSN 12/863,773
  misc_feature (1)..(207): Public GI No. 118566241
  misc_feature (1)..(207): FRAGMENT
  misc_feature (1)..(207): Homolog Of Ceres SEEDLINE ID no. ME00572
gagcttttttttcacctttctcttttcttaactttttttttactctacttgtgtcttcttgaccttgtaagaccttttcttgaccttgtaagacctcactctgtgtcggttttctttgtttttgcttttgtggaagacgctatatcgaaatttgttgatatagagtttcgtctccgtttttcccttttaccacccaactcattctct

SEQ ID NO: 4865 - DNA, 188 bp, Vitis vinifera
  misc_feature (1)..(188): useful for making plants with increased cold tolerance as described in USSN 12/863,773
  misc_feature (1)..(188): Public GI No. 147857869
  misc_feature (1)..(188): FRAGMENT
  misc_feature (1)..(188): Homolog Of Ceres SEEDLINE ID no. ME00572
cccggttgtgtttccttttgttcgggtcattacttcttcttgaccttgtaagaccttttcttgaccttgtaagaccccgggcaaaatccgctatccttattatatcagtcgagaaggacttcctattagacactactgataaagagttcaataatcaatacttgatgtccccaacctactcgtcatct

SEQ ID NO: 4866 - DNA, 182 bp, Oryza sativa
  misc_feature (1)..(182): useful for making plants with increased cold tolerance as described in USSN 12/863,773
  misc_feature (1)..(182): Public GI No. 58530789
  misc_feature (1)..(182): FRAGMENT
  misc_feature (1)..(182): Homolog Of Ceres SEEDLINE ID no. ME00572
aaaacctcaacatcactttgtgtgggaattaaaaggaattggtcttcttgaccttgcaagaccttttcttgaccttgtaagacccaacatcgttgtgttgtttttcttgtttcttatttttcaatttcatccacctcttctttctacctcccatctttctcctagttcttgccttctctctc

SEQ ID NO: 4867 - DNA, 232 bp, Zea mays
  misc_feature (1)..(232): useful for making plants with increased cold tolerance as described in USSN 12/863,773
  misc_feature (1)..(232): Public GI No. 21212701
  misc_feature (1)..(232): FRAGMENT
  misc_feature (1)..(232): Homolog Of Ceres SEEDLINE ID no. ME00572
ccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcaggatacctggatcccaaactagctggccaacatggcgaacgatgaccctgtggacgacg

SEQ ID NO: 4868 - DNA, 549 bp, Manhiot esculenta
  misc_feature (1)..(549): useful for making plants with increased cold tolerance as described in USSN 12/863,773
  misc_feature (1)..(549): Public GI No. 119010892
  misc_feature (1)..(549): Homolog Of Ceres SEEDLINE ID no. ME00572
ttttttttttctcttcttctccttctccttctccttctcatctctctctctctctctctctctctcagcatgaaagagagaggaaagcattcagaggtgaaactcaggcataagtttcttcaaggcattcatgaagttaaaatcatgaacaacgccaccatctgcaacgcttccagtggtgggtttttggctggcttctcgtttggggctaaaagtccctttggaatggtggttggttcatgttgatggggtgctatcctacctgagctttttctattattttcctttttattttttttcttacttttgtttttaatcttcttgaccttgtaagaccttttcttgaccttgtaagacccctttttatgtttatttatcttaatttttgtattgtcataaattctatatcaaaattttttgatatagaatttcatgtttatttttttctgtttttgcccaactcatattctccttccttgtctatccctcctgagctatttgaataaaattattatgctaattattcagaaaaaaaaaaaaaaaaaatcg

SEQ ID NO: 4869 - DNA, 168 bp, Populus balsamifera subsp. Trichocarpa
  misc_feature (1)..(168): useful for making plants with increased cold tolerance as described in USSN 12/863,773
  misc_feature (1)..(168): 000POPULUS
  misc_feature (1)..(168): Homolog Of Ceres SEEDLINE ID no. ME00572
gtttttttttttgtttttttttcttgaccttgtaagaccttttcttgaccttgtaagaccccattttttgttctttgtttctatagcatccctcttgccacccaactcatcatctccttctctgtctatccctcctgagctatttcgatcacaccgcaagatcacatt

SEQ ID NO: 4870 - DNA, 167 bp, Theobroma cacao
  misc_feature (1)..(167): useful for making plants with increased cold tolerance as described in USSN 12/863,773
  misc_feature (1)..(167): 000THEOBROMA
  misc_feature (1)..(167): Homolog Of Ceres SEEDLINE ID no. ME00572
  misc_feature (69)..(69): n is a, c, t, g, unknown, or other
  misc_feature (71)..(71): n is a, c, t, g, unknown, or other
tttcttcttcttttcttatcttcttgaccttgtaagaccttttcttgaccttgtaagaccccgttcggngntccttggttttgcttctaccccattcccgccaacttttcttctcccttccttgctatccctcctgagctggttgaattagcctagcctagctatag

SEQ ID NO: 4871 - DNA, 168 bp, Malus x domestica
  misc_feature (1)..(168): useful for making plants with increased cold tolerance as described in USSN 12/863,773
  misc_feature (1)..(168): 000MALUS
  misc_feature (1)..(168): Homolog Of Ceres SEEDLINE ID no. ME00572
  misc_feature (98)..(98): v is a or g or c
  misc_feature (99)..(99): v is a or g or c
  misc_feature (101)..(101): v is a or g or c
  misc_feature (102)..(102): v is a or g or c
  misc_feature (103)..(103): v is a or g or c
cgcatcgatcccttccctttttcttgaccttgtaagaccttttcttgaccttgtaagatgtcatgccaggtctgttgtctttggttcctcatcgttavvgvvvaattcatcttctccttccttgtctatccctcctgagctgttccacaattacctcaaactacaagc

SEQ ID NO: 4872 - DNA, 168 bp, Glycine max
  misc_feature (1)..(168): useful for making plants with increased cold tolerance as described in USSN 12/863,773
  misc_feature (1)..(168): 000GLYCINE
  misc_feature (1)..(168): Homolog Of Ceres SEEDLINE ID no. ME00572
gtttttcccttggagtcttcttcttgaccttgtaagaccttttcttgaccttgtaagacctcacaccctatctcttctctttgttctttccccgttaccacccaactcatactttccttccttgtctatccctcctgagctgttccaatttaattaatttggcctacc

SEQ ID NO: 4873 - DNA, 168 bp, Lotus japonicus
  misc_feature (1)..(168): useful for making plants with increased cold tolerance as described in USSN 12/863,773
  misc_feature (1)..(168): 000LOTUS
  misc_feature (1)..(168): Homolog Of Ceres SEEDLINE ID no. ME00572
ccttgtttccccctccggtcttcttgaccttgtaagaccttttcttgaccttgtaagacctcacgccgtgtctgttttcttcagtctttccccgttaccgtccaactcatcctctccttccttgtctatccctcctgagctatttcaattttggccaagcatgccaca

SEQ ID NO: 4874 - protein, 165 aa, Sorghum bicolor
  misc_feature (1)..(165): useful for making plants with increased cold tolerance as described in USSN 12/863,773
  misc_feature (1)..(165): Ceres Annot ID no. 8670388
  misc_feature (1)..(165): Truncated
  misc_feature (1)..(165): Bit score of 420.2 for HMM based on sequences of FIGURE 4 of USSN 12/863,773.
  misc_feature (1)..(165): Functional Homolog Of SEQ ID NO. 93
MIDTMIPLMKHSPYGARIVNVSSRLGRANGRRNRIGDASLRDRLLKDDCLSEQLVDEMITKFLEQVKQGTWSSNEWPQMYTDYSISKLAVNVYTRLMARRLSDRPEGQKIYINCFCPGWVNTAMTGWEGNISAEEGADTGVWLALLPQEPPTNGKFFAERCEISF

SEQ ID NO: 4875 - protein, 165 aa, Zea mays
  misc_feature (1)..(165): useful for making plants with increased cold tolerance as described in USSN 12/863,773
  misc_feature (1)..(165): Public GI ID no. 194696386
  misc_feature (1)..(165): Truncated
  misc_feature (1)..(165): Bit score of 411.4 for HMM based on sequences of FIGURE 4 of USSN 12/863,773.
  misc_feature (1)..(165): Functional Homolog Of SEQ ID NO. 93
MIDAMIPLMKRSAYGARIVNVSSRLGRANGRRNRIGDVSLRDRLLKDDCLSEQLIDEMITKFLEQAKQGTWSLNEWPQMYTDYSISKLAVNAYTRLMARRLSDRPEGQKIYINCFCPGWVKTAMTGWEGNVSAEEGADTGIWLALLPQETDTNGKFFAERCEISF

SEQ ID NO: 4876 - protein, 163 aa, Panicum virgatum
  misc_feature (1)..(163): useful for making plants with increased cold tolerance as described in USSN 12/863,773
  misc_feature (1)..(163): Ceres Clone ID no. 1906273
  misc_feature (1)..(163): Truncated
  misc_feature (1)..(163): Bit score of 400.6 for HMM based on sequences of FIGURE 4 of USSN 12/863,773.
  misc_feature (1)..(163): Functional Homolog Of SEQ ID NO. 93
MLTEALLPLFRQSPATSRILNISSQLGLLNKVSDSSLKALLLDEETLTEAAIDAMVSRFLAQVKDGTWGAQGWPKVWTDYSVSKLALNAYSRLLARRLQARGARVSVNCFCPGFTRTDMTRGWGKRTAEEVADVGARLALLPPGELPTGAFFKWCTPQLYSKL

SEQ ID NO: 4877 - protein, 161 aa, Zea mays
  misc_feature (1)..(161): useful for making plants with increased cold tolerance as described in USSN 12/863,773
  misc_feature (1)..(161): Ceres Clone ID no. 100894176
  misc_feature (1)..(161): Truncated
  misc_feature (1)..(161): Bit score of 364.2 for HMM based on sequences of FIGURE 4 of USSN 12/863,773.
  misc_feature (1)..(161): Functional Homolog Of SEQ ID NO. 93
MLTEALLPLFRQSSATSRILNISSQLGLLNKVGDPSLKALLLDEERLTEAGIEAMVSRFLAQVKDGTWGEQGWPKVWTDYSVSKLALNAYSRLLARRLEARGVSVNCFCPGFTRTDMTRGWGKRTAGEAADVGARLALLPPTELPTGTFFKWRTPQLYSKL

SEQ ID NO: 4878 - protein, 164 aa, Solanum lycopersicum
  misc_feature (1)..(164): useful for making plants with increased cold tolerance as described in USSN 12/863,773
  misc_feature (1)..(164): Ceres Annot ID no. 8459736
  misc_feature (1)..(164): Truncated
  misc_feature (1)..(164): Bit score of 361.8 for HMM based on sequences of FIGURE 4 of USSN 12/863,773.
  misc_feature (1)..(164): Functional Homolog Of SEQ ID NO. 93
MIKALTPLMRPSPAGSRIVSVTSRLGRLNSKRNGISNVAVREQLENVDTLSEEVIDKTMHTFLEQVKDGTWESAGWPHVFTDYSLSKLAVNAYTRLMARIFEERPEGEKIYINCYCPGWVKTAMTGWAGHVTIEEAADTAVWLALLPDQFVSGKFFAERREINF

SEQ ID NO: 4879 - DNA, 975 bp, Sorghum bicolor
  misc_feature (1)..(975): useful for making plants with increased cold tolerance as described in USSN 12/863,773
  misc_feature (1)..(975): Ceres Annot ID no. 8670388
atggggaagaaagggaaggaggcggcgcgggagcggcgcgagcagcgccgccgcgaggtcaccctcctccgggctctcccctacgagccccaccagcgatggtgggaccgcctggcgccgcgggccgtggcggtggtcacgggcgccaaccgcgggataggcttcgaggccgcccgccagctcgcgctccacggcctgcacgtcgtgctcgcctcccgcgacgccgccaagggccaggacgccgcggggaggatcctggcggaggctcccgatggcgcggtcgtcagcgtggagtcccggcagcttgacgtggcggacgccgcgtccgtggaggccttcgcggcctgggcggtggaaacccacggcggcatccatgtccttgttaacaatgcaggtgtaaacttcaacaaaggagcagataattctgttgagtttgctgagcaagttatcaagacaaattactatggcacaaagcggatgattgatactatgataccactaatgaaacactccccgtatggtgctcggatagtgaatgtcagctcaaggcttggtagagccaatggcagacggaatagaattggtgatgcgagtctaagagatcgtctgttgaaagatgattgtttatcagagcagctagttgatgagatgatcacgaaatttctcgaacaagtcaagcaaggtacttggtcctccaatgagtggccacagatgtacacggactattcgatctcaaagcttgctgttaatgtttatacacgactgatggcaaggaggctctcggatcgacctgaaggccaaaagatatacattaactgtttctgccctggctgggtaaatactgccatgactggttgggaagggaatatttctgccgaagaaggtgctgacacaggtgtatggctcgccttattacctcaggaaccacccacaaatgggaagttcttcgctgagagatgtgagataagcttctaa

SEQ ID NO: 4880 - protein, 324 aa, Sorghum bicolor
  misc_feature (1)..(324): useful for making plants with increased cold tolerance as described in USSN 12/863,773
  misc_feature (1)..(324): Ceres Annot ID no. 8670388
  misc_feature (1)..(324): Bit score of 760.0 for HMM based on sequences of FIGURE 3 of USSN 12/863,773.
  misc_feature (42)..(195): Pfam Name: adh_short Pfam Desc: short chain dehydrogenase
  misc_feature (1)..(324): Functional Homolog Of SEQ ID NO. 74
MGKKGKEAARERREQRRREVTLLRALPYEPHQRWWDRLAPRAVAVVTGANRGIGFEAARQLALHGLHVVLASRDAAKGQDAAGRILAEAPDGAVVSVESRQLDVADAASVEAFAAWAVETHGGIHVLVNNAGVNFNKGADNSVEFAEQVIKTNYYGTKRMIDTMIPLMKHSPYGARIVNVSSRLGRANGRRNRIGDASLRDRLLKDDCLSEQLVDEMITKFLEQVKQGTWSSNEWPQMYTDYSISKLAVNVYTRLMARRLSDRPEGQKIYINCFCPGWVNTAMTGWEGNISAEEGADTGVWLALLPQEPPTNGKFFAERCEISF

SEQ ID NO: 4881 - protein, 313 aa, Vitis vinifera
  misc_feature (1)..(313): useful for making plants with increased cold tolerance as described in USSN 12/863,773
  misc_feature (1)..(313): Public GI ID no. 147853829
  misc_feature (1)..(313): Bit score of 757.9 for HMM based on sequences of FIGURE 3 of USSN 12/863,773.
  misc_feature (37)..(185): Pfam Name: adh_short Pfam Desc: short chain dehydrogenase
  misc_feature (1)..(313): Functional Homolog Of SEQ ID NO. 74
MGRKERAEERRKQRQQEISLFRTIPYSDHQRWWNSETIAVVTGANRGIGFEIARQLCGHGLTVILTSRDSAIGREAASVLQEGGFNAVSHQLDVLDPSSIEQFAEWVQQNYGFVDILINNAGVNYNMGSENSVENAENVIATNYFGTKNVIKAMVPLMKPSASGARIVNVSSRLGRINGRRNKIEDSALRGQLEDVDSLSEEVIDQMVHTFVEQVKDGTWTSAGWPQTFTDYSVSKLAVNCYTRIMAKVLSDRPEGEKIFINCYCPGWVKTAMTGWAGNVSVEEGADTGVWLALLPDQSVTGKIFAERREVHF

SEQ ID NO: 4882 - protein, 324 aa, Zea mays
  misc_feature (1)..(324): useful for making plants with increased cold tolerance as described in USSN 12/863,773
  misc_feature (1)..(324): Public GI ID no. 194696386
  misc_feature (1)..(324): Bit score of 755.3 for HMM based on sequences of FIGURE 3 of USSN 12/863,773.
  misc_feature (42)..(195): Pfam Name: adh_short Pfam Desc: short chain dehydrogenase
  misc_feature (1)..(324): Functional Homolog Of SEQ ID NO. 74
MGKKGKEAARERREQRRREVALLRSLPYEPHQRWWDRLAPRAVAVVTGANRGIGFEAARQLALHGLHVVLACRDAAKGQDAAERILAEAPDDTVVSVESRKLDVADAASVEAFAAWAVETYGGIHVLVNNAGVNFNKGADNSVEFAEQVIETNYYGTKRMIDAMIPLMKRSAYGARIVNVSSRLGRANGRRNRIGDVSLRDRLLKDDCLSEQLIDEMITKFLEQAKQGTWSLNEWPQMYTDYSISKLAVNAYTRLMARRLSDRPEGQKIYINCFCPGWVKTAMTGWEGNVSAEEGADTGIWLALLPQETDTNGKFFAERCEISF

SEQ ID NO: 4883 - DNA, 942 bp, Solanum lycopersicum
  misc_feature (1)..(942): useful for making plants with increased cold tolerance as described in USSN 12/863,773
  misc_feature (1)..(942): Ceres Annot ID no. 8459736
atggataaaaaggaaagggcaaaggaaaaaaaggagaaaagacgccaggagatctcccttctacgtactattccctattctgatcaccaaagatggtggtcatctgaaacaattgcggttgttacgggcgcaaatagaggcattggatttgaaattgctcatcagcttgcatcacatggcgttactgttgttctcacgtcgcgagagacagctgttggagaagaagcagtgaaagtctttcaggaaggaggtctaaatgtggcatttcatcaattggatattgtggatcctgtatcaattcaaacattttgtgattggattaaagaaacatatggtggcctagatatactgatcaacaatgcaggagtcaatttcaattgcggaaaagataattctgttgaattttctgaaatggtaatccaagttaactattttggcaccaaaaacatgatcaaagcacttactccgttgatgaggccttcccctgctggctctcgtattgttagtgtcacctcgcgattgggtagacttaatagcaaacgaaatggaatttcaaatgtagcagtgagagaacaattagaaaacgtggatacgctatctgaggaagttatcgataaaactatgcacacatttttggagcaagtaaaagatggaacttgggaatcagcaggatggcctcatgtgttcacagactactcattgtcaaagctagcagttaatgcctacacaaggttaatggcaaggatattcgaggaacgaccagaaggtgaaaaaatatacataaattgttattgtccgggatgggtgaaaactgctatgactggctgggcagggcatgttactattgaagaagctgctgatactgctgtatggcttgctttgctccctgatcaatttgtgagtggtaagttcttcgctgagaggcgcgaaattaacttttaa

SEQ ID NO: 4884 - protein, 313 aa, Solanum lycopersicum
  misc_feature (1)..(313): useful for making plants with increased cold tolerance as described in USSN 12/863,773
  misc_feature (1)..(313): Ceres Annot ID no. 8459736
  misc_feature (1)..(313): Bit score of 744.3 for HMM based on sequences of FIGURE 3 of USSN 12/863,773.
  misc_feature (37)..(193): Pfam Name: adh_short Pfam Desc: short chain dehydrogenase
  misc_feature (1)..(313): Functional Homolog Of SEQ ID NO. 74
MDKKERAKEKKEKRRQEISLLRTIPYSDHQRWWSSETIAVVTGANRGIGFEIAHQLASHGVTVVLTSRETAVGEEAVKVFQEGGLNVAFHQLDIVDPVSIQTFCDWIKETYGGLDILINNAGVNFNCGKDNSVEFSEMVIQVNYFGTKNMIKALTPLMRPSPAGSRIVSVTSRLGRLNSKRNGISNVAVREQLENVDTLSEEVIDKTMHTFLEQVKDGTWESAGWPHVFTDYSLSKLAVNAYTRLMARIFEERPEGEKIYINCYCPGWVKTAMTGWAGHVTIEEAADTAVWLALLPDQFVSGKFFAERREINF

SEQ ID NO: 4885 - DNA, 1198 bp, Panicum virgatum
  misc_feature (1)..(1198): useful for making plants with increased cold tolerance as described in USSN 12/863,773
  misc_feature (1)..(1198): Ceres Clone ID no. 1906273
agtcagccaccccccgcgctccccgctcgtctccagctcgatggactattcgagcaccaaggagttgcctccggccggggcctggtggtcgagggagacggtggccgtggtgacgggcgcgaaccggggcatcgggcacgccctcgccgcgcgcctggccgagcacgggctcaccgtggtgctcaccgcacgggacggcgcgcgcggggaggccgccgcggccccgctccgcgcgcgcgggctcgccgtcgccttccgcaggctcgacgtctccgacgccgcctccgtcgccgagttcgccgcctggctccgcgacgccgtcggcggcctcgacatcctggtgaacaacgcggccgtgtccttcaacgagatcgacaccaactcggtggagcacgccgagacagtcctcaggaccaacttccacggcgccaagatgctcacggaagcgctgctgccgctgttccggcagtccccggccaccagcaggatcctcaacatcagctcgcagcttggccttctcaacaaggtgagcgactcgtccctgaaggcgctgctcctggacgaggagaccctgacggaggcggcgatcgacgccatggtgtcgcggttcctggcgcaggtgaaggacgggacgtggggcgctcagggctggcccaaggtgtggacggactactcggtctccaagctggccctgaacgcctactcccggctgctggcgcggcggctgcaggcgcgcggcgcccgcgtgagcgtcaactgcttctgccccgggttcacgcgcaccgacatgaccaggggctgggggaagcgcaccgccgaggaggtggccgacgtcggcgcgcggctcgcgctgctgccgcccggcgagctccccacgggggccttcttcaagtggtgcacgccgcagctctactccaagctgtgacctgccgggagctagccacgccgccggccggcgcgccccggccatggcggcagtgggagtatatgtatgtagcgttggtttagctgctcctagtgacttgactccccatgcaaacaagaagtcgatcgagtagttagtgcctctggcagtctggctttctgccaaggtgctatggttgaagcaatgcaacctaaccatgtcagcaatcaatgtactatgcctagttagccgtgtaagatttaaagttaacttctgaacatgggaagaatcatg

SEQ ID NO: 4886 - protein, 294 aa, Panicum virgatum
  misc_feature (1)..(294): useful for making plants with increased cold tolerance as described in USSN 12/863,773
  misc_feature (1)..(294): Ceres Clone ID no. 1906273
  misc_feature (1)..(294): Bit score of 656.4 for HMM based on sequences of FIGURE 3 of USSN 12/863,773.
  misc_feature (20)..(173): Pfam Name: adh_short Pfam Desc: short chain dehydrogenase
  misc_feature (1)..(294): Functional Homolog Of SEQ ID NO. 74
MDYSSTKELPPAGAWWSRETVAVVTGANRGIGHALAARLAEHGLTVVLTARDGARGEAAAAPLRARGLAVAFRRLDVSDAASVAEFAAWLRDAVGGLDILVNNAAVSFNEIDTNSVEHAETVLRTNFHGAKMLTEALLPLFRQSPATSRILNISSQLGLLNKVSDSSLKALLLDEETLTEAAIDAMVSRFLAQVKDGTWGAQGWPKVWTDYSVSKLALNAYSRLLARRLQARGARVSVNCFCPGFTRTDMTRGWGKRTAEEVADVGARLALLPPGELPTGAFFKWCTPQLYSKL

SEQ ID NO: 4887 - protein, 319 aa, Olea europaea
  misc_feature (1)..(319): useful for making plants with increased cold tolerance as described in USSN 12/863,773
  misc_feature (1)..(319): Public GI ID no. 198285679
  misc_feature (1)..(319): Bit score of 219.9 for HMM based on sequences of FIGURE 2 of USSN 12/863,773.
  misc_feature (252)..(296): Pfam Name: CCT Pfam Desc: CCT motif
  misc_feature (1)..(46): Pfam Name: zf-B_box Pfam Desc: B-box zinc finger
  misc_feature (1)..(319): Functional Homolog Of SEQ ID NO. 20
MWVCEACERAPAAFLCKADAASLCITCDSDIHSAQPLARRHQRVPILPIPGMLCGTPSAPYPSGLVMGPTGVAAKIEFLTQDEDQTIHEEEDEDEAASWPLFNHVKNICNQSNNIGRFFGGEVDEYLDLDEYNSYQDNQFSNQDNNQLQPYDVSQKSYGSDNVVPIQYGKSKDQIHNHGFQLGREYEASKNVYDNPASISHTVSFSSLDVGVVPESTTSEVSVPHPRPPKGTIDLFSSPPIPMPTQLSPMDREARVLRYREKKKARKFEKTIRYASRKAYAETRPRIKGRFAKRTDVRANQMFSSTLIEEGGYGIVPSF

SEQ ID NO: 4888 - DNA, 982 bp, Arabidopsis thaliana
  misc_feature (1)..(982): useful for making plants with increased cold tolerance as described in USSN 12/863,773
  misc_feature (1)..(982): Ceres Clone ID no. 7088
atagagagaagaaaaagaagaggtttagagagagaaaaatggcgtcaaagctctgcgattcgtgcaaatcagcgacggcggcgttatactgccgaccagacgcagcgtttctatgcttaagctgcgattcaaaagtccacgcggcgaacaaactcgcgtcacgacacgcgcgcgtgtggatgtgtgaagtgtgcgagcaagcaccggcacacgtcacgtgcaaagcagacgcggccgcgttatgcgtcacgtgcgaccgtgatatccactcggctaatccgttagctcgccgtcacgaacgcgttcccgttactccgttttacgattccgtctctagtgacggttccgttaaacacaccgccgttaatttccttgacgactgttacttctccgatatagatggtaacggaagccgtgaagaagaggaggaagaagctgcttcgtggctgttacttcccaatccaaagactacaacgacggcgacggcggggatcgttgctgttacttcagctgaggaagttccgggagatagtccggagatgaacactggtcaacagtatttgttctcggatccggatccgtatctggatctggattatggaaatgttgatccgaaggtggaatcgttagagcagaatagctccggtactgatggtgttgttccggtggagaatcggacggttagaatcccgacggtgaacgagaattgctttgaaatggattttaccggaggatctaaaggctttgcttatggaggtggttacaattgcatcagtcacagcgtgtcatcatcgtcgatggaagtgggagtggtgccagatggtggttcggtggctgatgtatcgtatccttacggtggtcctgcaaccagtggagctgatccggggacacagcgggctgttccgctgacttcagctgagagagaagcgagggtaatgaggtacagagagaagaggaagaacaggaagtttgagaagactat

SEQ ID NO: 4889 - protein, 314 aa, Arabidopsis thaliana
  misc_feature (1)..(314): useful for making plants with increased cold tolerance as described in USSN 12/863,773
  misc_feature (1)..(314): Ceres Clone ID no. 7088
  misc_feature (1)..(314): Bit score of 334.7 for HMM based on sequences of FIGURE 2 of USSN 12/863,773.
  misc_feature (1)..(48): Pfam Name: zf-B_box Pfam Desc: B-box zinc finger
  misc_feature (295)..(314): Pfam Name: CCT Pfam Desc: CCT motif
  misc_feature (1)..(314): Functional Homolog Of SEQ ID NO. 20
MASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFAYGGGYNCISHSVSSSSMEVGVVPDGGSVADVSYPYGGPATSGADPGTQRAVPLTSAEREARVMRYREKRKNRKFEKT

SEQ ID NO: 4890 - protein, 350 aa, Populus x generosa
  misc_feature (1)..(350): useful for making plants with increased cold tolerance as described in USSN 12/863,773
  misc_feature (1)..(350): Public GI ID no. 118489345
  misc_feature (1)..(350): Bit score of 491.6 for HMM based on sequences of FIGURE 2 of USSN 12/863,773.
  misc_feature (1)..(48): Pfam Name: zf-B_box Pfam Desc: B-box zinc finger
  misc_feature (287)..(331): Pfam Name: CCT Pfam Desc: CCT motif
  misc_feature (1)..(350): Functional Homolog Of SEQ ID NO. 20
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGAAVNLLEDRYFDEVDGGRGDVSREEAEAESWLLPNPGGGTAKGVDSMDLNTGQYVFGSEMDPYLDLDPYVDPKVEVQEQNSSGTTDGVVPVQSNKLGFQAPALVNDNCCYELDFSTGSKSFGGGYGYNSLSHSVSSSSLDVGVVPDGSGSTLTDISNPYCSRSVSNGMESANQTVQLSAVDREARVLRYREKRKNRKFEKTIRYASRKAYAETRPRIKGRFAKRTDTEVEVDRSSLYGFGVVPSF

SEQ ID NO: 4891 - DNA, 1549 bp, Panicum virgatum
  misc_feature (1)..(1549): useful for making plants with increased cold tolerance as described in USSN 12/863,773
  misc_feature (1)..(1549): Ceres Clone ID no. 1769510
ctccctccactacgccgcgcgcgctccctcccacccctcccctccaccaccacaagcaccgcgtcgacaccacctgccatcgccgcgccgagctcagcctctagctagctgcgccaggagggcgcccgcctcgctccctccctgccgacgccagtgcgatggagctgcataagtactggggcgtggggggccggcggtgcggcgactgcgaggcggccccggcggcggtgcactgccgctcgtgccccgccaccgccgggggcgcgttcctctgcgctgcgtgcgacgcgcgcccggggcacgcgcggctgggccacgagcgcgtgtggatgtgcgaggtctgcgagctggcccccgccgccgtcacctgcaaggccgacgccgccgtgctctgcgccgcctgcgacgccgacatccacgacgccaacccgctggcgcgccgccatgcgcgcgtccccgtcgcgcccatcgggtccgaggccgccgcctccgccgtcgaggccatgctgttcgggaccggcgacggcgacccggccgcgcccgaggccgaggagccgcaggacgcggcggccgggcacgggcacgggcagctccagcaccaccaccagcacgcgctgaacctcaacgtggaggccaaggacatgaagctggactacctcttctccgacctggacccctacctcagcgtcgacatcccgcgcttccagcacgccgacagcgtcgtccccagcggcgtcggcgccggagccgccgccggcgccgtcgagctggacttcacgtgcggcatcggcgtcaagccctcctcgtacagctcctacacggcaacatccttcgcccacagcggctcctcctctgaggtcggcgtggtgccggaggccttctgcggcggcggcgccgggaccttcgagctcgacttcacccggcccaagcctcaagcctacatgccgtacaccgcgactcctcagagccacagcgtgtcgtcggtggacgtggaggtggcggcggcggagcggggggacatggcggcggcgaggccggtgccgctggtgggggagagccgggaggcgcggctgatgcgctaccgggagaagcggaagaaccggcggttcgagaagaccatccggtacgcgtcccggaaggcctacgccgagacgcggccgcggatcaagggccggttcgccaagcgcgccgaccacgacgccgacgacgccgaggccgaggccgccgtgccgtcgccggcgtcgtacgtgctcgacttcggctacggcgtcgtgcccagcttctgatcgatcgacgacggtccggcgggcggcggcgcgcctgacccggcactggcgcgcgcgccttgtgtacttgtatcgatgcatgatgtataggggaggaatagtaaatcccatgtactactctctttttggagctgtgctagccttgcgcacgctagtgatgtataatttgtatactacgcgctgctacttactactagcatgttcttgctggaattagccccggctatttttgaatcaaatctatgcaagaaatttgtaacggt

SEQ ID NO: 4892 - protein, 375 aa, Panicum virgatum
  misc_feature (1)..(375): useful for making plants with increased cold tolerance as described in USSN 12/863,773
  misc_feature (1)..(375): Ceres Clone ID no. 1769510
  misc_feature (1)..(375): Bit score of 695.5 for HMM based on sequences of FIGURE 2 of USSN 12/863,773.
  misc_feature (301)..(345): Pfam Name: CCT Pfam Desc: CCT motif
  misc_feature (54)..(101): Pfam Name: zf-B_box Pfam Desc: B-box zinc finger
  misc_feature (1)..(375): Functional Homolog Of SEQ ID NO. 20
MELHKYWGVGGRRCGDCEAAPAAVHCRSCPATAGGAFLCAACDARPGHARLGHERVWMCEVCELAPAAVTCKADAAVLCAACDADIHDANPLARRHARVPVAPIGSEAAASAVEAMLFGTGDGDPAAPEAEEPQDAAAGHGHGQLQHHHQHALNLNVEAKDMKLDYLFSDLDPYLSVDIPRFQHADSVVPSGVGAGAAAGAVELDFTCGIGVKPSSYSSYTATSFAHSGSSSEVGVVPEAFCGGGAGTFELDFTRPKPQAYMPYTATPQSHSVSSVDVEVAAAERGDMAAARPVPLVGESREARLMRYREKRKNRRFEKTIRYASRKAYAETRPRIKGRFAKRADHDADDAEAEAAVPSPASYVLDFGYGVVPSF

SEQ ID NO: 4893 - protein, 336 aa, Chenopodium rubrum
  misc_feature (1)..(336): useful for making plants with increased cold tolerance as described in USSN 12/863,773
  misc_feature (1)..(336): Public GI ID no. 170779038
  misc_feature (1)..(336): Bit score of 411.9 for HMM based on sequences of FIGURE 2 of USSN 12/863,773.
  misc_feature (13)..(60): Pfam Name: zf-B_box Pfam Desc: B-box zinc finger
  misc_feature (267)..(311): Pfam Name: CCT Pfam Desc: CCT motif
  misc_feature (1)..(336): Functional Homolog Of SEQ ID NO. 20
MMKKEVPGGDNNSWARVCDTCRSAPCTVYCKEDSAFLCTSCDARIHAVNQVASRHERVWVCEACEREPAAFLCKADAASLCATCDADIHSANPLARRHHRVPIMPVGCVYGPSDGRMSEEGFLDLPDGDDQTTDHEGDEDEAASWLLLNPGADNQFCEQYSQQQEFSVPEKNCGGDSVVPVQCREVKDHQIQYQKFLFGMECETKSEYNYNTSISHSVSVSSLDVGVVPESTMSDMSVSHSRPPKGTIDLFSSPPMQVPTQLSPLDREARVMRYREKKKNRKFEKTIRYASRKAYAETRPRIKGRFAKRTDVEAEMDQMFTNSLMSDGGYGIVPSF

SEQ ID NO: 4894 - DNA, 1357 bp, Panicum virgatum
  misc_feature (1)..(1357): useful for making plants with increased cold tolerance as described in USSN 12/863,773
  misc_feature (1)..(1357): Ceres Clone ID no. 1996408
aaaaacacccccgaggccaaccatttccgacgcaaaaccccccggaatccgtgacacccgcccggaggagagcagagcagaggcaccaggcatggacgccgcggtggagctggagctggagcagaagccggcggtggggtactggggcttggccggcgcgcggccctgcgacgcgtgcgccgcggaggcggcgcggctgcactgccgcgcggacggcgccttcctgtgccccgggtgcgacgcccgcgcgcacggcgccgggtcgcgccacgcgcgcgtctgtctctgcgaggtctgcgagcacgcccccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtcctcagccttcgccgccgcgggggtccaggcccagggggacgcggctgcggacgacgacgggagcaacgaggccgaggccgcctcgtggctcctccccgagcccgacaactgccacgaggacagcgccgccgccaccgacgccttcttcgctgactccgacgcgtacctcggcgtcgacctcgacttcgcccggtccatggacggcatcaaggccatcggcgtgccggtcgcgccgcccgagctggacatggccaccggcggttactactaccccgaacactccatgaaccacagcgtgtcgtcgtcggaggtggcggttgtgccggacgcgctggcgggcggcgccccggccgcgccggcggtgccggcggcgagccgggggaaggagcgggaggcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctcctccgcggaggccgaggccgaggacgaggcgctgctggagcacgaggaagcggcgtgcttctcgcccgcggcgtcggcgcccgcggcctcctcggacggcgtcgtcccgtcctgctgaggggacacgacgggcggcggccgcgcctcctcctcccaggctccccggcggcgaccccttaattttgccgactctgaatcgatcccaacgcatgcgaacatgcgatgcgatgcgcgctccgtgcagcacatgaataattgtacagtagttccacgaactcgatcgtggtcgcacggaatcgcatgtaatcctcctcaccgtccttgtaatccagccttgtacattaccgtctagaggtgtttgtgcttctctcgc

SEQ ID NO: 4895 - protein, 336 aa, Panicum virgatum
  misc_feature (1)..(336): useful for making plants with increased cold tolerance as described in USSN 12/863,773
  misc_feature (1)..(336): Ceres Clone ID no. 1996408
  misc_feature (1)..(336): Bit score of 649.8 for HMM based on sequences of FIGURE 2 of USSN 12/863,773.
  misc_feature (254)..(298): Pfam Name: CCT Pfam Desc: CCT motif
  misc_feature (21)..(65): Pfam Name: zf-B_box Pfam Desc: B-box zinc finger
  misc_feature (1)..(336): Functional Homolog Of SEQ ID NO. 20
MDAAVELELEQKPAVGYWGLAGARPCDACAAEAARLHCRADGAFLCPGCDARAHGAGSRHARVCLCEVCEHAPAAVTCRADAAALCAACDADIHSANPLARRHERLPVAPFFGALADAPQPFPSSAFAAAGVQAQGDAAADDDGSNEAEAASWLLPEPDNCHEDSAAATDAFFADSDAYLGVDLDFARSMDGIKAIGVPVAPPELDMATGGYYYPEHSMNHSVSSSEVAVVPDALAGGAPAAPAVPAASRGKEREARLMRYREKRKNRRFDKTIRYASRKAYAETRPRIKGRFAKRCSSAEAEAEDEALLEHEEAACFSPAASAPAASSDGVVPSC

SEQ ID NO: 4896 - DNA, 990 bp, Sorghum bicolor
  misc_feature (1)..(990): useful for making plants with increased cold tolerance as described in USSN 12/863,773
  misc_feature (1)..(990): Ceres Annot ID no. 8701721
atggagggcgacgagaagtcggcgggcggggccccggcgtactggggcctgggcgcgcggccctgcgacgcgtgcggcgccgatgcggcgcgcctctactgccgcgcggactcggcgttcctgtgcgccgggtgcgacgcgcgggcgcacggggccgggtcgcccaacgcgcgggtctggctctgcgaggtctgcgagcacgcgccggcggcggtcacgtgccgcgccgacgccgccgcgctctgcgcctcctgcgacgccgacatccactcggccaacccgctggcgcgacgccacgagcgcctccccgtggcgcccttcttcggcgcgctggccgacgcgcccaagcccttcgcctcgtcggcggcggccgtgccgcccaaagcgacggccggggccgacgacgacgggagcagcgaggccgaggcggcgtcgtggctcctccccgagcccgaccacgggcacaaagaagaaggcgccaccacggaggtgttcttcgcggactccgacccgtacctcgacctcgacttcgcgcgttccatggacgacatcaagaccatcggcgtccagggcgggccaccagagctcgacctcaacggcgccaagctcttctactccgaccactccatgaaccacagtgtgtcatcgtcggaggcagcggtggtgcccgacgcggcggctggcgcggcgcccgtggtggcagtggtcagcaggggcctggagcgggaggcgcggctgatgcggtaccgggagaagcgcaagagcaggcggttcgagaagacgatccggtacgcgtcccgcaaggcgtacgcggagacgcggccgcgcatcaagggccggttcgccaagcgcacgccgggggctggggaggacccgctggaggagcacgaggagatgtactcctcggccgcggcggccgtggctgcgctcatggcccccggcggagccgacgcggactacggcgtcgacggcgtcgtgcccacatattga

SEQ ID NO: 4897 - protein, 329 aa, Sorghum bicolor
  misc_feature (1)..(329): useful for making plants with increased cold tolerance as described in USSN 12/863,773
  misc_feature (1)..(329): Ceres Annot ID no. 8701721
  misc_feature (1)..(329): Bit score of 640.1 for HMM based on sequences of FIGURE 2 of USSN 12/863,773.
  misc_feature (242)..(286): Pfam Name: CCT Pfam Desc: CCT motif
  misc_feature (57)..(104): Pfam Name: zf-B_box Pfam Desc: B-box zinc finger
  misc_feature (1)..(329): Functional Homolog Of SEQ ID NO. 20
MEGDEKSAGGAPAYWGLGARPCDACGADAARLYCRADSAFLCAGCDARAHGAGSPNARVWLCEVCEHAPAAVTCRADAAALCASCDADIHSANPLARRHERLPVAPFFGALADAPKPFASSAAAVPPKATAGADDDGSSEAEAASWLLPEPDHGHKEEGATTEVFFADSDPYLDLDFARSMDDIKTIGVQGGPPELDLNGAKLFYSDHSMNHSVSSSEAAVVPDAAAGAAPVVAVVSRGLEREARLMRYREKRKSRRFEKTIRYASRKAYAETRPRIKGRFAKRTPGAGEDPLEEHEEMYSSAAAAVAALMAPGGADADYGVDGVVPTY

SEQ ID NO: 4898 - protein, 343 aa, Prunus persica
  misc_feature (1)..(343): useful for making plants with increased cold tolerance as described in USSN 12/863,773
  misc_feature (1)..(343): Public GI ID no. 197726026
  misc_feature (1)..(343): Bit score of 521.0 for HMM based on sequences of FIGURE 2 of USSN 12/863,773.
  misc_feature (1)..(48): Pfam Name: zf-B_box Pfam Desc: B-box zinc finger
  misc_feature (282)..(326): Pfam Name: CCT Pfam Desc: CCT motif
  misc_feature (1)..(343): Functional Homolog Of SEQ ID NO. 20
MASKLCDSCKSATATLFCRADSAFLCVNCDSKIHAANKLASRHARVWLCEVCEQAPAHVTCKADDAALCVTCDRDIHSANPLSRRHERVPVTPFYDSGNSAANSAPVVKSVVNFLDDRYFSDVDGQDAETEVSREEAEAASWLLPNPKAMENPDLNSGEYFLPEMDPYLDLDYGHVDPKLEDAQEQNSCGTDGVVPVQSKSVQPQLVNDHSFEIDFSAASKPYVYGFHAQCLSQSVSSSSMDVSVVPDGNTTMTDVCDPYTKSMSAAVESTHQAVQISSADREARVLRYREKRKNRKFEKTIRYASRKAYAETRPRIKGRFAKRTEVEIEAERLCRYGVVPSF

SEQ ID NO: 4899 - protein, 343 aa, Brassica nigra
  misc_feature (1)..(343): useful for making plants with increased cold tolerance as described in USSN 12/863,773
  misc_feature (1)..(343): Public GI ID no. 194244824
  misc_feature (1)..(343): Bit score of 289.3 for HMM based on sequences of FIGURE 2 of USSN 12/863,773.
  misc_feature (7)..(54): Pfam Name: zf-B_box Pfam Desc: B-box zinc finger
  misc_feature (281)..(325): Pfam Name: CCT Pfam Desc: CCT motif
  misc_feature (1)..(343): Functional Homolog Of SEQ ID NO. 20
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNSENNRFSVGEEYLDLVDYSSSMDKRFTGQANQYQQDYNVPQRSYVADGVVPLQVGVSKGHMHHEQHNFQFGFTNVSSEAHQISNGSPIHMVSLVPESVTSDATVSHQRSPKSGTEELPEAPVQMLSPMERKARVLRYREKKKTRKFEKRIRYASRKEYAEKRPRIKGRFAKRNEVDADQAFPTVVMFDTGYG

SEQ ID NO: 4900 - protein, 398 aa, Zea mays
  misc_feature (1)..(398): useful for making plants with increased cold tolerance as described in USSN 12/863,773
  misc_feature (1)..(398): Public GI ID no. 158866355
  misc_feature (1)..(398): Bit score of 329.2 for HMM based on sequences of FIGURE 2 of USSN 12/863,773.
  misc_feature (327)..(371): Pfam Name: CCT Pfam Desc: CCT motif
  misc_feature (27)..(74): Pfam Name: zf-B_box Pfam Desc: B-box zinc finger
  misc_feature (1)..(398): Functional Homolog Of SEQ ID NO. 20
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 4901 - DNA, 1320 bp, Glycine max
  misc_feature (1)..(1320): useful for making plants with increased cold tolerance as described in USSN 12/863,773
  misc_feature (1)..(1320): Ceres Clone ID no. 472076
tcttcactctcagaacactaactcccccaatgttggagggccaagcaacaacgcccacgtggccgcgcatgtgcgacacgtgccgctccgtcccctccaccgtcttctgccgctcccacaccgcctttctctgcgccacgtgcgacactcgcctccacgtctcgctcacgtggcacgagcgcgtgtgggtgtgcgaggcgtgcgagcgcgccccggcggcgttcctctgcaaggccgacgccgcctccctctgcgcctcctgcgacgccgacatccacgccgccaaccccctcgccagccgccaccaccgcgtccccatcctccccatcgccgccgccaacaacaacaacaacgacgacgacgacgttgctgacgttgacgacgaagacgaaaccgcttcatggctcttgctcaaccctatcaagagtgctactgtccctaacaccaataacaataacaataataacgggttcttgtataacggtgaggttgatgagtatttggaccttgttgataattgtaactcttgtggtgataataatcacttcgcttcagctgctgctactactgatcattacgctcagcaccaacatttcgctggtgtttctcagaagagttatgctggggacagtgttgttccggttcagcaacaccagcattttcagcttgggttggactttgacaactccaaacctgccttcagttacaatggttctgttagtcaaagtgtttcagtttcatcaatggatattggtgttgtacctgaatcaccaatgagggatgtctcaattgcccatacaagaccccccaaagggacaattgacctattttctggacctccaattcaggtgccttcccatttttctccaatggacagggaggccagagtcctaaggtacagggagaaaaagaagatgagaaaatttgagaagacaatcaggtatgcctcaaggaaggcctatgcagagactagacctcgtataaaaggtcgatttgccaagagaacagatgtagaagctgaagtggatcagatgttctcgacaacactaattacagaagttggatatggaattgttccctctttctgaatatgctgtgtagaacaaatggccagaagacattgaagatgctagaggatcatgattaatagaaatggaaaccacttgtgtactaagttattctgctgataatgtattttttatgtaatctaattgcttgcagttgtactaatcggatgctttattattttgtttattgtcttttgaatgaaacttgtatttgtaaatacagtccttgtattaaattattaaattacagtcg

SEQ ID NO: 4902 - protein, 352 aa, Glycine max
  misc_feature (1)..(352): useful for making plants with increased cold tolerance as described in USSN 12/863,773
  misc_feature (1)..(352): Ceres Clone ID no. 472076
  misc_feature (1)..(352): Bit score of 378.3 for HMM based on sequences of FIGURE 2 of USSN 12/863,773.
  misc_feature (283)..(327): Pfam Name: CCT Pfam Desc: CCT motif
  misc_feature (50)..(97): Pfam Name: zf-B_box Pfam Desc: B-box zinc finger
  misc_feature (1)..(352): Functional Homolog Of SEQ ID NO. 20
MLEGQATTPTWPRMCDTCRSVPSTVFCRSHTAFLCATCDTRLHVSLTWHERVWVCEACERAPAAFLCKADAASLCASCDADIHAANPLASRHHRVPILPIAAANNNNNDDDDVADVDDEDETASWLLLNPIKSATVPNTNNNNNNNGFLYNGEVDEYLDLVDNCNSCGDNNHFASAAATTDHYAQHQHFAGVSQKSYAGDSVVPVQQHQHFQLGLDFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 4903 - protein, 321 aa, Brassica rapa subsp. campestris
  misc_feature (1)..(321): useful for making plants with increased cold tolerance as described in USSN 12/863,773
  misc_feature (1)..(321): Public GI ID no. 33943521
  misc_feature (1)..(321): Bit score of 284.1 for HMM based on sequences of FIGURE 2 of USSN 12/863,773.
  misc_feature (252)..(296): Pfam Name: CCT Pfam Desc: CCT motif
  misc_feature (46)..(93): Pfam Name: zf-B_box Pfam Desc: B-box zinc finger
  misc_feature (1)..(321): Functional Homolog Of SEQ ID NO. 20
MLKEESNESGGTRACDTCRSAACTIYREADSTYLCTTCDARVHAAKRVRVCDSCESAPAAFFCKADAASLCTACDAEIHSANPLARRHQRVPITSNSCGSMATDGDNNVMMVSEEKEDADEVASWLMLNPGKNNQNNGFLFGVEYLDLVDYSSSIDNQFEDQYSKYHRSFGGGEDGVVPLQLEESSTSHMQQSQHNFHLGVNYGYSTEPQYSYVSVVPESLSDTTVQHAKETIDQVCGPPTQMVQQLTPADREARVLRYREKKKRRKFEKTIRYASRKAYAEVRPRIKGRFAKRIDMEADAEQLFSTSVMSNTSYGIVPSF

SEQ ID NO: 4904 - protein, 348 aa, Beta vulgaris subsp. vulgaris
  misc_feature (1)..(348): useful for making plants with increased cold tolerance as described in USSN 12/863,773
  misc_feature (1)..(348): Public GI ID no. 186911830
  misc_feature (1)..(348): Bit score of 348.6 for HMM based on sequences of FIGURE 2 of USSN 12/863,773.
  misc_feature (6)..(53): Pfam Name: zf-B_box Pfam Desc: B-box zinc finger
  misc_feature (313)..(348): Pfam Name: CCT Pfam Desc: CCT motif
  misc_feature (1)..(348): Functional Homolog Of SEQ ID NO. 20
MGGGLMAAKLCDSCKSATATIFCRADTAYLCISCDAKIHAANKLASRHARVWVCEVCEHAPATVTCKADAAHLCATCDRDIHSANPLARRHERVPLTPFYDPLSPPNTTNNNNDDSDSSATAAAAAKSAAINKLFGDEYYSDADEAEAASWLLPNPNKTDEPKSIDYLFSSSGNDGDDIDPYLDLDFGAEAKPDPDLSSDGVVPDPDQKGVHHHHLTTLQHPAASMFSLSSYHHHHHHHHVSNNNGHFDGFENSSAACKPFALSSYHTQPSLSHSVSSSSLDFGVVPDASNITDVASTGFDKQQQMKIIGMDREARVLRYREKRKNRKFEKTIRYASRKAYAETRPRI

SEQ ID NO: 4905 - DNA, 1077 bp, Solanum lycopersicum
  misc_feature (1)..(1077): useful for making plants with increased cold tolerance as described in USSN 12/863,773
  misc_feature (1)..(1077): Ceres Annot ID no. 8457547
atgggaacggagaattggagtttaacggcgaagttatgtgactcatgcaaaacgtcgccggcgacggtgttctgccgggcagattcagcatttctctgcttaggatgtgactgcaaaatccacgcagcgaacaagttagcgtcacgtcacgcgcgtgtctgggtttgtgaagtgtgtgagcaagctccggcgagtgtcacgtgtaaagcggatgccgctgctctctgcgttacgtgtgaccgtgatattcattcagcaaatccgttagctcgtcgccatgagcgttttccggtagttccgttctatgatttcgccgtcgcgaaatctcacggcggtggtgataccgatgccgatgctgttgatgatgagaagtactttgatagtactaatgagaatccttctcaaccagaggaagaagctgaagcagcgtcgtggatacttccgacgccgaaagaaggaactgatcagtataaatctgctgattacttgtttaatgatatggattcatatttagatatagatctaatgtcatgtgagcaaaaaccacatattcttcatcatcaacagcatcaacacaaccattacagctccgacggagttgtaccagtacagaacaacaacgaaactactcatttacccggtccagtcgttgatggattccctacatacgaactcgatttcactggatctaaaccttatatgtacaatttcacctctcaatcgatcagccaaagtgtttcatcatcatctcttgacgtcggagttgtaccagaccacagcacaatgacggatgtatcaaacacttttgtgatgaactcatcttccggtgctattgccggcgccggcgccgacgttgtaccgaatgcagtttccggtttagacagagaagcaagggtaatgaggtacagagagaagaggaagaatagaaagttcgagaagacgattcgatatgcttctagaaaagcttatgctgagactcggcccagaatcaaagggagattcgctaaacgtactgaaactgaaatcgattcactcatcaccgtcgatgcatcatacggtgtcgttccatcgttttaa

SEQ ID NO: 4906 - protein, 358 aa, Solanum lycopersicum
  misc_feature (1)..(358): useful for making plants with increased cold tolerance as described in USSN 12/863,773
  misc_feature (1)..(358): Ceres Annot ID no. 8457547
  misc_feature (1)..(358): Bit score of 531.8 for HMM based on sequences of FIGURE 2 of USSN 12/863,773.
  misc_feature (8)..(55): Pfam Name: zf-B_box Pfam Desc: B-box zinc finger
  misc_feature (295)..(339): Pfam Name: CCT Pfam Desc: CCT motif
  misc_feature (1)..(358): Functional Homolog Of SEQ ID NO. 20
MGTENWSLTAKLCDSCKTSPATVFCRADSAFLCLGCDCKIHAANKLASRHARVWVCEVCEQAPASVTCKADAAALCVTCDRDIHSANPLARRHERFPVVPFYDFAVAKSHGGGDTDADAVDDEKYFDSTNENPSQPEEEAEAASWILPTPKEGTDQYKSADYLFNDMDSYLDIDLMSCEQKPHILHHQQHQHNHYSSDGVVPVQNNNETTHLPGPVVDGFPTYELDFTGSKPYMYNFTSQSISQSVSSSSLDVGVVPDHSTMTDVSNTFVMNSSSGAIAGAGADVVPNAVSGLDREARVMRYREKRKNRKFEKTIRYASRKAYAETRPRIKGRFAKRTETEIDSLITVDASYGVVPSF

SEQ ID NO: 4907 - protein, 369 aa, Lolium perenne
  misc_feature (1)..(369): useful for making plants with increased cold tolerance as described in USSN 12/863,773
  misc_feature (1)..(369): Public GI ID no. 188484477
  misc_feature (1)..(369): Bit score of 209.9 for HMM based on sequences of FIGURE 2 of USSN 12/863,773.
  misc_feature (300)..(344): Pfam Name: CCT Pfam Desc: CCT motif
  misc_feature (22)..(69): Pfam Name: zf-B_box Pfam Desc: B-box zinc finger
  misc_feature (1)..(369): Functional Homolog Of SEQ ID NO. 20
MLMNCDFNCDLFEQEAKRRSYPWARPCDGCHAAPSAVYCHADAAYLCASCDTQVHSANRLASSHERVRVCVSCESAAAVLECHADSAALCTTCDAQVHSANPIAQRHQRVPVLPLPALAIPAASVFAEAEAATTVYGDKEEGEEVDSWLLLERDSDDNNCTNNIDQYFNLFGYDMYYDKFSCNPGPGEEYRLQEQDVQNMYRENEVCEFAVPSQVGMASEQPESSYGMIGAEQDASMTAGTSTYTASISNGIPFSSMEVGIIPDNTRPDVSNTNIQRTSEAMELAGHSLQMPVHFSSMDRDARVLRYKEKKQARTFQKTIRYATRKAYAEARPRIKGRFAKRSDIEHELDQMLTIPALPDSGHATVLWF

SEQ ID NO: 4908 - DNA, 1131 bp, Sorghum bicolor
  misc_feature (1)..(1131): useful for making plants with increased cold tolerance as described in USSN 12/863,773
  misc_feature (1)..(1131): Ceres Annot ID no. 8743875
atggagctgcacaagtactggggcgtgggtggccggcggtgcggcagctgcgaggcggcgccggcggcggtgcactgccgcacgtgcgtcggcgggtcgtcgtcgttcctctgcacgacgtgcgacgcgcgccccgcgcacgcgcgcctggcccacgagcgcgtgtgggtgtgcgaggtctgcgagctggcccccgccgccgtcacgtgcaaggccgacgccgccgtgctctgcgccgcctgcgacgccgacatccacgacgccaacccgctggcgcgccgccacgcgcgggtccccgtcgcgcccatcggctccgaggccgccgccgcggccgtcgaggccatgctgttcgggaccggcgacgcggccgaggccgacgaccagcacaacaacgcggcggcggcggccgagcagcatcagcatcagcaccacgctcaccacgcgcacgcgctgaacctcaacgtggaggcgaaggacatgaagctggactacctcttctctgagctggatccctacctcagcgtcgagatcccgcgcttccaccacgccgacagcgtcgtccccaacggcgccggcgctgccggcgccgtcgagctcgacttcacgtgcggcatcggcgtcaagcactcctcctacagctcctacaccgccacctccctcgatctcgcgcatagcggctcctcgtcggaggtcggcgtggtgccagaggccttcggcggcggcggcggcggcggcggcgggagctttgagctcgacttcacaaggccaaagcctcaggcctacatgccatacacggcgactccccagagccacagcgtgtcgtccgtggacgtggaggtggtgccggagcggggagacttgccggcggtgaggccggtgccgctgatgggggagagccgggaggcgcggctgatgcggtaccgtgagaagaggaagaaccggcggttcgagaagaccatccggtacgcgtcccggaaggcctacgccgagacgcggccgcggatcaaggggaggtttgccaagcgcgccgaccacgacggcgacggcgacgccgacgacgccgaggccgaggccgccgtgccgtcgtcgtacgtgctcgacttcggctacggcgtcgtgccgagcttctga

SEQ ID NO: 4909 - protein, 376 aa, Sorghum bicolor
  misc_feature (1)..(376): useful for making plants with increased cold tolerance as described in USSN 12/863,773
  misc_feature (1)..(376): Ceres Annot ID no. 8743875
  misc_feature (1)..(376): Bit score of 743.4 for HMM based on sequences of FIGURE 2 of USSN 12/863,773.
  misc_feature (300)..(344): Pfam Name: CCT Pfam Desc: CCT motif
  misc_feature (53)..(100): Pfam Name: zf-B_box Pfam Desc: B-box zinc finger
  misc_feature (1)..(376): Functional Homolog Of SEQ ID NO. 20
MELHKYWGVGGRRCGSCEAAPAAVHCRTCVGGSSSFLCTTCDARPAHARLAHERVWVCEVCELAPAAVTCKADAAVLCAACDADIHDANPLARRHARVPVAPIGSEAAAAAVEAMLFGTGDAAEADDQHNNAAAAAEQHQHQHHAHHAHALNLNVEAKDMKLDYLFSELDPYLSVEIPRFHHADSVVPNGAGAAGAVELDFTCGIGVKHSSYSSYTATSLDLAHSGSSSEVGVVPEAFGGGGGGGGGSFELDFTRPKPQAYMPYTATPQSHSVSSVDVEVVPERGDLPAVRPVPLMGESREARLMRYREKRKNRRFEKTIRYASRKAYAETRPRIKGRFAKRADHDGDGDADDAEAEAAVPSSYVLDFGYGVVPSF

SEQ ID NO: 4910 - protein, 444 aa, Picea abies
  misc_feature (1)..(444): useful for making plants with increased cold tolerance as described in USSN 12/863,773
  misc_feature (1)..(444): Public GI ID no. 193735598
  misc_feature (1)..(444): Bit score of 405.5 for HMM based on sequences of FIGURE 2 of USSN 12/863,773.
  misc_feature (377)..(421): Pfam Name: CCT Pfam Desc: CCT motif
  misc_feature (79)..(126): Pfam Name: zf-B_box Pfam Desc: B-box zinc finger
  misc_feature (1)..(444): Functional Homolog Of SEQ ID NO. 20
MVKEEDKDWHTVEDLHRGSHVDHKEFLRGIGGWRMSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 4911 - protein, 384 aa, Picea sitchensis
  misc_feature (1)..(384): useful for making plants with increased cold tolerance as described in USSN 12/863,773
  misc_feature (1)..(384): Public GI ID no. 116787635
  misc_feature (1)..(384): Bit score of 467.1 for HMM based on sequences of FIGURE 2 of USSN 12/863,773.
  misc_feature (23)..(70): Pfam Name: zf-B_box Pfam Desc: B-box zinc finger
  misc_feature (320)..(364): Pfam Name: CCT Pfam Desc: CCT motif
  misc_feature (1)..(384): Functional Homolog Of SEQ ID NO. 20
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDHDDDDEIYAAEAASWLLPNPKSSAEGTKNCDDGGSCFGVDAGPPVNKAAGGYFSVVDLFPDVDPYLDLDYASPLEATGGTDSVVPVQSNVSSQDGAVSTPSDCFDTEKVTYSYTTTTSLSHSVSSSSLDVGVVPDATLSDMPRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 4912 - protein, 383 aa, Triticum aestivum
  misc_feature (1)..(383): useful for making plants with increased cold tolerance as described in USSN 12/863,773
  misc_feature (1)..(383): Public GI ID no. 169807976
  misc_feature (1)..(383): Bit score of 230.7 for HMM based on sequences of FIGURE 2 of USSN 12/863,773.
  misc_feature (314)..(358): Pfam Name: CCT Pfam Desc: CCT motif
  misc_feature (19)..(66): Pfam Name: zf-B_box Pfam Desc: B-box zinc finger
  misc_feature (1)..(383): Functional Homolog Of SEQ ID NO. 20
MNCVSNGTVYEEAVGREGSWARLCDGCCTVPSVVYCRADSAYLCASCDAQIHAANRVASRHERVLLSEAYKHAPVVLECHADAAALCAAYEAQVHYANLLATMHQRVPVVSHPVAAIPAASLFAEAAATAPVLGSKEEDASWLLLSKDSDNHNHSGNHSSSSSSSRYFGEVDQYFDLVGYNSYYDSHMNNQEQYVMQEQQHLQQMQKEYAEQQMQKEYVEKEGSECIVPSQSAIVSRPHQSGYAPLVRAEQAASVTAGVSAYTDSVNNSISFSMEAGIVPDNTVQSSILRPAGAIGHFSSPSLQTPLHFSSKEREARVLRYKEKKKSRKFEKTTRYATRKAYAEARPRIKGRFAKRSDADMEVDQTFSTAALSDSSYSTVPWF

SEQ ID NO: 4913 - protein, 397 aa, Zea mays
  misc_feature (1)..(397): useful for making plants with increased cold tolerance as described in USSN 12/863,773
  misc_feature (1)..(397): Public GI ID no. 157422228
  misc_feature (1)..(397): Bit score of 334.9 for HMM based on sequences of FIGURE 2 of USSN 12/863,773.
  misc_feature (326)..(370): Pfam Name: CCT Pfam Desc: CCT motif
  misc_feature (27)..(74): Pfam Name: zf-B_box Pfam Desc: B-box zinc finger
  misc_feature (1)..(397): Functional Homolog Of SEQ ID NO. 20
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEATATAASVAGDKDEEVDSWLLLTKDPDDDDKNHNCSSNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISYSSSMEVGIVPDNMATTDMPSSGILLTPAGAISLFSSGPPLQMPLHLASMDREARVLRYREKKKSRKFEKTIRYATRKTYAEARPRIKGRFAKRSSDMDDEVDQMFSAAALSSDGSYGTVPWF

SEQ ID NO: 4914 - DNA, 1423 bp, Panicum virgatum
  misc_feature (1)..(1423): useful for making plants with increased cold tolerance as described in USSN 12/863,773
  misc_feature (1)..(1423): Ceres Clone ID no. 1755159
gcgcgctccctcccctcccctcctcccaccagcccaccaccaccacaagcaccgcgtcgtccacaccacctgccattgccgcgccgagctcagcctctagctgcgccaggagggcgcccgcctccctccctgccgacgccggtgtgatggagctgcacaagtactggggcgtggggggccgccggtgcggcggctgcgaggcggccccggcggcggtgcactgccgctcgtgccccgccgggggcgcgttcctctgcacggcgtgcgacgcgcgcccggggcacgcgcatctgggccacgagcgcgtgtggatgtgcgaggtctgcgagctggcgcccgccgccgtcacgtgcaaggccgacgccgccgtgctctgcgccgcctgcgacgccgacatccacgacgccaacccgctggcgcgccgccacgcacgcgtccccgtcgcgcccatcggctcggaggccgcggccgccgccgtggaggccatgctgttcgggaccggcgagccggccgcgtccgaggccgaggagccgcagaacgcggcggccaggcacaaccaccagcacgcgctgaacctcaacgtggaggccaaggacatgaagctggactacctcttttccgacctggacccctacctcagcgtcgatatcccgcgcttccagcacgccgacagcgtcgtccccagcggcgtcggcgccggagcagccggcgccgtcgagctggacttcacgtgcggcatcggcgtcgagccctcctcatacagctcctacacggcaacatccctcgcccacagcggctcctcttctgaggtcggcgtggtgccagaggccttctgcggcggcggcgggagcttcgagctcgacttcacaaggcccaagcctcaagcctacatgccgtacaccgcgactcctcaaagtcacagcgtgtcgtcggtggacgtggaggtggtgccggagcggggggacatgatggcggcggcgaggccggtgccgctggtgggggagagccgggaggcgcggctgatgcgctaccgggagaagcggaagaaccggcggttcgagaagaccatccggtacgcgtcccggaaggcctacgccgagatgcggccgcggatcaagggccggttcgccaagcgcgccgaccacgacgccgacgccgacgacaccgaggccgaggccgaggccgccgtgccgtcgccggcgtcgtacgtgctcgacttcggctacggcgtcgtgcccagcttctgatcgacgacgatcgtctcgctcgttccacgcgcggcgcgcttgacccggcccggcgcgcgcgccttgtacttgtatcgatgcatgtataggggaggaatagtaatcccatgtactctcgtcttggagctgcgctagccctgcgtacgtacgctagtgatgtataatttgtacaaccc

SEQ ID NO: 4915 - protein, 366 aa, Panicum virgatum
  misc_feature (1)..(366): useful for making plants with increased cold tolerance as described in USSN 12/863,773
  misc_feature (1)..(366): Ceres Clone ID no. 1755159
  misc_feature (1)..(366): Bit score of 709.8 for HMM based on sequences of FIGURE 2 of USSN 12/863,773.
  misc_feature (288)..(332): Pfam Name: CCT Pfam Desc: CCT motif
  misc_feature (52)..(99): Pfam Name: zf-B_box Pfam Desc: B-box zinc finger
  misc_feature (1)..(366): Functional Homolog Of SEQ ID NO. 20
MELHKYWGVGGRRCGGCEAAPAAVHCRSCPAGGAFLCTACDARPGHAHLGHERVWMCEVCELAPAAVTCKADAAVLCAACDADIHDANPLARRHARVPVAPIGSEAAAAAVEAMLFGTGEPAASEAEEPQNAAARHNHQHALNLNVEAKDMKLDYLFSDLDPYLSVDIPRFQHADSVVPSGVGAGAAGAVELDFTCGIGVEPSSYSSYTATSLAHSGSSSEVGVVPEAFCGGGGSFELDFTRPKPQAYMPYTATPQSHSVSSVDVEVVPERGDMMAAARPVPLVGESREARLMRYREKRKNRRFEKTIRYASRKAYAEMRPRIKGRFAKRADHDADADDTEAEAEAAVPSPASYVLDFGYGVVPSF

SEQ ID NO: 4916 - protein, 362 aa, Chenopodium rubrum
  misc_feature (1)..(362): useful for making plants with increased cold tolerance as described in USSN 12/863,773
  misc_feature (1)..(362): Public GI ID no. 170779036
  misc_feature (1)..(362): Bit score of 423.2 for HMM based on sequences of FIGURE 2 of USSN 12/863,773.
  misc_feature (13)..(60): Pfam Name: zf-B_box Pfam Desc: B-box zinc finger
  misc_feature (297)..(341): Pfam Name: CCT Pfam Desc: CCT motif
  misc_feature (1)..(362): Functional Homolog Of SEQ ID NO. 20
MMKKEVPGGDNNSWARVCDTCRSAPCTVYCKEDSAFLCTSCDARIHAVNQMASRHERVWVCEACEREPAAFLCKADAASLCATCDADIHSANPLARRHHRVPIMPVGCVYGPSDGRMSEDGFLDLPDRDDQTTDHEGDEDEAASWLLLNPGKNSNNQTTNGFLTGGGEVDEYLDLFEYNSGADNQFCEQYNQQQEFSVPEKNCGGDSVVPVQCREVKDHQIQYQNFLFGMECETKSEYTYNTSISHSVSVSSLDVGVVPESTMSDMSVSHSRPPKGTIDLFSSTPMQVPTQLSPLDREARVMRYREKKKNRKFEKTIRYASRKAYAETRPRIKGRFAKRTDVEAERTNSLMSDGGYGIVPSF

SEQ ID NO: 4917 - DNA, 1116 bp, Oryza sativa
  misc_feature (1)..(1116): useful for making plants with increased cold tolerance as described in USSN 12/863,773
  misc_feature (1)..(1116): Ceres Annot ID no. 1731456
atgatggagttgcgcaagtactggggcgtcggcgggcggcggtgcggtgcgtgcgaggcgtcgccggcggccgtgcactgccgcggctgcggcggggtgtacctgtgcacggcgtgcgacgcgcgcccgggccacgcgcgggcggcgcacgagcgggtgtgggtgtgcgaggtctgcgaggtggcgcccgccgccgtcacctgcaaggccgacgccgcggtgctctgcgccgcctgcgacgccgacatccacgacgccaacccgctggcccgccgccacgcgcgcgtccccgtcgcgcccatcggctccgccgccgccgccgccgtggccgccgaggccatgctgttcggcgtcgccgccgccggggccgaggccgaggcggtggaggataaggccgcggccgagcaccaccaccaccagcagcggcagcagcacggcgcgctcaacctcaacgtggaggcgaaggacatgaagctcgactacctcttctccgacctcgacccttacctcaacgtcgagttcgcccgcttcccccacgccgacagcgtcgtccccaacggcgccggcgccggcgccgccatagagctcgacttcacctgcggcctaggcgtcggcgtcggcggcgccaagcagtcctacagctcctacaccgccaccgacctcgctcacagcggctcgtcgtcggaggtgggcgtggtgccggaggccatgtgcggcggcggcggcgccatcgatctcgacttcacgaggccgaagcctcaaccctacatgccgtacacggcgactcctcctccgagccacagcgtagtaagcgcgcagatgtcgtcgtcggtggtcgacgtgggcgtggtgccggagcgggcggcggcgatgggggaagggagggaggcgaggctgatgaggtacagggagaagcggaagaaccggcggttcgagaagacgatccggtacgcgtcgcgcaaggcctacgccgagacgcgcccccggatcaagggccgcttcgccaagcgcgccgaccacgacgccgacgacgccgacgccgacgccgacgaccccgccgccgtcccatcctcctacatgctcgacttcggctacggcgtcgtcccgtccttctga

SEQ ID NO: 4918 - protein, 371 aa, Oryza sativa
  misc_feature (1)..(371): useful for making plants with increased cold tolerance as described in USSN 12/863,773
  misc_feature (1)..(371): Ceres Annot ID no. 1731456
  misc_feature (1)..(371): Bit score of 611.8 for HMM based on sequences of FIGURE 2 of USSN 12/863,773.
  misc_feature (295)..(339): Pfam Name: CCT Pfam Desc: CCT motif
  misc_feature (51)..(98): Pfam Name: zf-B_box Pfam Desc: B-box zinc finger
  misc_feature (1)..(371): Functional Homolog Of SEQ ID NO. 20
MMELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVAAEAMLFGVAAAGAEAEAVEDKAAAEHHHHQQRQQHGALNLNVEAKDMKLDYLFSDLDPYLNVEFARFPHADSVVPNGAGAGAAIELDFTCGLGVGVGGAKQSYSSYTATDLAHSGSSSEVGVVPEAMCGGGGAIDLDFTRPKPQPYMPYTATPPPSHSVVSAQMSSSVVDVGVVPERAAAMGEGREARLMRYREKRKNRRFEKTIRYASRKAYAETRPRIKGRFAKRADHDADDADADADDPAAVPSSYMLDFGYGVVPSF

SEQ ID NO: 4919 - DNA, 1251 bp, Panicum virgatum
  misc_feature (1)..(1251): useful for making plants with increased cold tolerance as described in USSN 12/863,773
  misc_feature (1)..(1251): Ceres Clone ID no. 1770031
agcgagctcccggcgcgcgataatggagggtgacgagaagtcggcaggcggggccccggccccggcctactggggcctgggcgcgcggccctgcgacgcgtgcggcgacgaggcggcgaggctctactgccgcgcggacgcggcgttcctctgcgccgggtgcgacgcgcgcgcgcacggcgccgggtcgcgccacgcccgcgtctggctctgcgaggtctgcgagcacgcgccggccgcggtcacgtgccgcgcggacgccgccgcgctctgcgcctcgtgcgacgccgacatccactccgccaacccgctcgcgcgccgccacgagcgccaggccgtggcgcccttctacggcgcgctggccgacgcgcccaagcccttcgcctcgtcggcggccgtgcccaaagcggccgacgacgacgggagcaacgaggccgaggcggcgtcgtggctcctccccgagcccgaccacgggctcaaggaaggcgccacgacggaggtgttcttcgcggactccgacccgtacctcgacctcgacttcgcgcgcaccatggacgacatcaaggccatcggcgtccagaacggccccgccgagctcgacctcaccggcgccaagctcttctactccgaccactccatgaaccacagcgtgtcgtcatcggaggcagcagtggtgcccgacgcggcggcgggcgcggcgcccgtggttccagtggtgagcaggggtctggagcgggaggcccggctgatgcggtaccgggagaagcgcaagagccggcggttcgagaagacgatccggtacgcgtcccgcaaggcgtacgcggagacgcggccgcgcatcaagggccggttcgccaagcgcacccccgggcccggcggcgcggacggggaggacccgctggaggagcacgaggaggagatgtactcctccgccgcggcagccgtggccgcgctcatggtccccggcggcgccgacgccgactacggcgtcgtgcccacgtattgatcggcgccggcctgttgtaacactagccagcctcgacctcgccgccggggctgtaatttttgctgcatgccctgcatgcaaagctgccgtgtagcattaattacctgtaatatgattccacggaagccatcaggccggacttccaagctattcttcctccctaatcattccgccatgtatgtatattattatgagtaaattgcactcatcatacaataaattgacagatagatacaaattgatcc

SEQ ID NO: 4920 - protein, 327 aa, Panicum virgatum
  misc_feature (1)..(327): useful for making plants with increased cold tolerance as described in USSN 12/863,773
  misc_feature (1)..(327): Ceres Clone ID no. 1770031
  misc_feature (1)..(327): Bit score of 643.2 for HMM based on sequences of FIGURE 2 of USSN 12/863,773.
  misc_feature (238)..(282): Pfam Name: CCT Pfam Desc: CCT motif
  misc_feature (19)..(63): Pfam Name: zf-B_box Pfam Desc: B-box zinc finger
  misc_feature (1)..(327): Functional Homolog Of SEQ ID NO. 20
MEGDEKSAGGAPAPAYWGLGARPCDACGDEAARLYCRADAAFLCAGCDARAHGAGSRHARVWLCEVCEHAPAAVTCRADAAALCASCDADIHSANPLARRHERQAVAPFYGALADAPKPFASSAAVPKAADDDGSNEAEAASWLLPEPDHGLKEGATTEVFFADSDPYLDLDFARTMDDIKAIGVQNGPAELDLTGAKLFYSDHSMNHSVSSSEAAVVPDAAAGAAPVVPVVSRGLEREARLMRYREKRKSRRFEKTIRYASRKAYAETRPRIKGRFAKRTPGPGGADGEDPLEEHEEEMYSSAAAAVAALMVPGGADADYGVVPTY

SEQ ID NO: 4921 - protein, 345 aa, Brassica nigra
  misc_feature (1)..(345): useful for making plants with increased cold tolerance as described in USSN 12/863,773
  misc_feature (1)..(345): Public GI ID no. 194244874
  misc_feature (1)..(345): Bit score of 278.5 for HMM based on sequences of FIGURE 2 of USSN 12/863,773.
  misc_feature (7)..(54): Pfam Name: zf-B_box Pfam Desc: B-box zinc finger
  misc_feature (283)..(327): Pfam Name: CCT Pfam Desc: CCT motif
  misc_feature (1)..(345): Functional Homolog Of SEQ ID NO. 20
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEAHQISNGSPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 4922 - protein, 384 aa, Picea abies
  misc_feature (1)..(384): useful for making plants with increased cold tolerance as described in USSN 12/863,773
  misc_feature (1)..(384): Public GI ID no. 150014754
  misc_feature (1)..(384): Bit score of 466.3 for HMM based on sequences of FIGURE 2 of USSN 12/863,773.
  misc_feature (23)..(70): Pfam Name: zf-B_box Pfam Desc: B-box zinc finger
  misc_feature (320)..(364): Pfam Name: CCT Pfam Desc: CCT motif
  misc_feature (1)..(384): Functional Homolog Of SEQ ID NO. 20
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDDDEDDEIYAAEAASWLLPNPKSSAEGAKNCDDGGSCFGVDAGPPVNKAAGGYFSVVDLFPDVDPYLDLDYASPLEATGGTDSVVPVQSNVSSQDGAVSTPSDCFDTEKATYSYTTTTSLSHSVSSSSLDVGVVPDATLSDMSRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 4923 - protein, 340 aa, Brassica nigra
  misc_feature (1)..(340): useful for making plants with increased cold tolerance as described in USSN 12/863,773
  misc_feature (1)..(340): Public GI ID no. 194244844
  misc_feature (1)..(340): Bit score of 276.3 for HMM based on sequences of FIGURE 2 of USSN 12/863,773.
  misc_feature (7)..(54): Pfam Name: zf-B_box Pfam Desc: B-box zinc finger
  misc_feature (280)..(324): Pfam Name: CCT Pfam Desc: CCT motif
  misc_feature (1)..(340): Functional Homolog Of SEQ ID NO. 20
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTG

SEQ ID NO: 4924 - protein, 340 aa, Malus x domestica
  misc_feature (1)..(340): useful for making plants with increased cold tolerance as described in USSN 12/863,773
  misc_feature (1)..(340): Public GI ID no. 189014382
  misc_feature (1)..(340): Bit score of 510.4 for HMM based on sequences of FIGURE 2 of USSN 12/863,773.
  misc_feature (1)..(48): Pfam Name: zf-B_box Pfam Desc: B-box zinc finger
  misc_feature (279)..(323): Pfam Name: CCT Pfam Desc: CCT motif
  misc_feature (1)..(340): Functional Homolog Of SEQ ID NO. 20
MALKLCDSCKSATGTLFCRADSAFLCVNCDSKIHAANKLASRHARVWLCEVCEQAPAHVTCKADDAALCVTCDRDIHSANPLSRRHERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 4925 - protein, 386 aa, Solanum lycopersicum
  misc_feature (1)..(386): useful for making plants with increased cold tolerance as described in USSN 12/863,773
  misc_feature (1)..(386): Public GI ID no. 186915025
  misc_feature (1)..(386): Bit score of 486.0 for HMM based on sequences of FIGURE 2 of USSN 12/863,773.
  misc_feature (307)..(351): Pfam Name: CCT Pfam Desc: CCT motif
  misc_feature (22)..(63): Pfam Name: zf-B_box Pfam Desc: B-box zinc finger
  misc_feature (1)..(386): Functional Homolog Of SEQ ID NO. 20
MGIFREAPNCFPGGWNIGAAARMAKSCEYCHLAAALVFCRTDNTFVCLSCDTRLHARHERVWVCEVCEQAAASVTCRADAAALCVACDRDIHSANPLARRHERVPVVPFYDPVESVVKSTAATLLVSINGTTTTATTTATITPELGKVDTCIGHHENNNDPWIPPNTITSKLPLNTEMKGMDFIFTDSENFLDFDYPACVDTQSQPHYNSSNDSVVPVQANTPIKSLPFHHQEKHFEIDFTQSHIKSYNTPSLSVSSSSLDVGIVPDGSSISEISYPYIRTMNNSNSSIDLSNSANHQGEKLLGLDREARVLRYREKKKNRKFEKTIRYASRKAYAETRPRIKGRFAKRTDGSAGAGEFDDVDGIFSGTDFIAAESRYGVVPSFLT

SEQ ID NO: 4926 - DNA, 772 bp, Zea mays
  misc_feature (1)..(772): useful for making plants with increased cold tolerance as described in USSN 12/863,773
  misc_feature (1)..(772): Ceres Clone ID no. 100941305
gatggagggtgacgagaagtcggcgggcggggcccctgcttactggggcctgggcgcgcggccctgcgacgcgtgcggcgccgaggcggcgcgcctctactgccgcgcggacgcggcgttcctgtgcgccgggtgcgacgcgcgggcgcacggcgccgggtcgcgccacgcgcgggtctggctctgcgaggtctgcgagcacgcgccggcggcggtcacgtgccgcgcggacgctgccgcgctctgcgcctcctgcgacgccgacatccactcggcgaacccgctcgcgcgccgccacgagcgcctccacgtggcgcccttcttcggcgcgctggccgacgcgcccaagcccttcgcctcggcggcgccgcccaaagcaaccgacgacgacgggagcaacgaggacgaggcggcgtcgtggctcctccccgagcccgaccacgggcagaaagaaggcgccacgacggaggtgttcttcgcggactctgacccgtacctcgacctcgacttcgcgcgttccatggacgaaatcaagaccatcggcgtccagcagagcgggtcaccagagctcgacctcgccggcaccaagctcttctactccgatcactccgtgaaccacagtgtgtcatcgtcggaggcagcggttgtgcccgacgcggcgtctggcatggcgcccatggtggcagtggtcagcaggggcctggagcgagaggcgcggctgatgcggtaccgggagaagcgcaagagcaggcggttcgagaagacgatccgg

SEQ ID NO: 4927 - protein, 257 aa, Zea mays
  misc_feature (1)..(257): useful for making plants with increased cold tolerance as described in USSN 12/863,773
  misc_feature (1)..(257): Ceres Clone ID no. 100941305
  misc_feature (1)..(257): Bit score of 429.2 for HMM based on sequences of FIGURE 2 of USSN 12/863,773.
  misc_feature (17)..(61): Pfam Name: zf-B_box Pfam Desc: B-box zinc finger
  misc_feature (236)..(257): Pfam Name: CCT Pfam Desc: CCT motif
  misc_feature (1)..(257): Functional Homolog Of SEQ ID NO. 20
MEGDEKSAGGAPAYWGLGARPCDACGAEAARLYCRADAAFLCAGCDARAHGAGSRHARVWLCEVCEHAPAAVTCRADAAALCASCDADIHSANPLARRHERLHVAPFFGALADAPKPFASAAPPKATDDDGSNEDEAASWLLPEPDHGQKEGATTEVFFADSDPYLDLDFARSMDEIKTIGVQQSGSPELDLAGTKLFYSDHSVNHSVSSSEAAVVPDAASGMAPMVAVVSRGLEREARLMRYREKRKSRRFEKTIR

SEQ ID NO: 4928 - protein, 358 aa, Vitis vinifera
  misc_feature (1)..(358): useful for making plants with increased cold tolerance as described in USSN 12/863,773
  misc_feature (1)..(358): Public GI ID no. 157341339
  misc_feature (1)..(358): Bit score of 452.0 for HMM based on sequences of FIGURE 2 of USSN 12/863,773.
  misc_feature (289)..(333): Pfam Name: CCT Pfam Desc: CCT motif
  misc_feature (18)..(65): Pfam Name: zf-B_box Pfam Desc: B-box zinc finger
  misc_feature (1)..(358): Functional Homolog Of SEQ ID NO. 20
MLKDEGCNADAAAGGGGGWARVCDTCRSAACTIYCRADSAYLCAGCDARIHAANRVASQHERVWVCESCERAPAAFVCKADAASLCATCDADIHSANPLARRHHRVPVLPIAGCLYGPPATDPGGTVTIDEEDEDEAASWLLLNPVKNNNGSSNNQNNGLLFGGEVDEYLDLVEYNSCPENQFSDQYNQQQPPPHYSVPHKNYGGDRVVPVQCGEAKGQLHQQHQQQGFHLGMDHSVSVSSMDVGVVPEATTMSDISISISHPRPPKGTIDLFSGPPIQMPTQLTPMDREARVLRYREKKKTRKFEKTIRYASRKAYAETRPRIKGRFAKRTDVEVEVDQMFSTTLMAESGYGIVPSF

SEQ ID NO: 4929 - protein, 338 aa, Vitis vinifera
  misc_feature (1)..(338): useful for making plants with increased cold tolerance as described in USSN 12/863,773
  misc_feature (1)..(338): Public GI ID no. 157327254
  misc_feature (1)..(338): Bit score of 612.5 for HMM based on sequences of FIGURE 2 of USSN 12/863,773.
  misc_feature (1)..(48): Pfam Name: zf-B_box Pfam Desc: B-box zinc finger
  misc_feature (271)..(315): Pfam Name: CCT Pfam Desc: CCT motif
  misc_feature (1)..(338): Functional Homolog Of SEQ ID NO. 20
MASKLCDSCKSAPPTLFCRADSAFLCVACDSKVHAANKLASRHARVWMCEVCEQAPAHVTCKADAAALCVTCDRDIHSANPLARRHERVPVVPFYDSAAAAAKSNAVNLLVDDRYYSDPDGDASREEAEAASWLLPNPNPKLAESSDLNSSHYMFSDIDPYLDLDYPSMDPKLQSQQQQQSSGTDGVVPVQNKSVQAPLVNDNCFDMDFSGSKSFYNGQSLSQSVSSSSLEVGVVPDGNAMVDVTNPFGRSMNTGSESANQTAQISSGIDREARVLRYREKRKNRKFEKTIRYASRKAYAETRPRIKGRFAKRSEIEVDYSSSGALTADSGYGVVPSF

SEQ ID NO: 4930 - protein, 395 aa, Zea mays
  misc_feature (1)..(395): useful for making plants with increased cold tolerance as described in USSN 12/863,773
  misc_feature (1)..(395): Public GI ID no. 187830112
  misc_feature (1)..(395): Bit score of 326.8 for HMM based on sequences of FIGURE 2 of USSN 12/863,773.
  misc_feature (324)..(368): Pfam Name: CCT Pfam Desc: CCT motif
  misc_feature (27)..(74): Pfam Name: zf-B_box Pfam Desc: B-box zinc finger
  misc_feature (1)..(395): Functional Homolog Of SEQ ID NO. 20
MDYNFDTSVLDEDVAGRGGREGSCPPAWARACDGCRAAPSVVYCHADTAYLCASCNSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 4931 - protein, 317 aa, Medicago sativa
  misc_feature (1)..(317): useful for making plants with increased cold tolerance as described in USSN 12/863,773
  misc_feature (1)..(317): Public GI ID no. 110277457
  misc_feature (1)..(317): Bit score of 385.4 for HMM based on sequences of FIGURE 2 of USSN 12/863,773.
  misc_feature (1)..(48): Pfam Name: zf-B_box Pfam Desc: B-box zinc finger
  misc_feature (256)..(300): Pfam Name: CCT Pfam Desc: CCT motif
  misc_feature (1)..(317): Functional Homolog Of SEQ ID NO. 20
MATKLCDSCKSSKATLFCRSDSAFLCLTCDSNIHAANKLASRHHRVTLCQVCEQAPAHVTCKADAAALCISCDHDIHSANPLARRHERVPLTTFHHHNNNSQQQSFFSENDHDATNEEAGAASWLLQTPSNPKFPDLNYSHYSYPEIDDFVTVNAKTDTPEQNSPGTTADGVVPVQSQSKTTTEHQHEHYSDINIDFSNSKPFTYNFNHTVSSPSMEVGVVPDGNVMTEISYCGYQTTATETAPMTVAVPMTAVEREARVSRYREKRKNRKFEKTIRYASRKAYAETRPRIKGRFAKRSDLNMNLIAEDEYGVVPSC

SEQ ID NO: 4932 - DNA, 1290 bp, Sorghum bicolor
  misc_feature (1)..(1290): useful for making plants with increased cold tolerance as described in USSN 12/863,773
  misc_feature (1)..(1290): Ceres Annot ID no. 8736698
atggcaaaggatctgccgatgatgcaaaggaggagtctggaagctgccggtcgttatgtggaggagtttcgctccaacgctctcgacgaggaggaggtcgctggaagaggcggggaaggagggagctgcgccgcagcaccagcatgggccaggccctgcgacgggtgccgggcggcgcccagcgtggtgtactgccacgccgacgcggcgtacctgtgcgcgtcgtgcgacgtgcgggtgcacgccgccaaccgcgttgcgtcgcgccacgagcgcgtgcgcgtgtgcgaggcctgcgagcgcgcgccagcagtgctggcgtgccgcgccgacgccgccgcgctctgcgtcgtctgcgacgcgcaggtccactccgcgaacccgctggccgggaggcaccagcgcgtgcccgtgctgccgctccccgtcgcggccatcccggctgcttccgtgctcgccgaggctgcggccaccgccgtggccgtgggtgacaagcaggaagaggaggtggactcgtggctgctgctcaccaacaccaaggatccagtttcagacaacaacaactgcaactgcagcagcagcagcaacaacaacatcagcagcagcaacaccagcaccttctacgcggatgttgatgagtactttgatctcgtgggctacaattcctactgtgacaaccacatcaacagcaacccaaagcagtacgggatgcaagaacgacagcaacagcagcagctgctgctgcaaaaggaatttggagacaaggagggaagcgagcacgttgtgcctgcttcacaggtcgcgatggcaaatgagcagcagcagagtggttatggagttattggggtagagcaggctgcctccatgactgccgcggtcagtgcttacacagattccatcactaacagcatatctttctcatcatcaatggaggtgggtatagtcccagacaacatggcaacgacgacagacatgccaaactccggcatcctgctgacacctgctgaggccatcagcctcttctcgtcaggttcttcgcttcagatgccactccacttgacctccatggacagagaggccagggtcctcaggtacaaggagaagaagaagagcagaaagttcgcgaagaccatacgatatgcgacgaggaagacatatgcagaagcaaggccgaggatcaagggccgcttcgccaagagatcttctgatatggaaatcgaagtggaccagatgttctcatctgcagctctgtcgtctgatggtagctacggtacggttctatggttctga

SEQ ID NO: 4933 - protein, 429 aa, Sorghum bicolor
  misc_feature (1)..(429): useful for making plants with increased cold tolerance as described in USSN 12/863,773
  misc_feature (1)..(429): Ceres Annot ID no. 8736698
  misc_feature (1)..(429): Bit score of 297.5 for HMM based on sequences of FIGURE 2 of USSN 12/863,773.
  misc_feature (358)..(402): Pfam Name: CCT Pfam Desc: CCT motif
  misc_feature (48)..(95): Pfam Name: zf-B_box Pfam Desc: B-box zinc finger
  misc_feature (1)..(429): Functional Homolog Of SEQ ID NO. 20
MAKDLPMMQRRSLEAAGRYVEEFRSNALDEEEVAGRGGEGGSCAAAPAWARPCDGCRAAPSVVYCHADAAYLCASCDVRVHAANRVASRHERVRVCEACERAPAVLACRADAAALCVVCDAQVHSANPLAGRHQRVPVLPLPVAAIPAASVLAEAAATAVAVGDKQEEEVDSWLLLTNTKDPVSDNNNCNCSSSSNNNISSSNTSTFYADVDEYFDLVGYNSYCDNHINSNPKQYGMQERQQQQQLLLQKEFGDKEGSEHVVPASQVAMANEQQQSGYGVIGVEQAASMTAAVSAYTDSITNSISFSSSMEVGIVPDNMATTTDMPNSGILLTPAEAISLFSSGSSLQMPLHLTSMDREARVLRYKEKKKSRKFAKTIRYATRKTYAEARPRIKGRFAKRSSDMEIEVDQMFSSAALSSDGSYGTVLWF

SEQ ID NO: 4934 - DNA, 1125 bp, Sorghum bicolor
  misc_feature (1)..(1125): useful for making plants with increased cold tolerance as described in USSN 12/863,773
  misc_feature (1)..(1125): Ceres Annot ID no. 8671780
atggaggccctggtggcggggaggtactggggtgtcgggggacggcggtgcgaggcgtgcgggggctcgccggcggcggtgcactgccggacgtgcccgggcggcggggcgtacctgtgcgcggggtgcgacgcgggccacgcgcgggccgggcacgagagggtgtgggtgtgcgaggtgtgcgagcgcgcgccggccgccgtcacgtgccgcgccgacgcggccgcgctctgcgccgcgtgcgacgccgacatccacgacgcgaacccgctggcgcgccgccacgagcgcgtgcccgtgcagcccatcggcgcggccgcggccgcgcccgccgcggagacgctgctgttcggcgccgccgcggaagagaatcaggacgacgacgacggcgccgccgcggcggctaaggtcgtcggcgtcgacgccggtaagctggcggacttcctgttcgcggacgtcatggacccgttcttcggccaagacttcactggtggcaccaggttcccgcacgccgacagcgttgtgcctaaccagggatcctgcggcgccgtcgctgccaagccgtcctacagctcctacaccgcggcgtcgctcggccacagcggctcgtcgtcggaggtcggcctggtcccagacgcgatgtgcggccgcggcgggagcgtgaccggcggcgtcatcgagctcgacttcgcgcagtccaaggccgcctacctgccttacgctgcaactccgacccacagtatgtcatctttggacgtgggtgcggtgccggaacgcggtgacggggtcatggcgggcagggtcgcgacgccgccggcggcggcggccgcggagagcagggaggcgcggctgatgcggtaccgcgagaagcggaagaaccggcggttcgagaagacgatccgctacgcgtcccggaaggcctacgcggagtcgcggccgcgcatcaagggccgcttcgcgaagcgcgcggacgacaacgacgccgacgccgacgccgacttcgacttcgacgcgggtgccgcggcggcgacggcgccggcgcggtcgcggtcgcagcagcagcagccatcgtacccctatgtgctcgacttcgccgccggctacggcgtcgtgcccacattctga

SEQ ID NO: 4935 - protein, 374 aa, Sorghum bicolor
  misc_feature (1)..(374): useful for making plants with increased cold tolerance as described in USSN 12/863,773
  misc_feature (1)..(374): Ceres Annot ID no. 8671780
  misc_feature (1)..(374): Bit score of 474.1 for HMM based on sequences of FIGURE 2 of USSN 12/863,773.
  misc_feature (280)..(324): Pfam Name: CCT Pfam Desc: CCT motif
  misc_feature (53)..(100): Pfam Name: zf-B_box Pfam Desc: B-box zinc finger
  misc_feature (1)..(374): Functional Homolog Of SEQ ID NO. 20
MEALVAGRYWGVGGRRCEACGGSPAAVHCRTCPGGGAYLCAGCDAGHARAGHERVWVCEVCERAPAAVTCRADAAALCAACDADIHDANPLARRHERVPVQPIGAAAAAPAAETLLFGAAAEENQDDDDGAAAAAKVVGVDAGKLADFLFADVMDPFFGQDFTGGTRFPHADSVVPNQGSCGAVAAKPSYSSYTAASLGHSGSSSEVGLVPDAMCGRGGSVTGGVIELDFAQSKAAYLPYAATPTHSMSSLDVGAVPERGDGVMAGRVATPPAAAAAESREARLMRYREKRKNRRFEKTIRYASRKAYAESRPRIKGRFAKRADDNDADADADFDFDAGAAAATAPARSRSQQQQPSYPYVLDFAAGYGVVPTF

SEQ ID NO: 4936 - protein, 367 aa, Beta vulgaris subsp. vulgaris
  misc_feature (1)..(367): useful for making plants with increased cold tolerance as described in USSN 12/863,773
  misc_feature (1)..(367): Public GI ID no. 186911828
  misc_feature (1)..(367): Bit score of 434.9 for HMM based on sequences of FIGURE 2 of USSN 12/863,773.
  misc_feature (13)..(60): Pfam Name: zf-B_box Pfam Desc: B-box zinc finger
  misc_feature (298)..(342): Pfam Name: CCT Pfam Desc: CCT motif
  misc_feature (1)..(367): Functional Homolog Of SEQ ID NO. 20
MMKEEVSGSDTNSWARVCDTCRAAPCTVYCRADSAFLCTSCDARIHAANQVASRHERVWVCEACERAPAAFLCKADAASLCATCDAEIHSANPLARRHQRVPIMPVAGCVYGPQGGRMSEDRFLTLPEGDDHTTDHEGDEDEAASWLLLNPVKNSNNQNTNGFLTGGGEVDEYLDLLEYNSGADNQLCEQYNQQQEFKVPEKNCGGDSVVPVQCREAKDHQIQYQNFLFGMECETKSGYTYNTSISQSVSVSSMDVGVVPESAMSDISMSHPRPPKGTIDLFSSPPMQVPTQLSPLDREARVMRYREKKKNRKFEKTIRYASRKAYAETRPRIKGRFAKRTDVEAEMDQMFTNSLMADSGYGIVPSY

SEQ ID NO: 4937 - protein, 368 aa, Physcomitrella patens subsp. patens
  misc_feature (1)..(368): useful for making plants with increased cold tolerance as described in USSN 12/863,773
  misc_feature (1)..(368): Public GI ID no. 168062896
  misc_feature (1)..(368): Bit score of 368.4 for HMM based on sequences of FIGURE 2 of USSN 12/863,773.
  misc_feature (301)..(345): Pfam Name: CCT Pfam Desc: CCT motif
  misc_feature (1)..(47): Pfam Name: zf-B_box Pfam Desc: B-box zinc finger
  misc_feature (1)..(368): Functional Homolog Of SEQ ID NO. 20
MPKSCDACQASSAVVYCRADAAYLCLGCDGKVHGANKLASRHERLWMCEVCEVAAAVVTCKADAASLCVSCDTDIHSANPLAQRHERVPVQPLFDCVSQFRGTHFSVLAPKNECNNNLLKGDEDPAVAEAVSWLLPHPKTLSSAILRGIAAADEAPAFPFRERPFSPKLKKLKVEQAADIYSDVDPFLVLDGGNGTGFQPDSMVPVHIPEGPDDSPSLANSTAPSSAINFRASQKSGCSYGTSTLTHSMSCSSVDAAVVPDSSLSDISTPYSKALDSQDSQDLSGALVPHQASKPIDTVDREARVMRYKEKRQKRKFEKTIRYASRKAYAESRPRIKGRFTKRTDSDVEQMFSSCTADSGFGVVPSSC

SEQ ID NO: 4938 - protein, 342 aa, Brassica nigra
  misc_feature (1)..(342): useful for making plants with increased cold tolerance as described in USSN 12/863,773
  misc_feature (1)..(342): Public GI ID no. 194244852
  misc_feature (1)..(342): Bit score of 286.3 for HMM based on sequences of FIGURE 2 of USSN 12/863,773.
  misc_feature (7)..(54): Pfam Name: zf-B_box Pfam Desc: B-box zinc finger
  misc_feature (280)..(324): Pfam Name: CCT Pfam Desc: CCT motif
  misc_feature (1)..(342): Functional Homolog Of SEQ ID NO. 20
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYG

SEQ ID NO: 4939 - DNA, 1011 bp, Sorghum bicolor
  misc_feature (1)..(1011): useful for making plants with increased cold tolerance as described in USSN 12/863,773
  misc_feature (1)..(1011): Ceres Annot ID no. 8680182
atggacaccgcggtggagctggagctggagcagaagccggcggtgggttactggagcgtggtgggcgcccggccctgcgacgcgtgcgccgcggagccggcgcggctgcactgccgcgaggacggcgcgttcctgtgccccggctgcgacgcccgggcgcacggcgccgggtcccgccacgcgcgcgtctggctgtgcgaggtctgcgagcacgcccccgccgccgtcacctgccgcgccgacgccgccgcgctctgcgccgcctgcgacgccgacatccactcggccaacccgctcgcgcgccgccacgagcgcctccccgtcgcgcccttcttcggcgcgctcgctgacgcgccccagcccttcccgtccccggccttcgccgccgctgccgcagcggggggccaggctcagggggaagccgcggcggcggacaacgacgacgacgacgggagcaacgaggccgaggcggcgtcgtggctgctcgccgagcccgacaacagccacgaggacagcgccgccgccaccgccgccgacacgttgttcgcggaatcggacgcgtacctcggcgtcgacctggacttcgcccggtgcatggacggcgtcaaggccatcggcgtgccggtcgcgccgcccgagctggacatcgctgccggcagctttttctaccccgaacactccatgaaccacagtttgtcgtcgtcggaggtggcggtggtgccggacgcgcaggcggccggcgtgccggcggtggtgagcagggggaaggagcgggaggcgcggctgatgcggtaccgtgagaagcgcaagaaccgccggttcgacaagaccatccgctacgcgtcccgcaaggcgtacgccgagacgcggccgcgcatcaagggccgcttcgccaagcgctgctccgcggaggccgacgacgacgcgctggagcacgacgaaggcgcgtgcttctcgcccgcggggtcggcgcacgcggcgtcggacggcgtcgtcccgtccttctgttga

SEQ ID NO: 4940 - protein, 336 aa, Sorghum bicolor
  misc_feature (1)..(336): useful for making plants with increased cold tolerance as described in USSN 12/863,773
  misc_feature (1)..(336): Ceres Annot ID no. 8680182
  misc_feature (1)..(336): Bit score of 634.7 for HMM based on sequences of FIGURE 2 of USSN 12/863,773.
  misc_feature (258)..(302): Pfam Name: CCT Pfam Desc: CCT motif
  misc_feature (21)..(65): Pfam Name: zf-B_box Pfam Desc: B-box zinc finger
  misc_feature (1)..(336): Functional Homolog Of SEQ ID NO. 20
MDTAVELELEQKPAVGYWSVVGARPCDACAAEPARLHCREDGAFLCPGCDARAHGAGSRHARVWLCEVCEHAPAAVTCRADAAALCAACDADIHSANPLARRHERLPVAPFFGALADAPQPFPSPAFAAAAAAGGQAQGEAAAADNDDDDGSNEAEAASWLLAEPDNSHEDSAAATAADTLFAESDAYLGVDLDFARCMDGVKAIGVPVAPPELDIAAGSFFYPEHSMNHSLSSSEVAVVPDAQAAGVPAVVSRGKEREARLMRYREKRKNRRFDKTIRYASRKAYAETRPRIKGRFAKRCSAEADDDALEHDEGACFSPAGSAHAASDGVVPSFC

SEQ ID NO: 4941 - DNA, 2463 bp, Solanum lycopersicum
  misc_feature (1)..(2463): useful for making plants with increased cold tolerance as described in USSN 12/863,773
  misc_feature (1)..(2463): Ceres Annot ID no. 8457344
atggctacttctgagaattgccggaacgctgccggcgccggaaaagttgatgctgagaaagcgttgtacacggagctatggcgagcatgtgcaggtccgcttgtgacagtgccatgtgaaggcgagctggtgttctatttcccacaaggtcatattgaacaggttgaagcatcaacaaaccaagcttcagaccagcagatgccagtatataatcttccttctaagatcctctgtcgtgtgattaacgtcctgctgaaggctgaacccgatacagatgaggtgtatgcacaagtgactttgttgccagaaccaaatcaagatgagaatgtggtatcaaaggaaccgatgccctctccgccaccacgattccatgtgcactctttttgtaagacattaacagcctctgataccagcactcatggaggattttctgtcttgagacggcatgctgatgaatgcctcccgcctctggatatgtctcggcagcctccaacacaggagttggtggccaaagatttgcatgcaaatgagtggcgcttcaggcacatattccggggccagcctaggaggcaccttcttcagagtggttggagtgtctttgttagttcgaaaaggcttgttgcaggggatgcattcatatttcttagaggtgagaatggggagcttcgtgttggagtccgacgtgccatgagacagcagggtaatgctccatcatcagtgatatccagtcatagcatgcatcttggtgtccttgctacagcttggcatgctattcagacgaaaacactgacgagccctgctgactttatagttccatatgatcagtatatggagtctctgaaaaacaattactccatcgggatgaggtttaaaatgaggtttgaaggtgaagaagctccagaacagaggtttactggaactatagttggcattgaaaatgctgacctcaaaaggtggcctgagtcaaaatggagatgcctgaaggttcgatgggatgaaacttctgctattcctaggccagaccgagtttcaccctggaaagtagagccagctcttagccctcctgcacttaatccacttccaataccaaggcagaaaaggccgcgatcaaatgttctgccctcgtctcctgattcttctgtacttactagggaaggttcatccaaagtagttgtagacacttcacaagccagtgggttttcaagagttttgcaaggtcaagaaatatcaaccttgagaggcaattttgtagaaaataacgagtcggactcttctgagaagccacctatatggcaaccattactggatgacgagaaggctgatgttcattctgcgtcaaggaaatgtatatcagataaacggcttcctttagggaggcctgaatcatcttttacagatcttttatcaggttttggggggcaatctagttcatctcatggattccattcacccactgggggccaaacagcacctgctagctgggttaagcgacaagctctggataaggaaactgatttcagcttactggcaaaacaatggtctctagtgtcttctggtctctcacttaatctgatggaatcaggattgaagggtgcagatactctgtatcaaatgcggggaacatctcgactcaattgttttaacgagtatccaaccttccctggtcatagacctgacaatcagcagggaaattggttaatgcccccgtccgtgctgccttatattcagatgtccgctcattctggagaaattatgcctaaacccatggcttcaccacagcccgaagccatgaaacccaaagaagggaactgcaaactatttggcattccccttgtaagtaaatgtgccaccatagatcctgtcatgttgcggaaaaattccccgattcactcaacaagtaacatgcactttggtatacatccacatcaattccctataattgaatctgatcaaaggtctgagcaatcaaagggatcaaagctaccagatgatggcttcatagttcatgatcaggaagaacaattccaaacctctcatcctggtactcgagatagagagggcaaaggccttgttcattcaacaaggagttgcaccaaggttcataaacagggtacagcccttggaaggtctgttgatcttgcaaagttcaacaactatgaagaattgatagctgaactggatcacatttttgattttaatggtgagctcaaggctcgtaacaagaactggctggttgtatatactgatgatgagggtgacatgatgcttgttggagatgatccatgggaattttgtggtatggttcggaagatttttatctacacgaaagatgaggtgcagcggatgaaccctgggactctcaattcaaaaggcgaggacaattcttctgttgcagaaggctctgatgctaaagaagtgaagaatctacagcttcacattgattccagtccggaagattcttag

SEQ ID NO: 4942 - protein, 820 aa, Solanum lycopersicum
  misc_feature (1)..(820): useful for making plants with increased cold tolerance as described in USSN 12/863,773
  misc_feature (1)..(820): Ceres Annot ID no. 8457344
  misc_feature (1)..(820): Bit score of 1560.8 for HMM based on sequences of FIGURE 5 of USSN  12/863,773.
  misc_feature (254)..(328): Pfam Name: Auxin_resp Pfam Desc: Auxin response factor
  misc_feature (127)..(232): Pfam Name: B3 Pfam Desc: B3 DNA binding domain
  misc_feature (1)..(820): Is Acted Upon By Ceres SEEDLINE ID no. ME00572
MATSENCRNAAGAGKVDAEKALYTELWRACAGPLVTVPCEGELVFYFPQGHIEQVEASTNQASDQQMPVYNLPSKILCRVINVLLKAEPDTDEVYAQVTLLPEPNQDENVVSKEPMPSPPPRFHVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNAPSSVISSHSMHLGVLATAWHAIQTKTLTSPADFIVPYDQYMESLKNNYSIGMRFKMRFEGEEAPEQRFTGTIVGIENADLKRWPESKWRCLKVRWDETSAIPRPDRVSPWKVEPALSPPALNPLPIPRQKRPRSNVLPSSPDSSVLTREGSSKVVVDTSQASGFSRVLQGQEISTLRGNFVENNESDSSEKPPIWQPLLDDEKADVHSASRKCISDKRLPLGRPESSFTDLLSGFGGQSSSSHGFHSPTGGQTAPASWVKRQALDKETDFSLLAKQWSLVSSGLSLNLMESGLKGADTLYQMRGTSRLNCFNEYPTFPGHRPDNQQGNWLMPPSVLPYIQMSAHSGEIMPKPMASPQPEAMKPKEGNCKLFGIPLVSKCATIDPVMLRKNSPIHSTSNMHFGIHPHQFPIIESDQRSEQSKGSKLPDDGFIVHDQEEQFQTSHPGTRDREGKGLVHSTRSCTKVHKQGTALGRSVDLAKFNNYEELIAELDHIFDFNGELKARNKNWLVVYTDDEGDMMLVGDDPWEFCGMVRKIFIYTKDEVQRMNPGTLNSKGEDNSSVAEGSDAKEVKNLQLHIDSSPEDS

SEQ ID NO: 4943 - protein, 563 aa, Vitis vinifera
  misc_feature (1)..(563): useful for making plants with increased cold tolerance as described in USSN 12/863,773
  misc_feature (1)..(563): Public GI ID no. 157327120
  misc_feature (1)..(563): Bit score of 794.2 for HMM based on sequences of FIGURE 5 of USSN 12/863,773.
  misc_feature (202)..(281): Pfam Name: Auxin_resp Pfam Desc: Auxin response factor
  misc_feature (75)..(180): Pfam Name: B3 Pfam Desc: B3 DNA binding domain
  misc_feature (1)..(563): Is Acted Upon By Ceres SEEDLINE ID no. ME00572
MEQLQASTNQGVDQRIPLFNLPSKILCRVVHTRLLAEQETDEVYAQITLQPEADQTEPKSPDSCPDEAPKQTVHSFCKILTASDTSTHGGFSVLRKHANECLPPLDMSQATPTQELVARDLHGYEWRFKHIFRGQPRRHLLTTGWSTFVTSKRLVAGDAFVFLRGDNGELRVGVRRLARQQSPMPSSVISSQSMHLGVLATASHAVTTQTLFVVYYKPRTSQFIISLNKYLEAVNYGFAVGMRFKMRFEGEDSPERRFTGTIVGIGDISPQWSNSKWRSLKIQWDEPATIQRPERVSSWDIEPFVASASLNLTQPPVKIKRPRPLDLPVAVPSPFWYAGSSPSHELTQLDSKTVSTRSILSGYNTSLSSRPNNGLISDQVEKGKRIEASIGCRLFGIDLTNNSKATALLEMIQNLDVSKSSNEQKQVVPEASQKETQGRQSCTPSSRTRTKKVQMQGVAVGRAVDLTALEGYDELISELEKMFEIKGELCPRNKWEVVFTDDEGDMMLVGDDPWQEFCKMVRKIFIYSSEEVKKMSPRCKLSTSSLDGEGTVISLDSELRTEP

SEQ ID NO: 4944 - protein, 737 aa, Vitis vinifera
  misc_feature (1)..(737): useful for making plants with increased cold tolerance as described in USSN 12/863,773
  misc_feature (1)..(737): Public GI ID no. 157358702
  misc_feature (1)..(737): Bit score of 957.5 for HMM based on sequences of FIGURE 5 of USSN 12/863,773.
  misc_feature (278)..(360): Pfam Name: Auxin_resp Pfam Desc: Auxin response factor
  misc_feature (151)..(256): Pfam Name: B3 Pfam Desc: B3 DNA binding domain
  misc_feature (1)..(737): Is Acted Upon By Ceres SEEDLINE ID no. ME00572
MIDLNTVDDDETPSSGSSSSSSSSASASASTVCGSLLSAASSVCLELWHACAGPLISLPKKGSLVVYFPQGHLEQLSDYPAVAYDLPPHVFCRVVDVKLHAEVVTDEVYAQVSLVPETKQIKQKLQEGEIEADGGEEEDIEGSIKSMTPHMFCKTLTASDTSTHGGFSVPRRAAEDCFPPLDYKQQRPSQELVAKDLHGFEWRFRHIYRGQPRRHLLTTGWSAFVNKKKLVSGDAVLFLRGGDGELRLGIRRAAQIKGSSPFPALCSQQLNLNTLTAVVNAISTRSVFNICYNPRASSSEFIIPLRKFSKSIDHSFSAGMRFKMRVETEDAAERRYTGLITGISDMDPVRWPGSKWRCLLVRWDDIEANRHNRVSPWEIELSGSLSGSGSLTVPGSKRTRIGLPGTRPDFSVPNGMGVSDFGESSRFQKVLQGQEIFGFNTPYDGVDTQDHHPSEIRCFPGSSCSGIAAIGNGVRNPLGNSDISYKGIGFGESFRFHKVLQGQETFPSPPCGRALSANQAHENGSFGIFDGVQVPTSRNGWPALVQGYNAHTHLSTPSVQVSSPSSVLMFQQASTAAPNIYSMHSANNQEKEQEISNRSSFDIPEVYGEKLTPSRCELSVRGGGQGGMNFFGLLNEHNQLAVPHPLVTQSAFRGSQDLVPTCKSSCRLFGFSLTEERSIGNKVDNPTPVTSSLIPGTSFLPQQLHSEPPVMTKAIGSNCTKVSDFYAVRDMLFDIAL

SEQ ID NO: 4945 - DNA, 2922 bp, Panicum virgatum
  misc_feature (1)..(2922): useful for making plants with increased cold tolerance as described in USSN 12/863,773
  misc_feature (1)..(2922): Ceres Clone ID no. 1892720
aaaaaaaaaacccaacgcctcggctccaagccagccagccaaccaacccgccccgggcagcaaagcacaggcgcacgagctcccacagctccccagctccacgcctcctccctcgcgctcccgccatcctctcctccgccgcgcgccttcccgcccgccgagcctttggggtggttccggagtcgcggccgcgcgcgcgagagcgagaccctcccctgctgccgagcgtaaatctgccgagctcggcatggggtgaccagatcggggcgcggctcggtgctctacggctgaattccgctcgaggaggggggtttgccttgcctagaagaggccgcggggatggcgaacgccggcgtggccgtcggctcagggggtgttagccatgctttgttcagggaactctggcatgcttgtgctgggctgttggtcacggtgcctcgccaaggcgagctggtttactacttcccgcaaggtcatatggaacagcttgaagcatctacagatcagcaacttgaccagcacttacctttgtttaatctaccatccaagatcctgtgcaaggtggtaaatgtagaactcagagctgaaactgattccgatgaagtttatgctcaaattatgctgcaaccagaagcagatcaaagtgagcccaccagcccagctcctgagctaccagagccagaaaggtgcaatgtccattccttctgcaagactttgactgcttcagacacgagcacccatggtggtttctctgtcctcaggagacatgctgaagaatgtttgccccaattggatatgactcagaacccaccgtggcaagaactggtggctaaagatctccatggaaatgaatggcatttccgtcacatctttcgaggtcaaccaaggaggcatctacttacaacaggttggagtgtttttgttagctcaaaaagattggttgccggtgatgcatttatctttttgagaggtgagaatggagagctacgagtcggggtaagaaggctcatgaggcaagtaaataacatgccatcatcagttatctcaagccacagcatgcatcttggagtcctcgcaactgcatctcatgccatctccactggaactctcttttctgttttctacaaacccagaacaagtcgatcggagtttgttgtgagcgtaaacaagtaccttgaagctaagaatcacaagatgtctgtcggtatgaggtttaaaatgagatttgagggtgatgaatctcctgaaagaagatttagtggaacaattattggtctgggaagcatgccagctaactcaacatctccgtgggctgactctgattggagatctttgaaggtccaatgggatgagccttctgctgttgtccgtccagatagagtttcaccatgggaactagaaccccttgatgcaactaacacacaaccgcctcagcctcctttacggagtaagcgtgcacggcctcctgcttcaccttctattgctccagaacttcctccagcttttggtttttggaaatccccacctgagcctacccatgctttctcattttcgggactgcagcgaacccaggaactataccattcaaatcccaattcgatcttttcatcatcgttgaatgtgggatttaattcaaagaacgagcattctactccaaccaacaatcatttgtattggccaattcgagacactagaacggaatcctactctgctagcattaacaaacttccacctgaaaggaagcaagaattcactattgctggctgcagattgtttggtattgagttaagtaatgcagtatcaccagtggttgctgttgctagtgctggtcaagaccaaccacctgttgtgtcagtagatgttgagcctgatcagctgtcacagccatcccaagccaacaaaacggatgccccagcagcaagcagtgagcgctctcctcatgagactgagagccggcaagtcaggagctgcaccaaggtaatcatgcaaggaatggcggttggcagggcagtggacttgacgaggctagaagggtatgatgatcttctccacaagttggaggagatgtttgatatccagggggagctttctgctagcctcaagaaatggaaggttatttacacggatgatgaggatgatatgatgctggttggggatgatccgtggcctgaattttgcggcatggtgaaaaggatatacatttactcctatgaggaggccaagtctttgactcccaaggtgaagctgccggtcattggtgacaccactaaactgaacctagacaaattgtcaccagaatctgacatgccgcagagtgactcaaacaacatcgctctggttgccgccgataaggactgatggatgctaacttggtgctttaccttttcttccctttttggatgtttgggaggcaatgcccatgctccttgagactgctaagagttatctgtttgttgcgctgtgggcctcaaggacgttgccccacaatctgcctgactgccttggtttgcaatggctgatgtaggaccagtggtggtcctctgccagcaaggacgactggaacgtaatggcaagcaggctgcgtgcgcgccgttccctgtggcaccaacctgtgttttgtttgccgtgtttggtaggaggcatggcgaattgccggctgcttggttttggagactgccactgactgctgccgtctcgttggtcgacgtcggccggcaggccgcgcccctcacctccagtaaataggacttcatgtacaactagtttggtagtagcagtagtggtttatgtatatcagcgtcatgttccttgctacctatataagcatcatcatctgtagctgctgctcccaccttgcattgtattctacccccggcttggtaccgaatgatctggtgcaaaaaagtctcagcttgctgttcc

SEQ ID NO: 4946 - protein, 672 aa, Panicum virgatum
  misc_feature (1)..(672): useful for making plants with increased cold tolerance as described in USSN 12/863,773
  misc_feature (1)..(672): Ceres Clone ID no. 1892720
  misc_feature (1)..(672): Bit score of 1319.2 for HMM based on sequences of FIGURE 5 of USSN  12/863,773.
  misc_feature (248)..(333): Pfam Name: Auxin_resp Pfam Desc: Auxin response factor
  misc_feature (121)..(226): Pfam Name: B3 Pfam Desc: B3 DNA binding domain
  misc_feature (1)..(672): Is Acted Upon By Ceres SEEDLINE ID no. ME00572
MANAGVAVGSGGVSHALFRELWHACAGLLVTVPRQGELVYYFPQGHMEQLEASTDQQLDQHLPLFNLPSKILCKVVNVELRAETDSDEVYAQIMLQPEADQSEPTSPAPELPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGENGELRVGVRRLMRQVNNMPSSVISSHSMHLGVLATASHAISTGTLFSVFYKPRTSRSEFVVSVNKYLEAKNHKMSVGMRFKMRFEGDESPERRFSGTIIGLGSMPANSTSPWADSDWRSLKVQWDEPSAVVRPDRVSPWELEPLDATNTQPPQPPLRSKRARPPASPSIAPELPPAFGFWKSPPEPTHAFSFSGLQRTQELYHSNPNSIFSSSLNVGFNSKNEHSTPTNNHLYWPIRDTRTESYSASINKLPPERKQEFTIAGCRLFGIELSNAVSPVVAVASAGQDQPPVVSVDVEPDQLSQPSQANKTDAPAASSERSPHETESRQVRSCTKVIMQGMAVGRAVDLTRLEGYDDLLHKLEEMFDIQGELSASLKKWKVIYTDDEDDMMLVGDDPWPEFCGMVKRIYIYSYEEAKSLTPKVKLPVIGDTTKLNLDKLSPESDMPQSDSNNIALVAADKD

SEQ ID NO: 4947 - DNA, 2076 bp, Sorghum bicolor
  misc_feature (1)..(2076): useful for making plants with increased cold tolerance as described in USSN 12/863,773
  misc_feature (1)..(2076): Ceres Annot ID no. 8667998
atggcgggcattgacctcaacaccgtggaggaggaggacgaggaggaggcggaggcggaggcgccgcctgtggccgccagggccggtggtggcgccgtgtgtctggagctgtggcacgcgtgcgcgggccccgtcgcgccgctgccgcgcaagggcagcgccgtcgtgtacctgccgcagggccacctcgagcacatcggcggcgacgctgacgcggcgggagcagcggtgccgccacacgtgctctgccgcgtcgtcgacgtcaccctccacgcggacggcgccaccgacgaggtgtacgcgcgggtgtcgctgctgcccgaggacgaggaggcggagaggcgggcgcgggcgcgggttcgggaggacgaggacgcggatcgcgacggcgaggacggggccgccatgaagccgctcgcacggacgccgcacatgttctgcaagacgctcacggcctctgacaccagcacgcacggcggcttctccgtgccgcgccgcgccgccgaggactgcttcccgccgctggactacagccagcagaggccgtctcaggagctcgtggccaaggatctacacggcacggagtggaagttccgacatatctaccgaggccagccacgaaggcatctcttaaccactggatggagtgcatttgttaataagaagaagcttgtttctggcgatgcagttctgttccttcgaggtgaagatggagtgcttcgactgggagtgcgccgagcagcccagctaaaaattgtaactcctattcctgcactgcataaccagtgctcaagccagaccactctgggaaatgttgcacaagctgtggccacgaggactgttttccacatttactacaatcccaggttaagtcaatctgaattcattgtaccctattggaagttcaccagaagcttgaatcaaccaatttctgttggaatgagatgcagaatgcgatatgaaagtgacgatgcttctgaaagaaggtgcactgggataataattggaagcagagaagctgagcctatttggtatggttcaaaatggaaatgcttggtggttagatgggatgatggtatagagtgccattggcccaatagggtatctccttgggagattgaggtcacaggatcagtttcaggatctcatatgtgcgctcccaattcaaaacgtctgaaaccatgcctccctcaagttaatccggagattgtgcttccaaatggaagcgtttcttcagattttgcgggatctgtcagattccacaaggtcttgcaaggtcaagaattgttgggtttgaaaacccatgacggtactgctatttctgcttttcaggcaactgaagcaagtaatttgcagtacagtgatgaacgtagtaacatgagtaacaatatcttagggatcccaaggctcggtgttagatctccaaatggaatccctggatttccctaccattgctcaggctttggggaatctcaaagattccaaaaggtcttgcaaggtcaagaagtgtttcgtcctttccgaggaggatgtttggctgatggccatataagaactgctggcatgtatcaacctaaatggcctgcaccacaagggtgtgattttccacagccagcaaaaccggtacttgtgttgcaagcatcctccccatcatctgtgctgatgtttccacaaactggttctaagataactccattggaatatgagtacagctgcctggataaggatgaggatggtagatttgataggactgtccctactcaagatatgggaagaaacaatcaaacattatctctttggcctcatcttgtttccggcgaagcaatagaagaatgtactggaactgagaatatgcactcttctgtcagtggtgcagagcatgaatcaaacaatgagagtacagttgaaaatggctgcaaaatctttggtatctcattggctgaaaagatccgatcatgtgatgaagcagactcttgtagtgcaaaacgtaattctgggctccagccttcgaggtcacaaatactaggcagctgttgggccacttttgcctgtaattttcaagaccgaatcttttga

SEQ ID NO: 4948 - protein, 691 aa, Sorghum bicolor
  misc_feature (1)..(691): useful for making plants with increased cold tolerance as described in USSN 12/863,773
  misc_feature (1)..(691): Ceres Annot ID no. 8667998
  misc_feature (1)..(691): Bit score of 955.7 for HMM based on sequences of FIGURE 5 of USSN 12/863,773.
  misc_feature (272)..(353): Pfam Name: Auxin_resp Pfam Desc: Auxin response factor
  misc_feature (145)..(250): Pfam Name: B3 Pfam Desc: B3 DNA binding domain
  misc_feature (1)..(691): Is Acted Upon By Ceres SEEDLINE ID no. ME00572
MAGIDLNTVEEEDEEEAEAEAPPVAARAGGGAVCLELWHACAGPVAPLPRKGSAVVYLPQGHLEHIGGDADAAGAAVPPHVLCRVVDVTLHADGATDEVYARVSLLPEDEEAERRARARVREDEDADRDGEDGAAMKPLARTPHMFCKTLTASDTSTHGGFSVPRRAAEDCFPPLDYSQQRPSQELVAKDLHGTEWKFRHIYRGQPRRHLLTTGWSAFVNKKKLVSGDAVLFLRGEDGVLRLGVRRAAQLKIVTPIPALHNQCSSQTTLGNVAQAVATRTVFHIYYNPRLSQSEFIVPYWKFTRSLNQPISVGMRCRMRYESDDASERRCTGIIIGSREAEPIWYGSKWKCLVVRWDDGIECHWPNRVSPWEIEVTGSVSGSHMCAPNSKRLKPCLPQVNPEIVLPNGSVSSDFAGSVRFHKVLQGQELLGLKTHDGTAISAFQATEASNLQYSDERSNMSNNILGIPRLGVRSPNGIPGFPYHCSGFGESQRFQKVLQGQEVFRPFRGGCLADGHIRTAGMYQPKWPAPQGCDFPQPAKPVLVLQASSPSSVLMFPQTGSKITPLEYEYSCLDKDEDGRFDRTVPTQDMGRNNQTLSLWPHLVSGEAIEECTGTENMHSSVSGAEHESNNESTVENGCKIFGISLAEKIRSCDEADSCSAKRNSGLQPSRSQILGSCWATFACNFQDRIF

SEQ ID NO: 4949 - DNA, 2439 bp, Sorghum bicolor
  misc_feature (1)..(2439): useful for making plants with increased cold tolerance as described in USSN 12/863,773
  misc_feature (1)..(2439): Ceres Annot ID no. 8721170
atggcggcggctgcaccggcggccggcggcggcggtggtgcggaagcgggatgcggaggaggcggagggaaggacccgctgttcgtcgagctgtggaaggcctgcgcggggccgctgtctagcgtgccgccgctcggggagaaggtctactacttcccgcagggccacatcgagcaggtggaggcatcgacgaaccagattgctgagcagcagggcacgcccctctacaacctgccatggaagattccatgcaagctcatgaacatcgagctgaaggctgagccggatactgatgaggtgtacgcccagctcaccctgctccctgataagaagcaagatgagaatacatctacaacagtggagaatgaggaggcagaggaggaggtggtgcctcatgcgccaccaacaaatgagggacctcggatccattccttttgcaagacattgactgcctcagacacaagcacgcatggtggtttctcagtgttgcgccggcatgcagatgagtgcctcccaccattggatatgagtcaacaccccccaaatcaagaattggtggccaaggacctgcatgggattgagtggcggttccgtcacatctttcgaggtcagccacggagacacctccttcagagtggttggagtgtttttgttagcgccaagcgtcttgttgcaggggatgccttcatatttctcagaggtgagaatggggagttacgtgttggggttcggcgtgcactgaggcaccaaaccactatcccatcttcagtcatatcaagccacagtatgcatcttggtgttcttgcgacagcatggcatgcagtcaacactgggagtatgttcactgtctactacaagccaaggactagtccagctgaatttgtggtctcgcgagataggtactatgaatcactgaaacgaaattattcaatagggatgagatttaagatgagatttgaaggtgaagaagcagcagagcaaagattcactggcacaatagttggaataggtgcttctgatccatctggttgggctgactcaaaatggcgttcccttaaggtgagatgggatgaagcttcttctgttcctcgtcctgaaagagtttctccttggcaaatagaacctgctattagcccatctcctgtgaaccctcttccagtcagattcaagaggtctcgttcaagtgttaatgcttcaccatctgacgtgcctactgtatccagagaaggtcgataccatgatagcagtgatgtgaagactgctcaggatcttaccatgtggtcttcaggaactgagcagcagagaaacaatattgctgcccagacaaagcgaagtctggagggatggacgcaatctagaactcctgaaggttacaatcagctgttctcggcatttcaaccactgaaagatacacataatccactttgtactttccctagtcaaatatctgggactcgctcaaatacctgggacacagccgatgctcgttatccagcccaacaagccaatcacaacatgttacatggcacatggccttttatgcctcatagcagtggttttaggacgaatcaacagaattatctagtgatgcctgaagctgcaaagtttactgggaaatcagctttcacttcacttcagggccatggcactgatcagtgctccacaggctggtttggacatattgagtcaagttcccgcacagaccatgcatcgtcaagttcgatcaggccccagcctttggttattggtaatgatgttcagaaaaccaaaggcacttcattcaaactatttgggattcctcttggcagcccggaaaaatctgaacctctggtatccccaccaagtgtcgcatatgacgggaaacttcaaacttctccatcagaaaaagggaatcagctagacatagttggagtggataattgttctgatccttcgaagactgtgaagccatttgatggtcctcaatcagattcgattacagagaataatcagccttgtccagaagctacccagaatattcagaacaaagtgcaaagtagttccaccagaagctgcaagaaggtccataagcaaggcagtgccctcggcagatcgattgatctaacaaagttcacttgctacgatgagctgattgctgaactggatcagatgtttgactttgatggtgagctgaagaatccatgcaaaaattggctggttgtctacactgacaatgaaggcgatataatgctggttggcgatgacccctggaatgaattctgcgacatggtccacaagatcttcatctacacaagggaggaagtggaaaggatgaacccaggtgccctaaactcaaggtccgaggatagtctgtctgactcgcagggaagagggttggcttccaaagagccgccccgaggtggcccgtctacttcgactcccaattccgagagctgctaa

SEQ ID NO: 4950 - protein, 812 aa, Sorghum bicolor
  misc_feature (1)..(812): useful for making plants with increased cold tolerance as described in USSN 12/863,773
  misc_feature (1)..(812): Ceres Annot ID no. 8721170
  misc_feature (1)..(812): Bit score of 1310.2 for HMM based on sequences of FIGURE 5 of USSN  12/863,773.
  misc_feature (271)..(353): Pfam Name: Auxin_resp Pfam Desc: Auxin response factor
  misc_feature (144)..(249): Pfam Name: B3 Pfam Desc: B3 DNA binding domain
  misc_feature (1)..(812): Is Acted Upon By Ceres SEEDLINE ID no. ME00572
MAAAAPAAGGGGGAEAGCGGGGGKDPLFVELWKACAGPLSSVPPLGEKVYYFPQGHIEQVEASTNQIAEQQGTPLYNLPWKIPCKLMNIELKAEPDTDEVYAQLTLLPDKKQDENTSTTVENEEAEEEVVPHAPPTNEGPRIHSFCKTLTASDTSTHGGFSVLRRHADECLPPLDMSQHPPNQELVAKDLHGIEWRFRHIFRGQPRRHLLQSGWSVFVSAKRLVAGDAFIFLRGENGELRVGVRRALRHQTTIPSSVISSHSMHLGVLATAWHAVNTGSMFTVYYKPRTSPAEFVVSRDRYYESLKRNYSIGMRFKMRFEGEEAAEQRFTGTIVGIGASDPSGWADSKWRSLKVRWDEASSVPRPERVSPWQIEPAISPSPVNPLPVRFKRSRSSVNASPSDVPTVSREGRYHDSSDVKTAQDLTMWSSGTEQQRNNIAAQTKRSLEGWTQSRTPEGYNQLFSAFQPLKDTHNPLCTFPSQISGTRSNTWDTADARYPAQQANHNMLHGTWPFMPHSSGFRTNQQNYLVMPEAAKFTGKSAFTSLQGHGTDQCSTGWFGHIESSSRTDHASSSSIRPQPLVIGNDVQKTKGTSFKLFGIPLGSPEKSEPLVSPPSVAYDGKLQTSPSEKGNQLDIVGVDNCSDPSKTVKPFDGPQSDSITENNQPCPEATQNIQNKVQSSSTRSCKKVHKQGSALGRSIDLTKFTCYDELIAELDQMFDFDGELKNPCKNWLVVYTDNEGDIMLVGDDPWNEFCDMVHKIFIYTREEVERMNPGALNSRSEDSLSDSQGRGLASKEPPRGGPSTSTPNSESC

SEQ ID NO: 4951 - DNA, 2007 bp, Sorghum bicolor
  misc_feature (1)..(2007): useful for making plants with increased cold tolerance as described in USSN 12/863,773
  misc_feature (1)..(2007): Ceres Annot ID no. 8679636
atggcggacgccggcgtggcgcgcggcccagggagtgctggcgatgctctgttcagggaactctggcatgcttgtgctgggccgttggtcacagtgcctcgccaaggcgagctggtttactacttcccgcagggtcatatggaacagcttgaagcatctacagatcaacaacttgatcagcacttacctctgtttaatctaccacccaagatcctctgcaaggtggtcaatgtagaacttagagctgaaactgattccgatgaagtttatgctcagattatgctacaacccgaagcagagcaaaatgagcccaccagcccagatgctgagccacccgagcctgaaagatgcaacgtccattccttctgcaagaccttgactgcttcagatacaagtacccatggtggattctctgtcctcaggaggcatgctgaagaatgtctgccccaactggacatgactcagaatccaccatggcaagaactggtggctaaagatctccatggaaatgaatggcatttccgtcacatctttcgagggcaaccaaggaggcatctacttacgacaggctggagtgtttttgttagctcgaaaagattggttgctggtgacgcgtttatctttttgagaggtgagaatggagagctgcgagtcggggtgaggaggctcatgaggcaactaaacaacatgccatcttcggttatctcaagccacagcatgcatcttggagtccttgcaactgcatctcatgccatctccactggaactctcttttctgttttctacaaacccagaacaagtcgatcagaatttgtcgttagtgtaaacaagtaccttgaagctaagaatcacaagatgtctgttggtatgaggtttaaaatgagatttgagggtgacgaatctcctgaaagaagattcagtgggacaattattggtctgggaagcatgccagctaactcaacatctccgtgggctaactctgagtggagatctttgaaggtccaatgggacgagccttctgctattctgcgtccagatagagtttcaccatgggaactagaaccccttgatgcaactaatccacaaccacctcaacctcctttacggaataagcgtgcgcggcctcctgcttcaccttccattgctccagaacttcctccagtttttggtttttggaaatccccagctgagcctgcccaagctttctcattttcaggactgcagcgaactcaggaattataccattcaaaccccaattcaatcttctcgtcatcgttgaatgtaggattcaattcaaagaatgagcgttctactccaaacaacaatcatttgtactggacaatgagagagacaagaactgaatcctactctgctagcattaacaaagctcctactgaaaagaagcaagaatctgctacttctggctgcagattgtttggtattgagataggttctgcagtatcaccagtggttactgttgctagtgttggtcaggatccaccacctgctctctcagtagatgttgaatctgatcagctgtcacaaccatcccatgccaacaaaacggatgccccagcggcaagcagtgagcgctctcctaatgaaacagagagccgacaagtcaggagctgcaccaaggtaatcatgcaaggaatggcggttggcagggcagtggacttgacgaggttagatgggtatgatgatcttcaccgcaagttggaggagatgtttgatatccatggagagctttctgccaacctcaggaaatggaaggttgtttacacagatgatgaggatgacatgatgctggtcggggacgatccatggaagatggtaaaaaggatatatatttactcttacgaggaggccaaatctttgactcccaaagcgaagctgccagtcattggtgacaccatcaagccagacccaaacaaattgtcaccggaatctgacatgccacagagtgacacaaacagcaatgctcccgttgctgctgataaggattga

SEQ ID NO: 4952 - protein, 668 aa, Sorghum bicolor
  misc_feature (1)..(668): useful for making plants with increased cold tolerance as described in USSN 12/863,773
  misc_feature (1)..(668): Ceres Annot ID no. 8679636
  misc_feature (1)..(668): Bit score of 1385.0 for HMM based on sequences of FIGURE 5 of USSN  12/863,773.
  misc_feature (248)..(333): Pfam Name: Auxin_resp Pfam Desc: Auxin response factor
  misc_feature (121)..(226): Pfam Name: B3 Pfam Desc: B3 DNA binding domain
  misc_feature (1)..(668): Is Acted Upon By Ceres SEEDLINE ID no. ME00572
MADAGVARGPGSAGDALFRELWHACAGPLVTVPRQGELVYYFPQGHMEQLEASTDQQLDQHLPLFNLPPKILCKVVNVELRAETDSDEVYAQIMLQPEAEQNEPTSPDAEPPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGENGELRVGVRRLMRQLNNMPSSVISSHSMHLGVLATASHAISTGTLFSVFYKPRTSRSEFVVSVNKYLEAKNHKMSVGMRFKMRFEGDESPERRFSGTIIGLGSMPANSTSPWANSEWRSLKVQWDEPSAILRPDRVSPWELEPLDATNPQPPQPPLRNKRARPPASPSIAPELPPVFGFWKSPAEPAQAFSFSGLQRTQELYHSNPNSIFSSSLNVGFNSKNERSTPNNNHLYWTMRETRTESYSASINKAPTEKKQESATSGCRLFGIEIGSAVSPVVTVASVGQDPPPALSVDVESDQLSQPSHANKTDAPAASSERSPNETESRQVRSCTKVIMQGMAVGRAVDLTRLDGYDDLHRKLEEMFDIHGELSANLRKWKVVYTDDEDDMMLVGDDPWKMVKRIYIYSYEEAKSLTPKAKLPVIGDTIKPDPNKLSPESDMPQSDTNSNAPVAADKD

SEQ ID NO: 4953 - DNA, 2415 bp, Sorghum bicolor
  misc_feature (1)..(2415): useful for making plants with increased cold tolerance as described in USSN 12/863,773
  misc_feature (1)..(2415): Ceres Annot ID no. 8670373
atggcgctgccgtcccaggccccgtctaactcaggggatccgctgtacccggagctctggcgcgcctgcgccggcccgctcgtcaccgtccctcgcgtcggcgacctcgtcttctactttccccagggacacatcgagcaggtggaggcgtccatgaaccaggtcgccgggaaccagatgcgcctctacgatctgccctccaagctgctctgccgcgtgctcaacgtcgagcttaaggcggagacggacaccgacgaggtctacgcgcagatcatgctcatgccagagcccgagcaaaccgatgtggcggctgagaaggcgagttctgcgtccgctgcgtcgccgaggccagcagtgaggtccttctgcaagacgctcaccgcctccgacaccagcacacacggaggcttctctgtgctgcgccgccacgcagacgagtgcctcccaccactggatatgacgcagtcgcctcccacacaggagctggtggcgaaggatctgcatggcatggagtggcgcttccgccacatctttcgcgggcaacccaggaggcatctccttcagagtggttggagtgtttttgttagttccaaaaggcttgttgctggagacgccttcattttcctcagaggagaaaatggtgaacttcgggttggtgttaggcgggctatgaggcagttgtctaatgtaccttcttcagtcatatctagccaaagcatgcacctcggagtccttgcgactgcatggcacgccatcaacaccaaatccatgttcactgtctactacaagcctaggacgagcccttcagagttcatcataccatatgatcaatatatggagtcagtgaaaaataactattcaattgggatgagattcagaatgaggtttgaaggggaagaggcaccagagcagaggtttactggtacaatcgttggctgtgaaaatcttgacccactatggcctgattccagttggagatacttgaaggtgcgctgggatgagccttctactatcccacgaccagatagggtctctccttggaagatagagcctgcttcatcacctccagttaatccactcccgctttcttctagagtaaaaagacctagacaaaatgctcctccaccttcacctgaagcatctgttctcacaaaagaaagtgcagccaagatcgatattgactctgctcaaacacaacatcaaaattcggtcttgcaaggtcaagagcaaatgaccttgaggaacaacctgactgaaagcaacgactctgattccactgttcaaaagccgatgatgtggtccccatcacccaatgggaaagcccacactaactttcagcagagacctgctatggatagttggatgccaatgggaaggcgtgaaacggacttcaaggactcacgttccgccttcaaggatgcccgcactgcctctcaatcatttagagatacacaggggttcttcatgcaagcttatgatgacaatcatcaccgtctttctttcaacaaccagtttcaggatcagggttcagctcatcgctttgcggatccatacttctatatggcccaacaaccttctctgactgttgaatcaagcacaaggacacaaacagcaaacaacgacttgcgtttctggggcgaccagaattcgatctatggtaatccaggtgatcaacagcagcagggtttcagctttggacaaaacccatcaagttggttgaaccagccatttccccaggttgaacagccacgagtggttaggcctcatgcaacagttgctccatttgatttggaaaagaccagagaaggcagcgggttcaagatctttgggttccaagttgatacaaccagtccatctcctgcccagttgagctctccattatgtgctatccgggagcatgtggtacaaacccgaccatcggcaccagtgaatgaattgcaacctgtgcaaaatgagtgcttgcctgagggatctgtaagcactgctggaactgcaactgagaacgagaaaaacattcagcaagcccagccaagttcaaaagatattcaaagcaagtcccagggtgcttcgacaaggagctgcacaaaggttcataagcaaggggttgcgcttggcagatctgtggacctctcaaaattcactgactacgatgaactcaaagcagaattagacaagatgtttgaattcaatggcgaattagtatctgccaacagaagctggcagatcgtttatactgacaatgagggtgacatgatgcttgtgggggatgacccgtgggaagagttctgtagcatagtgcgcaagatctacatctatacgaaggaggaggtccagaagatgaactcaaaatcatctgcgccaaggaaggaggagcctctaacagtgggtgaaggatgcgccgccacaaatgagtag

SEQ ID NO: 4954 - protein, 804 aa, Sorghum bicolor
  misc_feature (1)..(804): useful for making plants with increased cold tolerance as described in USSN 12/863,773
  misc_feature (1)..(804): Ceres Annot ID no. 8670373
  misc_feature (1)..(804): Bit score of 1526.4 for HMM based on sequences of FIGURE 5 of USSN  12/863,773.
  misc_feature (248)..(329): Pfam Name: Auxin_resp Pfam Desc: Auxin response factor
  misc_feature (121)..(226): Pfam Name: B3 Pfam Desc: B3 DNA binding domain
  misc_feature (1)..(804): Is Acted Upon By Ceres SEEDLINE ID no. ME00572
MALPSQAPSNSGDPLYPELWRACAGPLVTVPRVGDLVFYFPQGHIEQVEASMNQVAGNQMRLYDLPSKLLCRVLNVELKAETDTDEVYAQIMLMPEPEQTDVAAEKASSASAASPRPAVRSFCKTLTASDTSTHGGFSVLRRHADECLPPLDMTQSPPTQELVAKDLHGMEWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSIGMRFRMRFEGEEAPEQRFTGTIVGCENLDPLWPDSSWRYLKVRWDEPSTIPRPDRVSPWKIEPASSPPVNPLPLSSRVKRPRQNAPPPSPEASVLTKESAAKIDIDSAQTQHQNSVLQGQEQMTLRNNLTESNDSDSTVQKPMMWSPSPNGKAHTNFQQRPAMDSWMPMGRRETDFKDSRSAFKDARTASQSFRDTQGFFMQAYDDNHHRLSFNNQFQDQGSAHRFADPYFYMAQQPSLTVESSTRTQTANNDLRFWGDQNSIYGNPGDQQQQGFSFGQNPSSWLNQPFPQVEQPRVVRPHATVAPFDLEKTREGSGFKIFGFQVDTTSPSPAQLSSPLCAIREHVVQTRPSAPVNELQPVQNECLPEGSVSTAGTATENEKNIQQAQPSSKDIQSKSQGASTRSCTKVHKQGVALGRSVDLSKFTDYDELKAELDKMFEFNGELVSANRSWQIVYTDNEGDMMLVGDDPWEEFCSIVRKIYIYTKEEVQKMNSKSSAPRKEEPLTVGEGCAATNE

SEQ ID NO: 4955 - DNA, 2565 bp, Sorghum bicolor
  misc_feature (1)..(2565): useful for making plants with increased cold tolerance as described in USSN 12/863,773
  misc_feature (1)..(2565): Ceres Annot ID no. 8690553
atgacttcggcggcggccgcggcccaggcggcgggagggggtggaggaggaggaggagtctgcgagggggatgccgctgccgcggcgcgaggcggaggcggaggcggaacggaggacggcatgtacacggagctctggagcctctgcgccggcccgctggtcacggtgcccagggtcggggacaaggtctactacttcccacagggccatatcgagcaggtggaggcatcgaccaaccaggtggctgagcagcacatgcaactttacaatctcccatggaagatcctgtgtgaggtcatgaatgttgaattgaaggctgagccggacaatgatgaggtttatgcccagctcactctgctacctgaatcgaagccagaggagaatggctctagtcaggaggagatgcctgctgcacctcctgctgcacttgcaaggccacgtgtgcactccttctgcaagacattgacagcctctgacaccagcacacatggtggtttctcggtgctgcgtcgccatgcagatgaatgccttccaccgctggatatgagtcgtcaacctccaacacaagagcttgtggccaaggatctgcatggtgtggaatggcgctttcgtcacatattcagaggtcaacccggaaggctttttttgcagagtggctggagtgtttttgttagtgcaaagcgtcttgttgctggggatgccttcatctttctgagaggtgataatggggagctgcgtgtgggagtcaggcgtgccatgaggcagcaagcaaatgttccgtcttcagtaatatcaagccacagcatgcatcttggtgttcttgctactgcatggcatgctgttaacactgggaccatgttcactgtctactacaaacctaggacaagtccagctgagtttgttgtcccctgtgatcgctatacggagtcactgaaacgaaattaccctatagggatgagatttaaaatgaggtttgaaggtgaagaggctccagagcaaaggttcactgggacgattgttggaaatgtggatcctgaacaagctggatgggctgaatctaaatggcgttacctcaaggtgaggtgggatgaagcttcctccattccacgtcctgaaagggtttctccttggcaaatagaacctgcagtcagccctccccctgtcaatccacttccagtacacaggcccaagaggcctcgctctaatgctgtagcttctctggctgagtcttcagctccaacaaaagaagctgctccgaaggtcacattagagactcaacaacatgccctgcaaaggcccttgcagacccaggataatgcggccccaaaaagtggttttggtgataacagtgagttggacgctgctcataagtcagccctgcgaccatcagggtttgatctagagaagaacaccattggcatgcagaggaagctgggttcagatagttggatgcatatgaacagacctgaaggatacaatgaaatgttatctggatatcaacaacctaataaagatgtacagaatccacagggtttctgttctttacctgatcagattgctgccggtcgtcctaatttctggcacaccgtaaatgctcattatcaagaccagcaaggcaatcacaatctattccctggttcatggtccatgatgccttcaagtactggctttgggttgaacagacagagctatccaatgatgcaggaagttggtgggttgtctcagagtgctacgaacaccaagtttgggaatggagcttatgctgcactacctggtcatggcattgatcaatactcttctggatggtttgggcacatgatacctggtgctcgcatggacgatgtccagccacgcgtgattaagcctcaacctttggtccttgctcatggtgaagctcagaaaatgaaaggcaattcatgcaagctttttggaattcaccttgatagcccagccaaatctgaacctttgaaatctccaccaagtgttgcctatgatgggatgccacaaactccagcagcagctgaatggcggatggttgattcaattgaagcagacagatgttctgatccacttaagatgccaaagcaactcgatgctacacaggtagatcctgttccagagaaatgttcacaagtttcaagaggcacacagtgcaaatcacaaggtggatcaactaggagctgcaagaaggtccacaagcaaggaatcgcacttggcaggtctgtggatcttacaaagttcaatggctacacggaattgattgctgagctggatgagatgtttgacttcaatggggagctgaaaggttctaacaaggaatggatggttgtgtacaccgacaatgaaggtgatatgatgctggttggggatgatccctggaatgagttctgcaacatggtccacaagatcttcatctacacaagggaggaggtccagaggatgaatccgggcaccctgaattcaaggtccgaggacagccttgctaattcaatggaaaggggctctactgctagggagacacctggcagcctatccgcctcttcccttgactctgagaactgctaa

SEQ ID NO: 4956 - protein, 854 aa, Sorghum bicolor
  misc_feature (1)..(854): useful for making plants with increased cold tolerance as described in USSN 12/863,773
  misc_feature (1)..(854): Ceres Annot ID no. 8690553
  misc_feature (1)..(854): Bit score of 1661.5 for HMM based on sequences of FIGURE 5 of USSN  12/863,773.
  misc_feature (277)..(359): Pfam Name: Auxin_resp Pfam Desc: Auxin response factor
  misc_feature (150)..(255): Pfam Name: B3 Pfam Desc: B3 DNA binding domain
  misc_feature (1)..(854): Is Acted Upon By Ceres SEEDLINE ID no. ME00572
MTSAAAAAQAAGGGGGGGGVCEGDAAAAARGGGGGGTEDGMYTELWSLCAGPLVTVPRVGDKVYYFPQGHIEQVEASTNQVAEQHMQLYNLPWKILCEVMNVELKAEPDNDEVYAQLTLLPESKPEENGSSQEEMPAAPPAALARPRVHSFCKTLTASDTSTHGGFSVLRRHADECLPPLDMSRQPPTQELVAKDLHGVEWRFRHIFRGQPGRLFLQSGWSVFVSAKRLVAGDAFIFLRGDNGELRVGVRRAMRQQANVPSSVISSHSMHLGVLATAWHAVNTGTMFTVYYKPRTSPAEFVVPCDRYTESLKRNYPIGMRFKMRFEGEEAPEQRFTGTIVGNVDPEQAGWAESKWRYLKVRWDEASSIPRPERVSPWQIEPAVSPPPVNPLPVHRPKRPRSNAVASLAESSAPTKEAAPKVTLETQQHALQRPLQTQDNAAPKSGFGDNSELDAAHKSALRPSGFDLEKNTIGMQRKLGSDSWMHMNRPEGYNEMLSGYQQPNKDVQNPQGFCSLPDQIAAGRPNFWHTVNAHYQDQQGNHNLFPGSWSMMPSSTGFGLNRQSYPMMQEVGGLSQSATNTKFGNGAYAALPGHGIDQYSSGWFGHMIPGARMDDVQPRVIKPQPLVLAHGEAQKMKGNSCKLFGIHLDSPAKSEPLKSPPSVAYDGMPQTPAAAEWRMVDSIEADRCSDPLKMPKQLDATQVDPVPEKCSQVSRGTQCKSQGGSTRSCKKVHKQGIALGRSVDLTKFNGYTELIAELDEMFDFNGELKGSNKEWMVVYTDNEGDMMLVGDDPWNEFCNMVHKIFIYTREEVQRMNPGTLNSRSEDSLANSMERGSTARETPGSLSASSLDSENC

SEQ ID NO: 4957 - DNA, 2924 bp, Panicum virgatum
  misc_feature (1)..(2924): useful for making plants with increased cold tolerance as described in USSN 12/863,773
  misc_feature (1)..(2924): Ceres Clone ID no. 1744705
agccagccaacctacccgccccggacagcaaagcacaggcgcacgagcccccccagctccacgcctcctcctcctccctccccctctcccgccatcctcctccgccgcgcgccttcccgcccgccgagcctttaggagggggtttccggagtcgcggacgcgcgtgcgagaccccttcccctgccgccgagcgcaagtaagatctccggcctcccgccccgcgcgctccgggcgcctcctctctcccctgaattgcccgggctcgggggctctaacggctgccccggtggcgctgcgcgcgcagatctgccgagctcggcatggggtgaccagatcggggcgcggctcggggctctacggctgaattccgctcggtgaggagggagctggtctcggagaggccggggggatggcgaacgccggcgcggccgtcggtccagggggtgctagcgatgctttgttcagggaactctggcatgcttgtgctgggccgttggtcacggtgcctcgccaaggcgagctggtttactacttcccgcaaggtcatatggaacagcttgaagcatctacagatcagcaacttgaccagcacttacctttgtttaatctaccatccaagatcctgtgcaaagtggtaaatgtagaactcagagctgaaactgattccgatgaagtttatgctcaaattatgctgcaaccagaagcagatcaaaatgagcccactggcccagatcctgagccaccagagccagaaaggtgcaatgtccattccttctgcaagactttgactgcttcagacacgagcacccatggtggtttctctgtcctcaggagacatgctgaagaatgtttgccccaattggatatgactcagaatccaccatggcaagaactggtggctaaagatctccatggaaatgaatggcatttccgtcacatctttcgaggtcaaccaaggaggcatctacttacaacaggctggagtgtttttgttagctcaaaaagattggttgctggtgatgcatttatctttttgagaggtgataatggagagctacgagtcggggtaagaaggctcatgaggcaactaaataacatgccatcatcagttatctcaagccatagcatgcatcttggagtcctcgcaacagcatctcatgccatctccactggaactctcttttctgttttctacaaacccagaacaagtcgatcggagtttgttgtgagcgtaaacaagtaccttgaagctaagaatcacaagatgtctgtcggtatgaggtttaaaatgagatttgagggtaatgaatctcctgaaagaagatttagtgggacaattattggtctgggaagcatgccagctaactcaacatctccgtgggctgactctgattggagatctttgaaggtccaatgggatgagccttctgctgttgtccgtccagatagagtttcaccatgggaactagaaccccttaatgcaactaacacacaaccgcctcagcctcctttacggaataagcgtgcacggcctcctgcttcaccttctattgctccagaacttcctccagcttttggtttttggaaatccccagctgagcctacccatcctttctcattttcgggactgcagcgaactcaggaattataccattcaaaccccaattcaatcttttcatcatcgttgaatgtgggatttaattcaaagaatgaacattctactccaaccaacaatcatttgtactggccaattcgagacactagaacggaatcctactctgctagcattaacaaacttctacctgaaaggaagcaagaatccgctactgctggctgcagattgtttggtattgagataagtaatgcagtatcaccagtggttactgttgctagtgttggtcaagaccagccacctgttgagtcagtagatgttgagtctgatcagctgtcacagccatcccaagccaacaaaacagatgctccagcagcaagcagtgagcgctctcctcatgagactgagagccggcaagtcaggagctgcaccaaggtaatcatgcaaggaatggcggttggcagggcagtggacttgacgaggctagaaggatatgatgatcttctccacaagttggaggagatgtttgatatccagggggagctttctgctagcctcaagaaatggaaggttatttacacggatgatgaggatgatatgatgctggtcggggatgatccgtggcctgaattttgcagcatggtgaaaaggatatacatttactcctatgaggaggccaagtctttgactcccaaggcgaagctgccggtcattggtgataccactaaaccgaacccagacaagttgtcaccggaatctgacatgccgcagagtgactcaaacaacagcgctctggttgctgccgataaggactgatggatgctaacttggcgctctacctttaattcccgttttggatgtttgggaggcaatgcccatactccttgagactgctgagagttatctgtttgttgcgctgtgggcccgaaggacgttgccccacaatctgcctgactgccttggtttggaatggctgatgtaggaccagtggtggtcctctgccagcaaggtcgactggaatgtaatggcaagcaggccgcattgcgcgccgttccctgtgccaccaacctgtgttttgtttgccgtgtttggtaggaggcatggcgtatcgctggcctcacctccagagtaaataggactttatgtacaactattttggtagtagcagtagcggtttatgtatatcagcgtcatgttccttgctacctatataagcattatcatctgtagctgctgttcccacctgcattgtattctacccccggcttggtaccggatgctctggtgcaaaaatgtctctgcttgctgttcc

SEQ ID NO: 4958 - protein, 672 aa, Panicum virgatum
  misc_feature (1)..(672): useful for making plants with increased cold tolerance as described in USSN 12/863,773
  misc_feature (1)..(672): Ceres Clone ID no. 1744705
  misc_feature (1)..(672): Bit score of 1346.5 for HMM based on sequences of FIGURE 5 of USSN  12/863,773.
  misc_feature (248)..(333): Pfam Name: Auxin_resp Pfam Desc: Auxin response factor
  misc_feature (121)..(226): Pfam Name: B3 Pfam Desc: B3 DNA binding domain
  misc_feature (1)..(672): Is Acted Upon By Ceres SEEDLINE ID no. ME00572
MANAGAAVGPGGASDALFRELWHACAGPLVTVPRQGELVYYFPQGHMEQLEASTDQQLDQHLPLFNLPSKILCKVVNVELRAETDSDEVYAQIMLQPEADQNEPTGPDPEPPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGDNGELRVGVRRLMRQLNNMPSSVISSHSMHLGVLATASHAISTGTLFSVFYKPRTSRSEFVVSVNKYLEAKNHKMSVGMRFKMRFEGNESPERRFSGTIIGLGSMPANSTSPWADSDWRSLKVQWDEPSAVVRPDRVSPWELEPLNATNTQPPQPPLRNKRARPPASPSIAPELPPAFGFWKSPAEPTHPFSFSGLQRTQELYHSNPNSIFSSSLNVGFNSKNEHSTPTNNHLYWPIRDTRTESYSASINKLLPERKQESATAGCRLFGIEISNAVSPVVTVASVGQDQPPVESVDVESDQLSQPSQANKTDAPAASSERSPHETESRQVRSCTKVIMQGMAVGRAVDLTRLEGYDDLLHKLEEMFDIQGELSASLKKWKVIYTDDEDDMMLVGDDPWPEFCSMVKRIYIYSYEEAKSLTPKAKLPVIGDTTKPNPDKLSPESDMPQSDSNNSALVAADKD

SEQ ID NO: 4959 - protein, 670 aa, Medicago truncatula
  misc_feature (1)..(670): useful for making plants with increased cold tolerance as described in USSN 12/863,773
  misc_feature (1)..(670): Public GI ID no. 140053546
  misc_feature (1)..(670): Bit score of 1133.4 for HMM based on sequences of FIGURE 5 of USSN  12/863,773.
  misc_feature (250)..(332): Pfam Name: Auxin_resp Pfam Desc: Auxin response factor
  misc_feature (119)..(228): Pfam Name: B3 Pfam Desc: B3 DNA binding domain
  misc_feature (1)..(670): Is Acted Upon By Ceres SEEDLINE ID no. ME00572
MCFSITFTGSTNDALYKELWHACAGPLVTLPREGERVYYFPQGHMEQLEASMNQGLEQQMPSFNLPSKILCKVVNIHLRAEPETDEVYAQITLLPETDQSEVTSPDDPLPEPPRCTVHSFCKTLTASDTSTHGGFSVLRRHADDCLPPLDMTQQPPWQELVATDLHGNEWHFRHIFRGQPRRHLLTTGWSVFVSSKKLVAGDAFIFLRQVVLGENGELRVGVRRLMRQQSNMPSSVISSHSMHLGVLATASHAISTGTLFSVFYKPRTSRSEFIVSINKYLEARNHKLSVGMRFKMRFEGDEVPERRFSGTIVGVEDNKSSVWADSEWRSLKVQWDEPSSILRPDRVSPWELEPLVSTPPANSQPTQRNKRSRPPILPSTMTDSSLQGIWKSPADSPPFPYRDPQHGRDLYPSPRFSSTATSFLGFGGNSPASNKSMYWSSRLENSTEPFSPVALEESGEKRQGTGNGCRLFGIQLLENSNAEESLQTAPLSGRVGDDRSVPSLDVESDQHSEPSNVNRSDIPSVSCDADKSCLRSPQESQSRQIRSCTKVHMQGMAVGRAVDLTRFDGYEDLLRKLEEMFDIEGELCGATKKWLVVYTDNEDDMMMVGDDPWLEFCSVVRKMFIYTPEEVKKLSPKIGLPSNEEGKPSKLDSEAVVNPEDRSSIVGPGC

SEQ ID NO: 4960 - DNA, 2031 bp, Sorghum bicolor
  misc_feature (1)..(2031): useful for making plants with increased cold tolerance as described in USSN 12/863,773
  misc_feature (1)..(2031): Ceres Annot ID no. 8733583
atggggattgatctcaacagcgtggaggaggacgagcaggcgccggcgggcgcggtgtgctgcggggagctgtggcacgcgtgcgcgggggctggggtggcgctgccgcggcggggcagcgccgtggtgtacctgcctcaggcgcacctcgcggccggcggcgacggtggggagctgccggcccttgcggcggcgccgcgcgtgccgccgcacgtggtgtgtcgcgtcgtcgacgtcgagctacgcgcggatgcggcgacggacgaggtctatgcgcggcttgcgctggtggcggaggataagatgtttggccgaaacatccatgatggtgaaactgaagagaaggatggtgagaaagaggatggtgatggagaaaagctcacatcgcacatgttctgcaagacactcacagcttctgatacaagcactcatgggggattctctgttcctcggcgggctgcagaggactgctttccaccattggactatgagcagcttaggccttcccaagagcttattgccaaggatttgcatggcatgaaatggaggttccgtcatatctatagaggtcaacctcgtaggcatcttctgacaactggatggagttcatttattaataagaagaaactagtctcaggggatgcagtcttgtttctgagaggtagtgatggcgagctaagattgggtgtgaggagagcagttcaactgaaaaatgaagctctacttgaagctgtcaactgtactgattcgaagctacttatgctgtctgctgtggccagttctttggacaatagaagtatatttcacatctgtttcaacccaaggattggtgcatcagaatttattgtgccatattgcaagtttttgaagggcttgaactatcctttttcaattggaaccagatttaaagttggctgcaagaatgaagatgctaacgagaggtcctttggattgatctcaggtattagtgaagttgatcccatacgctggcctggatcaaaatggaaatctctcttggtaaagtgggatggtgataccaagtacagccaccagaatagagtatctccatgggacatcgagagagttggcagctcagtttcagttactcactgtctttcatcttgtgtttcgaagcgaatgaagttgtgcttcccccaaggcaatttggacgctccaattctagatggaaatggtcgtccagactctgtgggaactgaaggtttccaccaggtcttgcaaggtcaagaattggtgagggttcatggtgctgcatgctctcattcatcagatacccccagatgtcaaggctcttatggaaggagattctctgccgatgtgtggaactgcaagatgaatgatggacacctaaataccactgggtttgcttaccagcccctaggcttcagtgaatctgtcaaattctcagaggtcttgcaaggtcaagaaatgtctcaggtggcagccccttccttcatgagagatgctttcagtgctggcacacagaatggcagggttcgatcatttgattatgtgcagagatcagctgcaactcaaggatatgctctccagcaatttaatctgccagcaacagaagtgcattcaccgtcttctgttcttatgtttaaccaaaccatggtaccacagcctgagttagatggtctgaccaaccgtgaagaagcatatggcagcgggtactcatccattgcaatacagagagaagctgaaccatggccatccacgcagcagcaaagagtgcgcgaaaatggaagcgagcctctcgacacaactgaagcctcagctcctgcaaggatcgcaaaatctggatcggtggacaggggcgtcgggggaagcagctgtaagctttttggtttctccttgactgagaagatccttggaacagagggagttggtgggaaagaagggaactacgaagcggatcggcagactccccgggttctagacttgcttgggcacggccattctacgcccggtgctctgcatgctctttgcgctgctcccttgggaatatga

SEQ ID NO: 4961 - protein, 676 aa, Sorghum bicolor
  misc_feature (1)..(676): useful for making plants with increased cold tolerance as described in USSN 12/863,773
  misc_feature (1)..(676): Ceres Annot ID no. 8733583
  misc_feature (1)..(676): Bit score of 1288.5 for HMM based on sequences of FIGURE 5 of USSN  12/863,773.
  misc_feature (258)..(339): Pfam Name: Auxin_resp Pfam Desc: Auxin response factor
  misc_feature (131)..(236): Pfam Name: B3 Pfam Desc: B3 DNA binding domain
  misc_feature (1)..(676): Is Acted Upon By Ceres SEEDLINE ID no. ME00572
MGIDLNSVEEDEQAPAGAVCCGELWHACAGAGVALPRRGSAVVYLPQAHLAAGGDGGELPALAAAPRVPPHVVCRVVDVELRADAATDEVYARLALVAEDKMFGRNIHDGETEEKDGEKEDGDGEKLTSHMFCKTLTASDTSTHGGFSVPRRAAEDCFPPLDYEQLRPSQELIAKDLHGMKWRFRHIYRGQPRRHLLTTGWSSFINKKKLVSGDAVLFLRGSDGELRLGVRRAVQLKNEALLEAVNCTDSKLLMLSAVASSLDNRSIFHICFNPRIGASEFIVPYCKFLKGLNYPFSIGTRFKVGCKNEDANERSFGLISGISEVDPIRWPGSKWKSLLVKWDGDTKYSHQNRVSPWDIERVGSSVSVTHCLSSCVSKRMKLCFPQGNLDAPILDGNGRPDSVGTEGFHQVLQGQELVRVHGAACSHSSDTPRCQGSYGRRFSADVWNCKMNDGHLNTTGFAYQPLGFSESVKFSEVLQGQEMSQVAAPSFMRDAFSAGTQNGRVRSFDYVQRSAATQGYALQQFNLPATEVHSPSSVLMFNQTMVPQPELDGLTNREEAYGSGYSSIAIQREAEPWPSTQQQRVRENGSEPLDTTEASAPARIAKSGSVDRGVGGSSCKLFGFSLTEKILGTEGVGGKEGNYEADRQTPRVLDLLGHGHSTPGALHALCAAPLGI

SEQ ID NO: 4962 - DNA, 1974 bp, Sorghum bicolor
  misc_feature (1)..(1974): useful for making plants with increased cold tolerance as described in USSN 12/863,773
  misc_feature (1)..(1974): Ceres Annot ID no. 8700968
atggacgcgcccaaccctgcagcggctgctggctcaggaggaatgcctagtgacgccctgtaccgagagctgtggcatgcgtgtgccggcccgttggtcacagtacctagacaaggcgagcgcgtctattacttcccccagggccatatggagcagcttgaggcgtctacacaccagcagcttgatcagtacttaccgatgttcaatctaccacccaagatcctatgcagtgtagtcaacgtggaactacgggccgaagctgattcagatgaagtttatgctcaaattatgttgcaaccagaagctgatcaaaacgaactcaccagcctggaccctgaaccacaagaacctgaaaaatgcactgcccattccttctgcaagacactgacagcttcagatacgagcactcacggcggtttttctgttcttcggaggcatgctgaagaatgtcttcctcagctggacatgtctctaaatccaccttgccaagaactggttgccaaagatctccatggcactgaatggcattttcgacacatttttcgagggcaacccaagaggcatctccttacaactggctggagtgtctttgttagctcaaagagattggttgcgggggatgcatttatcttcatgagaggtgaaaatggtgagctacgggttggtgtaaggaggctcatgagacaagtaaatagcatgccgtcatctgtcatatcaagccacagcatgcatcttggagtcttggccacagcctcccatgccatctccactggaaccctcttttccgttttctacaaaccaagaactagccgatctgattttattgtgagtgttaacaagtaccttgaagctaagaagcagaaaatatctgttggaatgaggtttaagatgagatttgaaggtgatgaggctcctgaaagaaggttcagtggaacaattattggcattggcagtttgccggcaatgtcaaaatctctgtgggcagattctgactggagatctctaaaggttcaatgggacgaaccttcatccattcttcgtccagatagaatctcaccatgggaagtggagcccctggatgctgctaatccacaatcccctcaacctccaccaaggcctaagcgtccacgacccccagcttcaccttgtatggtttcagaactgccttcaggttttggactctggaaatccccaacagaatcatcccgtacactctcattttcggaacctcaacgggctcgagagttatttccttcaattcccacatcaaccttctcatcttcatcaaacgtcagtttcaattcaaagaatgagccatccatgctaaccacacagttctactggtcagcaagggatacaagagctgactcctgcgctgctagcaccaacacagtcatagttgaaaagaagcaagagccaagttctggtggttgcagattgtttggaattgatatatgctcagctgaggaagaagtattacctgtggttactgctccaggtgttggttatgagcagactgctgcctctgtagagttgaactcggataagctctcacagggatctgatgtcaacaattctgatgccccagcagctagcagtgagcgttcacctcttgaatcccaaagccggcaagtgaggagctgcaccaaggtaattatgcaaggaatggcagttggaagggctgtagacctgacaaagcttagtggctacagtgatctttgccagaagttggaggagatgtttgacatccacggggagctaggttgcacactcaagaaatggcgggtcattttcactgatgatgaggatgacatgatgcttgttggggatgatccttgggatgagttttgcagaatggtgaaaaggatttacatttacacatatgaggaggcgaagaaactgacatccaagtcaaagttacctgttagcagtgacagcagcaagctgagtgctgtaaactcactgtctgaatga

SEQ ID NO: 4963 - protein, 657 aa, Sorghum bicolor
  misc_feature (1)..(657): useful for making plants with increased cold tolerance as described in USSN 12/863,773
  misc_feature (1)..(657): Ceres Annot ID no. 8700968
  misc_feature (1)..(657): Bit score of 1132.7 for HMM based on sequences of FIGURE 5 of USSN  12/863,773.
  misc_feature (251)..(336): Pfam Name: Auxin_resp Pfam Desc: Auxin response factor
  misc_feature (124)..(229): Pfam Name: B3 Pfam Desc: B3 DNA binding domain
  misc_feature (1)..(657): Is Acted Upon By Ceres SEEDLINE ID no. ME00572
MDAPNPAAAAGSGGMPSDALYRELWHACAGPLVTVPRQGERVYYFPQGHMEQLEASTHQQLDQYLPMFNLPPKILCSVVNVELRAEADSDEVYAQIMLQPEADQNELTSLDPEPQEPEKCTAHSFCKTLTASDTSTHGGFSVLRRHAEECLPQLDMSLNPPCQELVAKDLHGTEWHFRHIFRGQPKRHLLTTGWSVFVSSKRLVAGDAFIFMRGENGELRVGVRRLMRQVNSMPSSVISSHSMHLGVLATASHAISTGTLFSVFYKPRTSRSDFIVSVNKYLEAKKQKISVGMRFKMRFEGDEAPERRFSGTIIGIGSLPAMSKSLWADSDWRSLKVQWDEPSSILRPDRISPWEVEPLDAANPQSPQPPPRPKRPRPPASPCMVSELPSGFGLWKSPTESSRTLSFSEPQRARELFPSIPTSTFSSSSNVSFNSKNEPSMLTTQFYWSARDTRADSCAASTNTVIVEKKQEPSSGGCRLFGIDICSAEEEVLPVVTAPGVGYEQTAASVELNSDKLSQGSDVNNSDAPAASSERSPLESQSRQVRSCTKVIMQGMAVGRAVDLTKLSGYSDLCQKLEEMFDIHGELGCTLKKWRVIFTDDEDDMMLVGDDPWDEFCRMVKRIYIYTYEEAKKLTSKSKLPVSSDSSKLSAVNSLSE

SEQ ID NO: 4964 - protein, 831 aa, Vitis vinifera
  misc_feature (1)..(831): useful for making plants with increased cold tolerance as described in USSN 12/863,773
  misc_feature (1)..(831): Public GI ID no. 147770011
  misc_feature (1)..(831): Bit score of 909.6 for HMM based on sequences of FIGURE 5 of USSN 12/863,773.
  misc_feature (280)..(362): Pfam Name: Auxin_resp Pfam Desc: Auxin response factor
  misc_feature (153)..(258): Pfam Name: B3 Pfam Desc: B3 DNA binding domain
  misc_feature (1)..(831): Is Acted Upon By Ceres SEEDLINE ID no. ME00572
  misc_feature (606)..(606): Xaa is any aa, unknown or other
MVAMIDLNTVDDDETPSSGSSSSSSSSASASASTVCGSLLSAASSVCLELWHACAGPLISLPKKGSLVVYFPQGHLEQLSDYPAVAYDLPPHVFCRVVDVKLHAEVVTDEVYAQVSLVPETKIKQKLQEGEIEADGGEEEDIEGSIKSMTPHMFCKTLTASDTSTHGGFSVPRRAAEDCFPPLDYKQQRPSQELVAKDLHGFEWRFRHIYRGQPRRHLLTTGWSAFVNKKKLVSGDAVLFLRGGDGELRLGIRRAAQIKGSSPFPALCSQQLNLNTLTAVVNAISTRSVFNICYNPRASSSEFIIPLRKFSKSIDHSFSAGMRFKMRVETEDAAERRYTGLITGISDMDPVRWPGSKWRCLLLHHSHGSECVLLPCLPYYSDSATFFDLSLQVRWDDIEANRHNRVSPWEIELSGSLSGSGSLTVPGSKRTRIGLPGTRPDFSVPNGMGVSDFGESSRFQKVLQGQEIFGFNTPYDGVDTQDHHPSEIRCFPGSSCSRIAAIGNGVRNPLGNSDISYKGIGFGESFRFHKVLQGQETFPSPPCGRALSANQAHENGSFGIFDGVQVPTSRNGWPALVQGYNAHTHLSTPSVQVSSPSSVLMRRSKXLSNRSSFDIPEVYGEKLTPSRCELSVRGGGQGGMNFFGLLNEHNQLAVPHPLVTQSAFRGSQDLVPTCKSSCRLFGFSLTEERSIGNKVDNPTPVTSSLIPGTSFLPQQLHSEPPVMTKAIGSNCTKRTAVVRSKLQFHKLGSVVDQAINRWKLDRHDDLICALKHLFDMEGGLLHGEGNDMHLSLTPAFYSPKSGLAEIQNGYPFANSYVRPVFPENRILDIII

SEQ ID NO: 4965 - DNA, 2049 bp, Sorghum bicolor
  misc_feature (1)..(2049): useful for making plants with increased cold tolerance as described in USSN 12/863,773
  misc_feature (1)..(2049): Ceres Annot ID no. 8668727
atgggaatcgatctcaacatggtgggcggcgagggccacgatcgccgcccgccgccgccggtgagccgggagctgtggcacgcgtgcgcggggcccgtggtcgcgctaccgcggcgggggagcctggtcgtgtacctgccgcagggccacctagccgcggcgggcggcggggacgtcgctgcggacctgccgccgcacgtggtgtgccgcgtcgcggatgtcgagctatgcgcggatgcggcgacggacgaggtgtacgcgcggctggcgctggttgcggaaggcgaggcatttgggagaaatctgcacggcggcggagctgaaggggacgatgacatggaggatttggatgctgaaaggaagtcccggatgttgcacatgttctgcaaaacgcttacagcctctgacacaagcacgcatggagggttctctgttcctcgccgtgctgctgaggactgtttcccgcctctggattataatcagctcaggccttctcaagagctggttgccaaggatttgcatggaactaaatggaagtttcgtcatatatataggggtcagcctcgtaggcatctcttgactactggatggagttcatttgtcaataaaaagaaactggtttcaggggatgctgtgttatttctccgaggtgatgatggtgaactaaggcttggtgtacggagagccattcagcttaaaaatgaggccctttttgaagatttcagtagtgacagtacaaagcggcatacattgtcggctgtagctgattccttgaagcacagaagtgtttttcacatttcttacaatccaagagctactgcttcagaatatattattccataccataagttcctgaagagcctcaatcatccagtctgtgttggagcaaggatcaactttcagtgccataatgaagatgttagtgaaaggcgatctggaatggttgttcgcattagtgaaatagatcccatgaaatggcctggctcgaagtggagaagcctgctggtaagatgggaggatggtgctgaatgtaacggccaagatagagtatctccatgggagatcgaggtagctggtggttctgtctctgttgctcattctctgtccgcatctagttctaaaagaaccaagttgtgtgctcagggaaatttggacgttccaacaatgtggaatggttgtactgactccgtggaaactggaaagttacccagggtcttgcaaggtcaagaattgatgggttttaggactcgtcatgttccgtgtgctcctcaaactgctgaggctgcaaaacttcaatcttctgatgctagtaggtttcttagtaatgcacgtgactgcgcattgagtgctccaacaagcagactcgcagtgcataactctggttttacctaccaatctgtaggcttcaatgaatctattggattctcagaggtcttgcaaggtcaagaaatttctcgggcagttcctatgttccaaggaatgatgtctgaggcttgttcactgaaaggcggatatgggctacatagttatatgcataccccagttgctgttaatggattatcagccccagctcaagaatgttgtctgacactatctactccgccaggagcacaagtgccctctctctaccctgataatatttttaaccgaactgtggttccgcagcttggactggcaagcaagtttggtggtggaggtacaaatggccagcagtctggcccatttgataggcggagggaaatttggaccaagccacagcatgaaacacctgatcaaatgaacttggatcagtttgagactagaagagcttcagcacctggagatgctggtaagcttgggtctggtggaggggaggttcgcaaaactagctgcagactttttggtttctccttgactgagaagatcttgccagcagatgatgatggcgtcaaggaagtgagctatgagcctgagtgccagaacccacggatgctggatctgtttgggtacaactgctcaaccccgagtgctgctcttccggctctgtgtgctgcccccattggaatgtga

SEQ ID NO: 4966 - protein, 682 aa, Sorghum bicolor
  misc_feature (1)..(682): useful for making plants with increased cold tolerance as described in USSN 12/863,773
  misc_feature (1)..(682): Ceres Annot ID no. 8668727
  misc_feature (1)..(682): Bit score of 1041.4 for HMM based on sequences of FIGURE 5 of USSN  12/863,773.
  misc_feature (127)..(232): Pfam Name: B3 Pfam Desc: B3 DNA binding domain
  misc_feature (254)..(335): Pfam Name: Auxin_resp Pfam Desc: Auxin response factor
  misc_feature (1)..(682): Is Acted Upon By Ceres SEEDLINE ID no. ME00572
MGIDLNMVGGEGHDRRPPPPVSRELWHACAGPVVALPRRGSLVVYLPQGHLAAAGGGDVAADLPPHVVCRVADVELCADAATDEVYARLALVAEGEAFGRNLHGGGAEGDDDMEDLDAERKSRMLHMFCKTLTASDTSTHGGFSVPRRAAEDCFPPLDYNQLRPSQELVAKDLHGTKWKFRHIYRGQPRRHLLTTGWSSFVNKKKLVSGDAVLFLRGDDGELRLGVRRAIQLKNEALFEDFSSDSTKRHTLSAVADSLKHRSVFHISYNPRATASEYIIPYHKFLKSLNHPVCVGARINFQCHNEDVSERRSGMVVRISEIDPMKWPGSKWRSLLVRWEDGAECNGQDRVSPWEIEVAGGSVSVAHSLSASSSKRTKLCAQGNLDVPTMWNGCTDSVETGKLPRVLQGQELMGFRTRHVPCAPQTAEAAKLQSSDASRFLSNARDCALSAPTSRLAVHNSGFTYQSVGFNESIGFSEVLQGQEISRAVPMFQGMMSEACSLKGGYGLHSYMHTPVAVNGLSAPAQECCLTLSTPPGAQVPSLYPDNIFNRTVVPQLGLASKFGGGGTNGQQSGPFDRRREIWTKPQHETPDQMNLDQFETRRASAPGDAGKLGSGGGEVRKTSCRLFGFSLTEKILPADDDGVKEVSYEPECQNPRMLDLFGYNCSTPSAALPALCAAPIGM

SEQ ID NO: 4967 - protein, 670 aa, Vitis vinifera
  misc_feature (1)..(670): useful for making plants with increased cold tolerance as described in USSN 12/863,773
  misc_feature (1)..(670): Public GI ID no. 157354310
  misc_feature (1)..(670): Bit score of 1095.7 for HMM based on sequences of FIGURE 5 of USSN  12/863,773.
  misc_feature (246)..(329): Pfam Name: Auxin_resp Pfam Desc: Auxin response factor
  misc_feature (119)..(224): Pfam Name: B3 Pfam Desc: B3 DNA binding domain
  misc_feature (1)..(670): Is Acted Upon By Ceres SEEDLINE ID no. ME00572
MTCCCLLGAPCDALYKELWHACAGPLVTVPREGERVYYFPQGHMEQLEASTTHQGLDQQMPSFNLPSKILCKVVHVQLRAEPETDEVYAQVTLLPEPDQSEITSPDPPLPEPQRCTVHSFCKTLTASDTSTHGGFSVLRRHADDCLPPLDMSQQPPWQELVAADLHGNEWHFRHIFRGQPRRHLLTTGWSVFVSSKKLVAGDAFIFLRGENGELRVGVRRLMRQLSNMPSSVISSHSMHLGVLATASHAISTGTLFSVFYKPRTSRSEFIVSLNKYLEARNHKLSVGMRFKMRFEGEEVPERRFSGTIVGVGDKNTSSGWADSEWRSLKVQWDEPASIFRPERVSAWELEPLVAAAAPTNLQPAQRNKRARPPVLPSATPDLSVLGMWKSSVESPSGFPYCDPHRGRDLYPSPKFSSITKTNSFSFSGNSSPAAVSSNSMYWSNRMETATESFAPAVNKESGEKRRDTGSGCRLFGFQLLDNSTLEETLPVLTVGEDQPVPSLDVESDQHSEPSNINRSDIPSVSCEPDKLSLRSPQESQSRQIRSCTKVHMQGIAVGRAVDLTRFDRYEDLLKKLEEMFDIQGELCGLTSIWQVVYTDDEDDMMMVGDDPWLEFCSMVRKIFIYTAEEVKRLSPKIKLPAMEEIKPGKLDSDVAVAGTDDQSSVVGPGC

SEQ ID NO: 4968 - DNA, 2721 bp, Panicum virgatum
  misc_feature (1)..(2721): useful for making plants with increased cold tolerance as described in USSN 12/863,773
  misc_feature (1)..(2721): Ceres Clone ID no. 1769972
attaatggggtgctcatcctcctgacctcctcgtcctccccctcctctcctcctccccgccgggtcgcggtcggctccgccttttaaccgccttgccctggagggggccgagcggcggaccgcacgggcgcacgaccgcggggggaccggagcaggacccggaaccctagtggcggccgcgcgcgccatgggcatcgatctcaacatggtggacggcgagggcgaggagcggcgccccccgccggcggtgtgccgggacctgtggcacgcgtgcgcggggcccgtagtcgcgctgccgcggcggggcagcctcgtcgtgtacctgccgcagggccacctcgctgcggctggcggcggggacgtcgcggcggacctgccgccgcacgtggtgtgccgcgtcgcggacatcgagctatgcgcggatgcggcgacggacgaggtgtacgcacggctggcgctggtggcggagggtgaggcatttgggagaaatgtgcgtgttggtggagttgaaggggacgaggacatggaggattttgatgctgaaaggaagtcccggatgctgcacatgttctgcaaaacgctcactgcctctgacacaagcacgcatggagggttctctgttcctcgtcgagctgctgaggactgtttcccaccgctggactataatcaactcaggccttctcaagagcttgttgccaaggatttgcatggagccaagtggaagtttcgtcatatttataggggtcagcctcgtaggcatctcttaacaactggatggagttcatttgtcaataaaaagaaactggtttcaggggatgcagtcttatttctccgaggtgatgatggtgaactaagactgggtgtaaggagagctgttcagcttaaaaatgaggccctttttgaagaattcagtagcgacagtgcaaagcgacatacgttgtctgctgtatataattccttgaaacataaaagtgtctttcacatttcttacaatccaagagttgctgcttcagaatatataattccttaccggaagttccttaagagcctcaaccatccagtctgtattggagcgaggatcaacttccaatgccagaatgaagatgttagtgaaaggcgatctggaatggttgttggcaatagtgaagtagatcccatgaaatggcctggctcaaagtggagaagcctgctggtaagatgggaggatggttctgaatgcaatggccaagatagagtatctccatgggagatcgatatagttggtggctcagtctctgctgcccattctctgtccgcatctagttctaaaagaaccaagttatgccctccgggaaatttggacgttccaacaatgtggaatggttgtactgactccgtggaaactggaaagttacccagggtcttgcaaggtcaagaattgatgggttttaggactcatcgtgttacgtgtgctcctcaaacagctgaggttgcaaaatttcaatcttctgatgctagtaggttccttactaatgcacgaagctgcatgttgagtggtccaacaggcagacttgcagtacagaactctggctttacctaccaatctctgggcttcagtgaatctattggattctcagaggtcttgcaaggtcaagaaatttctcaggcagttcctatgttccaaggaatgatatctgcggcatgttcactgaagggcggatatgggctgcgtggttatgtgcataccccagctgctgttaatggattatcagccacagctcaagaatgttctctcacactatgtactccacctgcagcacaagtgccccctcctcatcccaatcatatgtttaaccaaactgtgtcgtcccagcttggattgggaaacaagtctgctggcgaagttgcaaatggcagtcagcctcgcccatttgatatgtcgtgggaagctcagaccaggccacagcatgaaatacctgctcaaattagcttggatcaatttgaggctaggagagcttcagcacctggagatgctgctaaaattgggtctggtggaagggaggtgcgcaaaactagctgcaggctttttggtttctcattgactgagaagatcttgccagctgatgatgatggcgtgaaggaagtgagttatgaggctgagtgccagaatccacggatgctggacttgttcgggtacaactgctccaccccaagtgctgctcttccagctctctgtgccgcccccttcggaatgtgatgctactttagtaatctttccaagtattttcaagcactcagattagacgtactttcccagtaccccagtgtgtgcataagctgtcttttgacctcattccctccattggcctgctcatgttaatcagtcatctgcacgagtcaaggaaggatgattggtgaaccattcctctgcatggctcacctggccacccaaagtattatggttgtgtatcgtgatatgcaccattgtaacttttgtggctatccttcagacccattgtgcgatgaagctaacgatgtgccctaaaagtacttcgctcacagatttggattcatgggaaggtctgtcagctttgatgtaccggttatgtgtctttaactgagctcctgtatgacttttgtagctcagtcatgagccgtgtttgcactggtgcctaggtcgtgtgattgtatcagtatgtaagactattgcttcgtttcaagatatgttgcttatggaccttt

SEQ ID NO: 4969 - protein, 682 aa, Panicum virgatum
  misc_feature (1)..(682): useful for making plants with increased cold tolerance as described in USSN 12/863,773
  misc_feature (1)..(682): Ceres Clone ID no. 1769972
  misc_feature (1)..(682): Bit score of 1072.6 for HMM based on sequences of FIGURE 5 of USSN  12/863,773.
  misc_feature (127)..(232): Pfam Name: B3 Pfam Desc: B3 DNA binding domain
  misc_feature (254)..(335): Pfam Name: Auxin_resp Pfam Desc: Auxin response factor
  misc_feature (1)..(682): Is Acted Upon By Ceres SEEDLINE ID no. ME00572
MGIDLNMVDGEGEERRPPPAVCRDLWHACAGPVVALPRRGSLVVYLPQGHLAAAGGGDVAADLPPHVVCRVADIELCADAATDEVYARLALVAEGEAFGRNVRVGGVEGDEDMEDFDAERKSRMLHMFCKTLTASDTSTHGGFSVPRRAAEDCFPPLDYNQLRPSQELVAKDLHGAKWKFRHIYRGQPRRHLLTTGWSSFVNKKKLVSGDAVLFLRGDDGELRLGVRRAVQLKNEALFEEFSSDSAKRHTLSAVYNSLKHKSVFHISYNPRVAASEYIIPYRKFLKSLNHPVCIGARINFQCQNEDVSERRSGMVVGNSEVDPMKWPGSKWRSLLVRWEDGSECNGQDRVSPWEIDIVGGSVSAAHSLSASSSKRTKLCPPGNLDVPTMWNGCTDSVETGKLPRVLQGQELMGFRTHRVTCAPQTAEVAKFQSSDASRFLTNARSCMLSGPTGRLAVQNSGFTYQSLGFSESIGFSEVLQGQEISQAVPMFQGMISAACSLKGGYGLRGYVHTPAAVNGLSATAQECSLTLCTPPAAQVPPPHPNHMFNQTVSSQLGLGNKSAGEVANGSQPRPFDMSWEAQTRPQHEIPAQISLDQFEARRASAPGDAAKIGSGGREVRKTSCRLFGFSLTEKILPADDDGVKEVSYEAECQNPRMLDLFGYNCSTPSAALPALCAAPFGM

SEQ ID NO: 4970 - DNA, 2421 bp, Solanum lycopersicum
  misc_feature (1)..(2421): useful for making plants with increased cold tolerance as described in USSN 12/863,773
  misc_feature (1)..(2421): Ceres Annot ID no. 8460878
atggctacttctgagaattgccggaacgctgccggcgccggaaaagttgatgctgagaaagcgttgtacacggagctatggcgagcatgtgcaggtccgcttgtgacagtgccatgtgaaggcgagctggtgttctatttcccacaaggtcatattgaacaggttgaagcatcaacaaaccaagcttcagaccagcagatgccagtatataatcttccttctaagatcctctgtcgtgtgattaacgtcctgctgaaggctgaacccgatacagatgaggtgtatgcacaagtgactttgttgccagaaccaaatcaagatgagaatgtggtatcaaaggaaccgatgccctctccgccaccacgattccatgtgcactctttttgtaagacattaacagcctctgataccagcactcatggaggattttctgtcttgagacggcatgctgatgaatgcctcccgcctctggttagaaagaattctttctcaatacagttatggtgcctgtattttgataatcctccaacacaggagttggtggccaaagatttgcatgcaaatgagtggcgcttcaggcacatattccggggccagcctaggaggcaccttcttcagagtggttggagtgtctttgttagttcgaaaaggcttgttgcaggggatgcattcatatttcttagaggtgagaatggggagcttcgtgttggagtccgacgtgccatgagacagcagggtaatgctccatcatcagtgatatccagtcatagcatgcatcttggtgtccttgctacagcttggcatgctattcagacgaaaacactgacgagccctgctgactttatagttccatatgatcagtatatggagtctctgaaaaacaattactccatcgggatgaggtttaaaatgaggtttgaaggtgaagaagctccagaacagaggtttactggaactatagttggcattgaaaatgctgacctcaaaaggtggcctgagtcaaaatggagatgcctgaaggttcgatgggatgaaacttctgctattcctaggccagaccgagtttcaccctggaaagtagagccagctcttagccctcctgcacttaatccacttccaataccaaggcagaaaaggccgcgatcaaatgttctgccctcgtctcctgattcttctgtacttactagggaaggttcatccaaagtagttgtagacacttcacaagccagtgggttttcaagagttttgcaaggtcaagaaatatcaaccttgagaggcaattttgtagaaaataacgagtcggactcttctgagaagccacctatatggcaaccattactggatgacgagaaggctgatgttcattctgcgtcaaggaaatgtatatcagataaacggcttcctttagggaggcctgaatcatcttttacagatcttttatcaggttttggggggcaatctagttcatctcatggattccattcacccactgggggccaaacagcacctgctagctgggttaagcgacaagctctggataaggaaactgatttcagcttactggcaaaacaatggtctctagtgtcttctggtctctcacttaatctgatggaatcaggattgaagggtgcagatactctgtatcaaatgcggggaacatctcgactcaattgttttaacgagtatccaaccttccctggtcatagacctgacaatcagcagggaaattggttaatgcccccgtccgtgctgccttatattcagatgtccgctcattctggagaaattatgcctaaacccatggcttcaccacagcccgaagccatgaaacccaaagaagggaactgcaaactatttggcattccccttgtaagtaaatgtgccaccatagatcctgtcatgttgcggaaaaattccccgattcactcaacaagtaacatgcactttggtatacatccacatcaattccctataattgaatctgatcaaaggtctgagcaatcaaagggatcaaagctaccagatgatggcttcatagttcatgatcaggaagaacaattccaaacctctcatcctggtactcgagatagagagggcaaaggccttgttcattcaacaaggagttgcaccaaggttcataaacagggtacagcccttggaaggtctgttgatcttgcaaagttcaacaactatgaagaattgatagctgaactggatcacatttttgattttaatggtgagctcaaggctcgtaacaagaactggctgatttttatctacacgaaagatgaggtgcagcggatgaaccctgggactctcaattcaaaaggcgaggacaattcttctgttgcagaaggctctgatgctaaagaagtgaagaatctacagcttcacattgattccagtccggaagattcttag

SEQ ID NO: 4971 - protein, 806 aa, Solanum lycopersicum
  misc_feature (1)..(806): useful for making plants with increased cold tolerance as described in USSN 12/863,773
  misc_feature (1)..(806): Ceres Annot ID no. 8460878
  misc_feature (1)..(806): Bit score of 1407.8 for HMM based on sequences of FIGURE 5 of USSN  12/863,773.
  misc_feature (266)..(340): Pfam Name: Auxin_resp Pfam Desc: Auxin response factor
  misc_feature (127)..(244): Pfam Name: B3 Pfam Desc: B3 DNA binding domain
  misc_feature (1)..(806): Is Acted Upon By Ceres SEEDLINE ID no. ME00572
MATSENCRNAAGAGKVDAEKALYTELWRACAGPLVTVPCEGELVFYFPQGHIEQVEASTNQASDQQMPVYNLPSKILCRVINVLLKAEPDTDEVYAQVTLLPEPNQDENVVSKEPMPSPPPRFHVHSFCKTLTASDTSTHGGFSVLRRHADECLPPLVRKNSFSIQLWCLYFDNPPTQELVAKDLHANEWRFRHIFRGQPRRHLLQSGWSVFVSSKRLVAGDAFIFLRGENGELRVGVRRAMRQQGNAPSSVISSHSMHLGVLATAWHAIQTKTLTSPADFIVPYDQYMESLKNNYSIGMRFKMRFEGEEAPEQRFTGTIVGIENADLKRWPESKWRCLKVRWDETSAIPRPDRVSPWKVEPALSPPALNPLPIPRQKRPRSNVLPSSPDSSVLTREGSSKVVVDTSQASGFSRVLQGQEISTLRGNFVENNESDSSEKPPIWQPLLDDEKADVHSASRKCISDKRLPLGRPESSFTDLLSGFGGQSSSSHGFHSPTGGQTAPASWVKRQALDKETDFSLLAKQWSLVSSGLSLNLMESGLKGADTLYQMRGTSRLNCFNEYPTFPGHRPDNQQGNWLMPPSVLPYIQMSAHSGEIMPKPMASPQPEAMKPKEGNCKLFGIPLVSKCATIDPVMLRKNSPIHSTSNMHFGIHPHQFPIIESDQRSEQSKGSKLPDDGFIVHDQEEQFQTSHPGTRDREGKGLVHSTRSCTKVHKQGTALGRSVDLAKFNNYEELIAELDHIFDFNGELKARNKNWLIFIYTKDEVQRMNPGTLNSKGEDNSSVAEGSDAKEVKNLQLHIDSSPEDS

SEQ ID NO: 4972 - protein, 862 aa, Vitis vinifera
  misc_feature (1)..(862): useful for making plants with increased cold tolerance as described in USSN 12/863,773
  misc_feature (1)..(862): Public GI ID no. 157343873
  misc_feature (1)..(862): Bit score of 1864.9 for HMM based on sequences of FIGURE 5 of USSN  12/863,773.
  misc_feature (289)..(371): Pfam Name: Auxin_resp Pfam Desc: Auxin response factor
  misc_feature (162)..(267): Pfam Name: B3 Pfam Desc: B3 DNA binding domain
  misc_feature (1)..(862): Is Acted Upon By Ceres SEEDLINE ID no. ME00572
MASSEVSIKGNCGHGRGESFTSGYSEPNDGGVSRSVAEGQKGHSSVSGAGKDFETALYTELWHACAGPLVTVPRERERVFYFPQGHIEQVEASTNQVSDQQMPVYDLPSKILCRVINVQLKAEPDTDEVFAQVTLLPEPNQDETAQEKEPLPPPPPRFHVHSFCKTLTASDTSTHGGFSVLRRHADECLPQLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAKSTGTMFTVYYKPRTSPAEFIVPFDQYMESVKNNYSIGMRFKMRFEGEEAPEQRFTGTIVGIEDADPKRWRDSKWRCLKVRWDETSTIPRPDRVSPWKIEPAVTPPALNPLPVPRPKRPRSNMVPSSPDSSVLTREGSSKVTVDPSPASGFSRVLQGQEFSTLRGTFAESNESDTAEKSVVWPPLLDDEKIDVVSTSRRFGSDNWMHLVRHEPTCTDLLSGFGARTDSSHGFSSFVDQNDVAANTMKKHLEHESKFNLLAGPWSMMPSGLSLNLLESSIKVPVQGSDMPYQTRGDARFGGFSEYPTLHGHRVELQQGNWLMPPPAQSHFENFAHSRELMPKPILVQKQEAVKPKDGNCKLFGIPLIGNPVISEPAMSYRSMTNEPAGHLHLAPSAFDSDQKSEQSKGAKSTDNPLAVSEQEKPCQTSLPLSRDVQGKVQSVSTRSCTKVHKQGIALGRSVDLTKFNNYDELIAELDQLFEFGGELMAPKKNWLIVYTDDEGDMMLVGDDPWQEFCGMVRKIYIYTREEVQRMNPGTLNSKNDDNPSVAEGMDAKEVKRQPVPLTSNLENC

SEQ ID NO: 4973 - protein, 946 aa, Vitis vinifera
  misc_feature (1)..(946): useful for making plants with increased cold tolerance as described in USSN 12/863,773
  misc_feature (1)..(946): Public GI ID no. 147791931
  misc_feature (1)..(946): Bit score of 1795.4 for HMM based on sequences of FIGURE 5 of USSN  12/863,773.
  misc_feature (289)..(371): Pfam Name: Auxin_resp Pfam Desc: Auxin response factor
  misc_feature (162)..(267): Pfam Name: B3 Pfam Desc: B3 DNA binding domain
  misc_feature (1)..(946): Is Acted Upon By Ceres SEEDLINE ID no. ME00572
MASSEVSIKGNCGHGRGESFTSGYSEPNDGGVSRSVAEGQKGHSSVSGAGKDFETALYTELWHACAGPLVTVPRERERVFYFPQGHIEQVEASTNQVSDQQMPVYDLPSKILCRVINVQLKAEPDTDEVFAQVTLLPEPNQDETAQEKEPLPPPPPRFHVHSFCKTLTASDTSTHGGFSVLRRHADECLPQLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAKSTGTMFTVYYKPRTSPAEFIVPFDQYMESVKNNYSIGMRFKMRFEGEEAPEQRFTGTIVGIEDADPKRWRDSKWRCLKVRWDETSTIPRPDRVSPWKIEPAVTPPALNPLPVPRPKRPRSNMVPSSPDSSVLTREGSSKVTVDPSPASGFSRVLQGQEFSTLRGTFAESNESDTAEKSVVWPPLLDDEKIDVVSTSRRFGSDNWMHLVRHEPTCTDLLSGFGARTDSSHGFSSFVDQNDVAANTMKKHLEHESKFNLLAGPWSMMPSGLSLNLLESSIKVPVQGSDMPYQTRGDARFGGFSEYPTLHGHRVELQQGNWLMPPPAQSHFENFAHSRELMPKPILVQKQEAVKPKDGNCKLFGIPLIGNPVISEPAMSYRSMTNEPAGHLHLAPSAFDSDQKSEQSKGAKSTDNPLAVSEQEKPCQTSLPLSRDVQGKVQSVSTRSCTKVCIHSLDGCWFLNNEYEIWKMLAGYKIVPQICFIAVSCLMSIGNLVHKQGIALGRSVDLTKFNNYDELIAELDQLFEFGGELMAPKKNWLIVYTDDEGDMMLVGDDPWQEFCGMVRKIYIYTREEVQRMNPGTLNSKNDDNPSVAEGMDAKEVKQKLAMVVLVGRAIELIEMHKSLLPLLDRFLNGCTFGWFLFSGLWEAPVDDGF

SEQ ID NO: 4974 - DNA, 2124 bp, Sorghum bicolor
  misc_feature (1)..(2124): useful for making plants with increased cold tolerance as described in USSN 12/863,773
  misc_feature (1)..(2124): Ceres Annot ID no. 8734042
atggcggggatcgacctcaacgacaccgtggaggaggacgaggaggaggcggagcccggcaaccccgcctgctcccagcaaagccggaccagctccgcggccacgcccccacccccgccgctgaccccgctgctccagccgaggccgggcgccgcggtgtgcctcgagctctggcacgcctgcgccggccccgtcgcgccgctgccgcggaaagggaccgtcgtcgtctacctcccgcagggacacctggagcacctcggtgacgccgccgcggccgcagccggaggcgcgccggcgcccgccgccctgccgccccacgtcttctgccgcgtcgtcgacgtcactctccatgcggacgcgtccacggacgaggtgtacgcccagctcgccctcgtcgccgagaacgaggatgtcgcgaggcggctgcgcggagggtccgaggacgggagcgctggggacggcgacgacggggaggccgtgaagcagcggttctcgcggatgccgcacatgttctgcaagacgctcacggcctccgacaccagcacgcacggcggcttctccgtgccgcgccgcgccgccgaggactgcttcccgcctctggactacagccagcagcggccgtcgcaggagcttgtcgccaaggatttgcacggaaccgagtggaggttccgccacatttatcgaggccagccccgcaggcaccttttaaccactggatggagtgcatttgtcaacaagaagaagcttgtctcaggggacgctgtactatttttgagaggtgatgatggggagctaagacttggagtgcgccgtgcagctcagcttaaaaatggatctgcttttccagctctttataatcagtgttctaatcttggttcactagctaacgtagcacatgctgtggccacaaaaagcgtgttccacatctactacaaccccagattaagccaatctgaattcattataccgtattcaaagtttatgaagagcttcagtcaacaattttctgctggtttgaggttcaaaatgagatatgagagtgatgatgcttctgaaagaagatgcactggggtaatagcaggaattggtgatgctgaccccatgtggcgtggttcgaagtggaaatgtttgatggtccgatgggatgatgatgtagattttcgtcgaccgaacaggatttctccttgggagattgagctgactagttcagtttcaggatcccatctgtctgcaccaaatgcaaagagactcaaaccatgtcttcccccggactacctagttccaaatggaagtggttgtcctgattttgcggaatctgcccaattccacaaggtcttgcaaggtcaagaattattgggttatagaactcgtgacaatgctgctgttgcaacttctcaaacaccactaggaaaccctaggttttcctaccattgctcaggctttggggagtctccaagattccaaaaggtcttgcaaggtcaagaagtatttcaaccctaccgaggaactctagtcgatccaagtttgagaaatagtggctttcatcagcaagatggttctcatgtgcctactcaagcgaataagtggcatccacagcttcatgggtgtgcttttcgtgggacacaagcaccagctattccatctcaatcctcatcgccaccatctgtcctaatgtttcaacgagataatccaaagatgtccccttttgaatttgggcattgtcacatggataagaatgaggatatgcgtgcaatgtttggccatgctggaggtattggaagaactgagcaaacaatgatgctccaggctcataatgtttctggaggaatgggaaatagagatgtgaccgttgagaaatttcagcccactgttgctgttggaagggatggatcagacaacagggaagttaccaaaaatagttgcaaaatatttggcatatctttgactgagaaggttccagcaatcaaagaaaaggactgtggtgataccaactatccatcccccttcctgtctttgaagcaacacgtgccaaaatcgctgggcaacagttgtgccactattcatgagcagaggcctgttgttggtagggtgattgatgtttcaacagtggatatgatgatctga

SEQ ID NO: 4975 - protein, 707 aa, Sorghum bicolor
  misc_feature (1)..(707): useful for making plants with increased cold tolerance as described in USSN 12/863,773
  misc_feature (1)..(707): Ceres Annot ID no. 8734042
  misc_feature (1)..(707): Bit score of 1084.7 for HMM based on sequences of FIGURE 5 of USSN  12/863,773.
  misc_feature (297)..(378): Pfam Name: Auxin_resp Pfam Desc: Auxin response factor
  misc_feature (170)..(275): Pfam Name: B3 Pfam Desc: B3 DNA binding domain
  misc_feature (1)..(707): Is Acted Upon By Ceres SEEDLINE ID no. ME00572
MAGIDLNDTVEEDEEEAEPGNPACSQQSRTSSAATPPPPPLTPLLQPRPGAAVCLELWHACAGPVAPLPRKGTVVVYLPQGHLEHLGDAAAAAAGGAPAPAALPPHVFCRVVDVTLHADASTDEVYAQLALVAENEDVARRLRGGSEDGSAGDGDDGEAVKQRFSRMPHMFCKTLTASDTSTHGGFSVPRRAAEDCFPPLDYSQQRPSQELVAKDLHGTEWRFRHIYRGQPRRHLLTTGWSAFVNKKKLVSGDAVLFLRGDDGELRLGVRRAAQLKNGSAFPALYNQCSNLGSLANVAHAVATKSVFHIYYNPRLSQSEFIIPYSKFMKSFSQQFSAGLRFKMRYESDDASERRCTGVIAGIGDADPMWRGSKWKCLMVRWDDDVDFRRPNRISPWEIELTSSVSGSHLSAPNAKRLKPCLPPDYLVPNGSGCPDFAESAQFHKVLQGQELLGYRTRDNAAVATSQTPLGNPRFSYHCSGFGESPRFQKVLQGQEVFQPYRGTLVDPSLRNSGFHQQDGSHVPTQANKWHPQLHGCAFRGTQAPAIPSQSSSPPSVLMFQRDNPKMSPFEFGHCHMDKNEDMRAMFGHAGGIGRTEQTMMLQAHNVSGGMGNRDVTVEKFQPTVAVGRDGSDNREVTKNSCKIFGISLTEKVPAIKEKDCGDTNYPSPFLSLKQHVPKSLGNSCATIHEQRPVVGRVIDVSTVDMMI

SEQ ID NO: 4976 - protein, 687 aa, Oryza sativa subsp. japonica
  misc_feature (1)..(687): useful for making plants with increased cold tolerance as described in USSN 12/863,773
  misc_feature (1)..(687): Public GI ID no. 158564103
  misc_feature (1)..(687): Bit score of 984.1 for HMM based on sequences of FIGURE 5 of USSN 12/863,773.
  misc_feature (259)..(340): Pfam Name: Auxin_resp Pfam Desc: Auxin response factor
  misc_feature (132)..(237): Pfam Name: B3 Pfam Desc: B3 DNA binding domain
  misc_feature (1)..(687): Is Acted Upon By Ceres SEEDLINE ID no. ME00572
MGIDLNTVEEEAEEGAAAAVCGELWHACAGPGVALPRRGSALVYLPQAHLAADGGGGEVPPAGAAAVPPHVACRVVGVELRADAATDEVYARLALVAEGEMLQRNFREGGGEDGAGEMEGCDAEKKPRMPHMFCKTLTASDTSTHGGFSVPRRAAEDCFPPLDYKTVRPSQELIAVDLHGTQWKFRHIYRGQPRRHLLTIGWSSFVNRKKLVSGDAVLFLRGDDGQLRLGVRRAVQLRNEALFEPVNSSDSKLRILSSVASSLENKSVFHICFNPRSGASEFIVPYWRLLKSLNHPFSIGMRFRVCYESEDANERSAGLISGISEVDPIRWPGSRWKCLLVRWDDSTDSSHQNRVSPWEIERVGGSVSVTHSLSSGSKRTKLHFPQGSLDTPFLNGNGHPDSMGTENFHRVLQGQEFRGSRSHGVVCSESPGVPNFQSPDNRRFSADMRGYMMPASGPPQRNTEFTYQPIGFSESLGFPEVLQGQEMSQVVPLFRGATFGARTQNDRVVSANSVHRSAAQSGLLASTLGHPISQFTLSSSKVSSPSSVLMFNQATAPNHETVSGTNNKGMHVSQFASQEMLSETVTWPGTQRQTPSEITSNQFALARIPAPPSGAESGLPKRDAGRSSCRLFGFSLTGNMLGEDGEGLDDGAIEAGCENPPVLELFGHSHSTPGALHALCAAAPLGM

SEQ ID NO: 4977 - protein, 653 aa, Vitis vinifera
  misc_feature (1)..(653): useful for making plants with increased cold tolerance as described in USSN 12/863,773
  misc_feature (1)..(653): Public GI ID no. 157360302
  misc_feature (1)..(653): Bit score of 952.6 for HMM based on sequences of FIGURE 5 of USSN 12/863,773.
  misc_feature (243)..(322): Pfam Name: Auxin_resp Pfam Desc: Auxin response factor
  misc_feature (116)..(221): Pfam Name: B3 Pfam Desc: B3 DNA binding domain
  misc_feature (1)..(653): Is Acted Upon By Ceres SEEDLINE ID no. ME00572
MMVGFGGEGDDLYAELWKACAGPLVDVPRRGERVFYFPQGHVEQLEASTNQELSQRIPLFNLPSKILCRVIHIQLRAEQETDEVYAQITLLPEPDQAEPRSPDPCTPEPPRPTVHSFCKVLTASDTSTHGGFSVLRKHANECLPQLDMNQATPTQELVAKDLHGYEWRFKHIFRGQPRRHLLTTGWSTFVTSKRLVAGDSFVFLRGDNGELRVGVRRLARQQSTMPTSVISSQSMHLGVLATASHAVATQTLFIVYYKPRTSQFIIGLNKYLEAVSNGFAVGMRFKMRFEGEDSPERRFSGTIVGGEDFSPEWKDSEWRSLKVQWDEPASIPRPEKVSPWEIEHYVSSVPQGLAPPGVLKNKRPRSNESPVPGSAAASAVWHLGLTQSHDLTQMSSTAEGKRSENHQADIGAIPPTEGSWLSSSHVSASQHQFQDATEDSKSVSAWPALSGYSTLHSSKLTSDTIIDPNGNGKKAVAEMATSCRLFGFELMNHSSSPPVGKAHGHSISSDLSKASKEQKQGQSHVSPKEIQSKQNCYSNTRSRTKVQMQGIAVGRAVDLTALEGYDELIDELEEMFEIKGELRPRYKWEIVFTDDEGDMMLVGDDPWPEFCNMVRRIFICSSQDVKKMSPGSKLPISSMEGEGTTISLDSTEN

SEQ ID NO: 4978 - DNA, 1032 bp, Arabidopsis thaliana
  misc_feature (1)..(1032): useful for making plants with increased salt and oxidative stress tolerance as described in USSN 12/282,342
  misc_feature (1)..(1032): Ceres CLONE ID no. 8686
  misc_feature (1)..(1032): Ceres Seed Line ID no. ME03807
aaaaaaacactagtatcaaaaattgaacccgttaaccggcgacccgaaacaatgacccggtccgtcagtttccctctcttcctcttcgccgttgtactctccctctcttcttctctcctcgccgacgatcccaaaccaatccgccgtgaggtctacgaaggaggtaagatatacgacatcagccatcgttacacgccggagattccagcttgggaatcttcggaaggattgggaaagacgttcctgcgattagccgcgagtatgaagaatggatcattcgctaacgtatcggagatgaaactatctgttcactctggaactcacgtggatgctccaggtcacttttgggataattattacgatgctggttttgatactgattcgcttgatctccaagtcctaaatggtcctgctttgttggttgatgttccgagagataagaacattactgctgaggtaatggaatcacttcatatacaaagaggagttcgtcgtgtgctctttagaacatccaacaccgacaagcggcttatgtttaagaaagagtttgattcaagctttgctgggttcatgaccgatggggctaaatggttggttgagaatacagacatcaaacttattgggcttgattatctttcatttgctgcttttgaggaatcacctgcaacacacagggttatacttaaaggacgggatataatcccagtggaagcgctgaagctggatggtgtggaggtaggaacatactcgcttcattgcttaccgctgagattagttggagcggaaggagcaccgacaagatgcattctcatcaagtgattcagttcttcttcttcttcttcttcttctgtgtaagttgttcagtataccaaactgataatgaataatatgcttcttactttacaagatctcagaacccatgaagcagatgtgatgattcagttgtaaaaggaagcatacctttataaacgtgtgaatgtattatgtatgacagtatatttgtaattctgaaggacatgataataaacctag

SEQ ID NO: 4979 - protein, 255 aa, Arabidopsis thaliana
  misc_feature (1)..(255): useful for making plants with increased salt and oxidative stress tolerance as described in USSN 12/282,342
  misc_feature (1)..(255): Ceres CLONE ID no. 8686
  misc_feature (1)..(255): Ceres Seed Line ID no. ME03807
  misc_feature (40)..(241): Pfam Name: Cyclase Pfam Description: Putative cyclase
MTRSVSFPLFLFAVVLSLSSSLLADDPKPIRREVYEGGKIYDISHRYTPEIPAWESSEGLGKTFLRLAASMKNGSFANVSEMKLSVHSGTHVDAPGHFWDNYYDAGFDTDSLDLQVLNGPALLVDVPRDKNITAEVMESLHIQRGVRRVLFRTSNTDKRLMFKKEFDSSFAGFMTDGAKWLVENTDIKLIGLDYLSFAAFEESPATHRVILKGRDIIPVEALKLDGVEVGTYSLHCLPLRLVGAEGAPTRCILIK

SEQ ID NO: 4980 - protein, 204 aa, Brassica napus
  misc_feature (1)..(204): useful for making plants with increased salt and oxidative stress tolerance as described in USSN 12/282,342
  misc_feature (1)..(204): Ceres CLONE ID no. 1096546
  misc_feature (1)..(185): Pfam Name: Cyclase Pfam Description: Putative cyclase
  misc_feature (1)..(204): Functional Homolog of  Ceres CLONE ID no. 8686 with e-value of 8.19E-91 and BLAST sequence identity of 87.2
  misc_feature (88)..(88): Xaa is any aa, unknown or other
  misc_feature (99)..(99): Xaa is any aa, unknown or other
  misc_feature (134)..(134): Xaa is any aa, unknown or other
  misc_feature (152)..(152): Xaa is any aa, unknown or other
  misc_feature (171)..(171): Xaa is any aa, unknown or other
  misc_feature (194)..(194): Xaa is any aa, unknown or other
  misc_feature (196)..(196): Xaa is any aa, unknown or other
  misc_feature (200)..(200): Xaa is any aa, unknown or other
MPAWESKEGLSNHLRLIASMKNGSFANVSEMKLSVHSGTHVDAPGHFIDEYYDAGFDCDSLDLQTLNGPALLVDVPRDKNITAEVMEXLHIPRGVRRVXFRTSNTDKRLMFKKEFDSSFSGFMTDGAKWLVENXDIKLVGLDYLSFAAFDEXPATHKVILRGRDIIPVEAXKLDGVEAGMYSLHCLPLRLVGAXGXPTRXILIK

SEQ ID NO: 4981 - protein, 157 aa, Brassica napus
  misc_feature (1)..(157): useful for making plants with increased salt and oxidative stress tolerance as described in USSN 12/282,342
  misc_feature (1)..(157): Ceres CLONE ID no. 1311812
  misc_feature (1)..(157): Functional Homolog of  Ceres CLONE ID no. 8686 with e-value of 2.60E-64 and BLAST sequence identity of 86.7
  misc_feature (13)..(141): Pfam Name: Cyclase Pfam Description: Putative cyclase
  misc_feature (37)..(37): Xaa is any aa, unknown or other
  misc_feature (58)..(58): Xaa is any aa, unknown or other
MDKVLTNAGFDSDSLDLQVLHGPALLVDVPRDKNITXVMKSLHIPKGVRRVLFRTLNXDRRLMFKKEFDSSFAGFMMDGAKWLVENTDIKLIGLDYLSFAAYEEAPETHKFILGERDIIPVEALKLDGVEVGVYSLHCLPLRLPGAEGAPTRCILIK

SEQ ID NO: 4982 - protein, 204 aa, Brassica napus
  misc_feature (1)..(204): useful for making plants with increased salt and oxidative stress tolerance as described in USSN 12/282,342
  misc_feature (1)..(204): Ceres CLONE ID no. 952461
  misc_feature (1)..(204): Functional Homolog of  Ceres CLONE ID no. 8686 with e-value of 1.79E-88 and BLAST sequence identity of 85.7
  misc_feature (1)..(182): Pfam Name: Cyclase Pfam Description: Putative cyclase
  misc_feature (76)..(76): Xaa is any aa, unknown or other
  misc_feature (77)..(77): Xaa is any aa, unknown or other
  misc_feature (78)..(78): Xaa is any aa, unknown or other
  misc_feature (88)..(88): Xaa is any aa, unknown or other
  misc_feature (99)..(99): Xaa is any aa, unknown or other
  misc_feature (134)..(134): Xaa is any aa, unknown or other
  misc_feature (152)..(152): Xaa is any aa, unknown or other
  misc_feature (171)..(171): Xaa is any aa, unknown or other
  misc_feature (194)..(194): Xaa is any aa, unknown or other
  misc_feature (196)..(196): Xaa is any aa, unknown or other
  misc_feature (200)..(200): Xaa is any aa, unknown or other
MPAWESKEGLSNHLRLIASMKNGSFANVSEMKLSVHSGTHVDAPGHFIDEYYDAGFDCDSLDLQTLNGPALLVDVXXXKNITAEVMEXLHIPRGVRRVXFRTSNTDKRLMFKKEFDSSFSGFMTDGAKWLVENXDIKLVGLDYLSFAAFDEXPATHKVILRGRDIIPVEAXKLDGVEAGMYSLHCLPLRLVGAXGXPTRXILIK

SEQ ID NO: 4983 - protein, 233 aa, Brassica napus
  misc_feature (1)..(233): useful for making plants with increased salt and oxidative stress tolerance as described in USSN 12/282,342
  misc_feature (1)..(233): Ceres CLONE ID no. 954851
  misc_feature (1)..(233): Functional Homolog of  Ceres CLONE ID no. 8686 with e-value of 4.70E-95 and BLAST sequence identity of 80.4
  misc_feature (20)..(216): Pfam Name: Cyclase Pfam Description: Putative cyclase
  misc_feature (112)..(112): Xaa is any aa, unknown or other
  misc_feature (113)..(113): Xaa is any aa, unknown or other
  misc_feature (134)..(134): Xaa is any aa, unknown or other
MTSSDDLKPIRQEVYGERKIFDITHRYTQDMPVWESTEGVKPFLRLTTSMKNQSLSNTSEMKLSVHTGTHLDAPGHFHDKYYDAGFDSDSLDLQVLHGPALLVDVPRDKNIXXVMKSLHIPKGVRRVLFRTLNXDRRLMFKKEFDSSFAGFMMDGAKWLVENTDIKLIGLDYLSFAAYEEAPETHKFILGERDIIPVEALKLDGVEVGVYSLHCLPLRLPGAEGAPTRCILIK

SEQ ID NO: 4984 - protein, 271 aa, Zea mays
  misc_feature (1)..(271): useful for making plants with increased salt and oxidative stress tolerance as described in USSN 12/282,342
  misc_feature (1)..(271): Ceres CLONE ID no. 1064137
  misc_feature (1)..(271): Functional Homolog of  Ceres CLONE ID no. 8686 with e-value of 1.00E-90 and BLAST sequence identity of 75.2
  misc_feature (57)..(257): Pfam Name: Cyclase Pfam Description: Putative cyclase
MAVPPLLLLTLLSLPSLLIHAAISDAYPTIPGTAPIDGGFSDELKPIRREVYGEGKIFDISHRYTPEMPAWESKEGIGRFLWLAASMKNGSLANNSEMKIPTHTGTHVDSPGHVYDEYYDAGFDVDSLDLQVLNGPALLVDVPRNKNITAEVMKSLNIPRGVRRVLFRTLNTDRRLMFKKEFDTSYVGFMKDGAQWLVDNTDIKLVGVDYLSVAAYDDLIPSHLVFLKGRETILVEGLKLDDVKAGVYSVHCLPLRLVGAEGSPIRCILIS

SEQ ID NO: 4985 - protein, 121 aa, Zea mays
  misc_feature (1)..(121): useful for making plants with increased salt and oxidative stress tolerance as described in USSN 12/282,342
  misc_feature (1)..(121): Ceres CLONE ID no. 368629
  misc_feature (1)..(121): Functional Homolog of Ceres CLONE ID no. 8686 with e-value of 9.09E-37 and BLAST sequence identity of 72.8
  misc_feature (1)..(103): Pfam Name: Cyclase Pfam Description: Putative cyclase
MPEWESSEGSGEFLQLARSMRNGSDIANFSELRLTAHSGTHVDAPGHVFEHYYDTGFDVDTLDLAVLNGPALLVDVPRDKNITADVMASLNMPKGVRRVLFRTLNTDRMVHNGWLIIQTSN

SEQ ID NO: 4986 - protein, 205 aa, Glycine max
  misc_feature (1)..(205): useful for making plants with increased salt and oxidative stress tolerance as described in USSN 12/282,342
  misc_feature (1)..(205): Ceres CLONE ID no. 473732
  misc_feature (1)..(205): Functional Homolog of  Ceres CLONE ID no. 8686 with e-value of 3.60E-74 and BLAST sequence identity of 71.2
  misc_feature (1)..(191): Pfam Name: Cyclase Pfam Description: Putative cyclase
MPVWDSTEGLGQHFLWLEKSMKNGSRANNSNMKLGVHTGTHVDAPGHFYDNYYDAGFDVDSLDLTLLNGLALLVDVPRDKNITAEVMKSLNIPRGVSRVLFRTLNTDRQLMFKKEFDTSYVGFKEDGAKWLAENTDIKLVGVDYLSVAAYDHSIPSHLVFLESKEIILVEGLKLDDVPAGIYSLNCLPLRLVHSEASPIRCILIK

SEQ ID NO: 4987 - DNA, 831 bp, Populus balsamifera subsp. trichocarpa
  misc_feature (1)..(831): useful for making plants with increased salt and oxidative stress tolerance as described in USSN 12/282,342
  misc_feature (1)..(831): Ceres ANNOT ID no. 1441150
atggcatccctcctcttgttactgctcctgtctcccctctccaccaccgcagcctccagcggcgcttaccccaccatccctggcagcatagacacctctttccccgcttcacaagacagcaaacttatcccaatcaggcgtgaggtgtatggtgatgggagaatatttgacataacccacaggtacacaagcgacatgccgtccatgggatcagaaaatgggctgggtcagttcctgaggctccctgaaagcatgaagaatgggtccttcgccaacatatcggagatgaagttgatcactcatactggcacacacgtcgatgcacctggacattactatgatcattacttcgatgctgggtttgatgtggacactcttgaccttgaagtacttaatggtcctggactattaattgatgttccaagggggacgaacataactgctgaagttatgaagtccttacatattcccaaaggagctcgacgtgttcttttcaggacagaaaataccgacaggcgacttatgttcaaaaatcagatcgatacaagctttgtgggatttacaacggatggagcaaaatggttggtagacaacactgacattaagcttgttggaattgattacttagctgttgctgcttggagtgatttggttccagctcatcttgtccttttggaaagcagggtgagactaatgcagtgtaaagaaatcatcattgtggaaggcctaaaactcgatgacatccaacctggtgtgtattctatccattgtttgcctataagattgctcggtgctgaaggatcaccaacgcgatgcattctcatcaaatga

SEQ ID NO: 4988 - protein, 211 aa, Populus balsamifera subsp. trichocarpa
  misc_feature (1)..(211): useful for making plants with increased salt and oxidative stress tolerance as described in USSN 12/282,342
  misc_feature (1)..(211): Ceres ANNOT ID no. 1441150
  misc_feature (1)..(211): Functional Homolog of  Ceres CLONE ID no. 8686 with e-value of 2.30E-72 and BLAST sequence identity of 68.6
  misc_feature (13)..(197): Pfam Name: Cyclase Pfam Description: Putative cyclase
MPSMGSENGLGQFLRLPESMKNGSFANISEMKLITHTGTHVDAPGHYYDHYFDAGFDVDTLDLEVLNGPGLLIDVPRGTNITAEVMKSLHIPKGARRVLFRTENTDRRLMFKNQIDTSFVGFTTDGAKWLVDNTDIKLVGIDYLAVAAWSDLVPAHLVLLESRVRLMQCKEIIIVEGLKLDDIQPGVYSIHCLPIRLLGAEGSPTRCILIK

SEQ ID NO: 4989 - protein, 251 aa, Glycine max
  misc_feature (1)..(251): useful for making plants with increased salt and oxidative stress tolerance as described in USSN 12/282,342
  misc_feature (1)..(251): Ceres CLONE ID no. 554272
  misc_feature (1)..(251): Functional Homolog of  Ceres CLONE ID no. 8686 with e-value of 1.90E-75 and BLAST sequence identity of 68.0
  misc_feature (37)..(237): Pfam Name: Cyclase Pfam Description: Putative cyclase
MNCYWWHALIMSGCVLGLCVGIGGCVCVVENENGRIIIDISHRYHPDMPAWESKDSLGQFLWLTRSMANGSLANFSQFKLPAHSGTHVDAPGHVFDHYFHSGFDVDSLDLLLLNGPALLVDVPRDTNISAGVMKSLNIPRGVRRVLFRTLNTYRRLMYQKEFDTSYVGFTEDGANWLVENTDIKLVGIDYLSVAAYDHLIPAHLVFLKGREIILVEGLKLDDVAAGIYTVHCLPLRLAGAEGSPIRCILIK

SEQ ID NO: 4990 - protein, 255 aa, Glycine max
  misc_feature (1)..(255): useful for making plants with increased salt and oxidative stress tolerance as described in USSN 12/282,342
  misc_feature (1)..(255): Ceres CLONE ID no. 511015
  misc_feature (1)..(255): Functional Homolog of  Ceres CLONE ID no. 8686 with e-value of 1.40E-81 and BLAST sequence identity of 66.3
  misc_feature (40)..(240): Pfam Name: Cyclase Pfam Description: Putative cyclase
MKRGALLSVLACAFAAVIWAANGDDNLVPPRREVYGNGRIFDISHRYQPEMPEWESNDGIGQFLWLPKSMKNGSLANNSEMKFPTHTGTHVDAPGHVFDHYFHAGFDVDTLDLDILNGPAMLVDVPRDSNITAQVMKSLNIPRGVIRVLFRTLNTDRRLMFQKEWDSSYVGFTADGAKWLVENTDIKLVGIDYLSVASYDYLIPSHLVFLKDREIILVEGLKLDDVPAGLYSVHCLPLRLAGAEGSPIRCILIKN

SEQ ID NO: 4991 - protein, 265 aa, Triticum aestivum
  misc_feature (1)..(265): useful for making plants with increased salt and oxidative stress tolerance as described in USSN 12/282,342
  misc_feature (1)..(265): Ceres CLONE ID no. 881632
  misc_feature (1)..(265): Functional Homolog of  Ceres CLONE ID no. 8686 with e-value of 2.10E-78 and BLAST sequence identity of 66.3
  misc_feature (51)..(251): Pfam Name: Cyclase Pfam Description: Putative cyclase
MAPPLLLLLLVPLVAATAPCAHPAHPSQPASCAAEPVLAPERREAHGGGRILDITHYYREDMPSWESGAGVGQFLWLPASMRNGSLANNSEMRMPTHTGTHIDASGHVFQHYFDAGFDVDTLDLDVLNGPALLVDVPRDENITAKTMESLHIPKGVQRVLFRTLNTDRNLMWKKEFDTSYVGFMKDGAQWLVDNTDIKLVGIDYLSVAAFDDLIPSHLVLLENRDIILVEGLKLENVIPGIYSLHCLPLRLRGAEGSPIRCILIK

SEQ ID NO: 4992 - protein, 269 aa, Oryza sativa subsp. japonica
  misc_feature (1)..(269): useful for making plants with increased salt and oxidative stress tolerance as described in USSN 12/282,342
  misc_feature (1)..(269): Public GI no. 50944095
  misc_feature (1)..(269): Functional Homolog of  Ceres CLONE ID no. 8686 with e-value of 1.40E-79 and BLAST sequence identity of 66.2
  misc_feature (55)..(255): Pfam Name: Cyclase Pfam Description: Putative cyclase
MAHLAPLFLLLLLLLLPLHAAATPSAHPAYPNEPPSCAAAVPVPERREAHGGGRILDITHYYREDMPSWESDGGVGQFLWLPASMRNGSRANNSEMRLPTHTGTHVDAPGHVFQHYFDAGFDVDSLDLEVLNGLALLVDVPRDDNITAKMMESLHIPKGIQRVLFRTLNTDRQLMWKKEFDTSYVGFMEDGAQWLVDNTDIKLVGIDYLSVAAFDDLIPSHLVLLKNRDIILVEGLKLENIMPGIYSLHCLPLRLRGAEGSPIRCILIK

SEQ ID NO: 4993 - DNA, 825 bp, Populus balsamifera subsp. trichocarpa
  misc_feature (1)..(825): useful for making plants with increased salt and oxidative stress tolerance as described in USSN 12/282,342
  misc_feature (1)..(825): Ceres ANNOT ID no. 1494052
atgtccaccaccaaaaccatgatccctctcctcctcctcctcctcctctctcccctctccaccaccgcttctaccgccgcctaccccacaatcccgggcaccatagacacctcagtctcctcctcccaacccgacaacctgattccaatccgcaacgaaatctacggcaatggtaaaatctttgacataagtcacagatacataaacgatatgccggtttgggactctaaagacgggttgggaaagttcctgtctttaccagcaagcatgaaaaatgggtctctcgctaacaactcagaaatgaagttacctactcatactggcacgcatgttgactcacctggacatgtttttgatcattactttgattctgggttcgatgttgatactcttgatcttgaagtccttaatggtcctgctttgctagtggatgttccaaggcattccaatataactgctgaagttatgaagtccttacacattccaaagggagtgcgtcgcgtgcttttcagaacactaaacactgacaggcggcttatgttcaaaagggagtttgatagaagttatgtggggttcacaaaggatggtgcaaaatggttggtagacaacactgacatcaagcttgttggaattgattacctatctgttgctgcctggagtgatttgattccatctcatcttgtctttctagaaggcagggaaatcatccttgtggaggctttaaaactggatgacatccaacctggagtatattctgtccattgtttacccctgaggttgtttggcgccgagggatctccaataagatgcgttctcatcaaatga

SEQ ID NO: 4994 - protein, 274 aa, Populus balsamifera subsp. trichocarpa
  misc_feature (1)..(274): useful for making plants with increased salt and oxidative stress tolerance as described in USSN 12/282,342
  misc_feature (1)..(274): Ceres ANNOT ID no. 1494052
  misc_feature (1)..(274): Functional Homolog of  Ceres CLONE ID no. 8686 with e-value of 4.30E-85 and BLAST sequence identity of 65.6
  misc_feature (60)..(260): Pfam Name: Cyclase Pfam Description: Putative cyclase
MSTTKTMIPLLLLLLLSPLSTTASTAAYPTIPGTIDTSVSSSQPDNLIPIRNEIYGNGKIFDISHRYINDMPVWDSKDGLGKFLSLPASMKNGSLANNSEMKLPTHTGTHVDSPGHVFDHYFDSGFDVDTLDLEVLNGPALLVDVPRHSNITAEVMKSLHIPKGVRRVLFRTLNTDRRLMFKREFDRSYVGFTKDGAKWLVDNTDIKLVGIDYLSVAAWSDLIPSHLVFLEGREIILVEALKLDDIQPGVYSVHCLPLRLFGAEGSPIRCVLIK

SEQ ID NO: 4995 - DNA, 1005 bp, Populus balsamifera subsp. trichocarpa
  misc_feature (1)..(1005): useful for making plants with increased salt and oxidative stress tolerance as described in USSN 12/282,342
  misc_feature (1)..(1005): Ceres ANNOT ID no. 1441151
atgtccaccaccaaaaccatgatccctctcctcctcctcctcctcctctctcccctctccaccaccgcttctaccgccgcctaccccacaatcccgggcaccatagacacctcagtctcctcctcccaacccgacaacctgattccaatccgcaacgaaatctacggcaatggtaaaatctttgacataagtcacagatacataaacgatatgccggtttgggactctaaagacgggttgggaaagttcctgtctttaccagcaagcatgaaaaatgggtctctcgctaacaactcagaaatgaagttacctactcatactggcacgcatgttgactcacctggacatgtttttgatcattactttgattctgggttcgatgttgatactcttgatcttgaagtccttaatggtcctgctttgctagtggatgttccaaggcattccaatataactgctgaagttatgaagtccttacacattccaaagggagtgcgtcgcgtgcttttcagaacactaaacactgacaggcggcttatgttcaaaagggagtttgatagaagttatgtggggttcacaaaggatggtgcaaaatggttggtagacaacactgacatcaagcttgttggaattgattacctatctgttgctgcctggagtgatttgattccatctcatcttgtctttctagaaggcagggaaatcatccttgtggaggctttaaaactggatgacatccaacctggagtatattctgtccattgtttacccctgaggatcctttattcacacttgttcaatgctgctaccagctcacatgccacaccatggcacaacaggcaagatacaatctaccacaacaaaagcctactgtttatcccacgtgaattgtctggtcagaaaggatcacaaacagaggccagtgactcaaatttaggcgggcgcttcattgactggcaagtggcaacagaaaccttccacgacccaggatcagtgcttgtatag

SEQ ID NO: 4996 - protein, 334 aa, Populus balsamifera subsp. trichocarpa
  misc_feature (1)..(334): useful for making plants with increased salt and oxidative stress tolerance as described in USSN 12/282,342
  misc_feature (1)..(334): Ceres ANNOT ID no. 1441151
  misc_feature (1)..(334): Functional Homolog of  Ceres CLONE ID no. 8686 with e-value of 6.10E-79 and BLAST sequence identity of 64.5
  misc_feature (60)..(260): Pfam Name: Cyclase Pfam Description: Putative cyclase
MSTTKTMIPLLLLLLLSPLSTTASTAAYPTIPGTIDTSVSSSQPDNLIPIRNEIYGNGKIFDISHRYINDMPVWDSKDGLGKFLSLPASMKNGSLANNSEMKLPTHTGTHVDSPGHVFDHYFDSGFDVDTLDLEVLNGPALLVDVPRHSNITAEVMKSLHIPKGVRRVLFRTLNTDRRLMFKREFDRSYVGFTKDGAKWLVDNTDIKLVGIDYLSVAAWSDLIPSHLVFLEGREIILVEALKLDDIQPGVYSVHCLPLRILYSHLFNAATSSHATPWHNRQDTIYHNKSLLFIPRELSGQKGSQTEASDSNLGGRFIDWQVATETFHDPGSVLV

SEQ ID NO: 4997 - DNA, 1888 bp, Artificial Sequence
  misc_feature (1)..(1888): useful for making plants with increased salt and oxidative stress tolerance as described in USSN 12/282,342
  misc_feature (1)..(1888): Ceres CDNA ID no. 23799376
  misc_feature (1)..(1888): Ceres Clone ID no. 375578
  misc_feature (1)..(1888): Ceres Seed Line ID no. ME02064
cccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagtgcggtgaagaaagtcttcagctcctccgatccagatggaaaggaagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaataacttgccgccaccaagattcagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactgaggcgagagagagcacttgcatatgcattttctcaccagtggaggaattctggtcgaactataacccctacttttacggaacctgggaaccccaactggggctggagctggatggagcgctggatgacagcaagaccatgggagagtcggttggcggcggcatcggacaaggaccctaaagaacgtgctgtgacaaagaatgcgagcaccagtgctgttcgagtacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttaaatgtactgatatgatagtatttgatttc

SEQ ID NO: 4998 - protein, 311 aa, Artificial Sequence; identical to SEQ ID NO: 3384
  misc_feature (1)..(311): useful for making plants with increased salt and oxidative stress tolerance as described in USSN 12/282,342
  misc_feature (1)..(311): Ceres CDNA ID no. 23799376
  misc_feature (1)..(311): Ceres Clone ID no. 375578
  misc_feature (1)..(311): Ceres Seed Line ID no. ME02064

SEQ ID NO: 4999 - protein, 500 aa, Oryza sativa subsp. japonica; identical to SEQ ID NO: 3391
  misc_feature (1)..(500): useful for making plants with increased salt and oxidative stress tolerance as described in USSN 12/282,342
  misc_feature (1)..(500): Public GI no. 56202321
  misc_feature (1)..(500): Functional Homolog of Ceres Clone ID no. 375578 at SEQ ID NO: 5151 with e-value of 2.59E-135 and BLAST sequence identity of 83.4
  misc_feature (142)..(162): Pfam Name: IQ Pfam Description: IQ calmodulin-binding motif

SEQ ID NO: 5000 - DNA, 1470 bp, Populus balsamifera subsp. trichocarpa; identical to SEQ ID NO: 3394
  misc_feature (1)..(1470): useful for making plants with increased salt and oxidative stress tolerance as described in USSN 12/282,342
  misc_feature (1)..(1470): Ceres ANNOT ID no. 1465047

SEQ ID NO: 5001 - protein, 489 aa, Populus balsamifera subsp. trichocarpa; identical to SEQ ID NO: 4327
  misc_feature (1)..(489): useful for making plants with increased salt and oxidative stress tolerance as described in USSN 12/282,342
  misc_feature (1)..(489): Ceres ANNOT ID no. 1465047
  misc_feature (1)..(489): Functional Homolog of Ceres Clone ID no. 375578 at SEQ ID NO: 5151 with e-value of 3.29E-71 and BLAST sequence identity of 56.8
  misc_feature (116)..(136): Pfam Name: IQ Pfam Description: IQ calmodulin-binding motif

SEQ ID NO: 5002 - protein, 367 aa, Glycine max
  misc_feature (1)..(367): useful for making plants with increased salt and oxidative stress tolerance as described in USSN 12/282,342
  misc_feature (1)..(367): Ceres CLONE ID no. 474985
  misc_feature (1)..(367): Functional Homolog of Ceres Clone ID no. 375578 at SEQ ID NO: 5151 with e-value of 1.39E-63 and BLAST sequence identity of 52.4
  misc_feature (11)..(31): Pfam Name: IQ Pfam Description: IQ calmodulin-binding motif
MPHYTGRTKEEIAAIKVQTAFRGYMARRALRALRGLVRLKTLVQGQSVKRQAASTLRSMQTLARLQSQIRERRIRMSEENQALQRQLHQKHEKELEKLRAAVGEEWDDSSQSKEQIEAKLLHRQEAALRRERALAYSFSHQQTWKGSSKSLNPTFMDPNNPQWGWSWLERWMATRPWDGHSTVVDHNDHASVKSAASRAVSVGQITKLYSLQDKKPSPFGSKARRPAPQSSHSKAPSTNGKARPSSSTKGSSVWGGDEDSRSMFSVQSERYRRHSIAGSSVRDDDSRASTPAIPSYMAATSSAKARSKIIRHSPEKKGGGGSVSARKRLSFSPSSAANSRRHSDPPKVEMVYNKDAAAATVSNGRGR

SEQ ID NO: 5003 - protein, 378 aa, Triticum aestivum; identical to SEQ ID NO: 3393
  misc_feature (1)..(378): useful for making plants with increased salt and oxidative stress tolerance as described in USSN 12/282,342
  misc_feature (1)..(378): Ceres CLONE ID no. 826796
  misc_feature (1)..(378): Functional Homolog of Ceres Clone ID no. 375578 at SEQ ID NO: 5151 with e-value of 5.20E-57 and BLAST sequence identity of 50.3
  misc_feature (4)..(24): Pfam Name: IQ Pfam Description: IQ calmodulin-binding motif

SEQ ID NO: 5004 - DNA, 1366 bp, Arabidopsis thaliana
  misc_feature (1)..(1366): useful for making plants with increased salt and oxidative stress tolerance as described in USSN 12/282,342
  misc_feature (1)..(1366): Ceres CDNA ID no. 23363195
  misc_feature (1)..(1366): Ceres Clone ID no. 105319
  misc_feature (1)..(1366): Ceres Seed Line ID no. ME04074
aaattgttgtcttttaggttttgacagtagcaaagaaaagctgaatctagttagaaattgcttttgcagggtttttgaatagtttgtgtattgaagattgtctgaaatggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaattgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaatttgtatcgaggccttcgagcaagttctgagctttctagagaaagaagaaactatggagatcccagacggcgacctctaatttcccagccttctgttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttgtttcagtatcatccttcttctcttttccttacaataagaattaaggaaaagtagccgtgtttgttaacatgggccaagaacaagcaaagtgatcattcaaatataaaagtagctttctcatggaat

SEQ ID NO: 5005 - protein, 303 aa, Arabidopsis thaliana
  misc_feature (1)..(303): useful for making plants with increased salt and oxidative stress tolerance as described in USSN 12/282,342
  misc_feature (1)..(303): Ceres CDNA ID no. 23363195
  misc_feature (1)..(303): Ceres Clone ID no. 105319
  misc_feature (1)..(303): Ceres Seed Line ID no. ME04074
  misc_feature (111)..(287): Pfam Name: SKI Pfam Description: Shikimate kinase
MEAAITQRIQYPSWVDCRKVECKPQRGSLRYSQQVKVDRRFRGLSLARLQPERRIDQRRAVSPAVSCSDNNSSALLETGSVYPFDEDILKRKAEEVKPYLNGRSMYLVGMMGSGKTTVGKLMSKVLGYTFFDCDTLIEQAMNGTSVAEIFVHHGENFFRGKETDALKKLSSRYQVVVSTGGGAVIRPINWKYMHKGISIWLDVPLEALAHRIAAVGTDSRPLLHDESGDAYSVAFKRLSAIWDERGEAYTNANARVSLENIAAKRGYKNVSDLTPTEICIEAFEQVLSFLEKEETMEIPDGDL

SEQ ID NO: 5006 - protein, 249 aa, Glycine max
  misc_feature (1)..(249): useful for making plants with increased salt and oxidative stress tolerance as described in USSN 12/282,342
  misc_feature (1)..(249): Ceres CLONE ID no. 463638
  misc_feature (1)..(249): Functional Homolog of  Ceres CLONE ID no. 105319 at SEQ ID NO: 5005 with e-value of 2.29E-79 and BLAST sequence identity of 66.6
  misc_feature (60)..(236): Pfam Name: SKI Pfam Description: Shikimate kinase
MMRRRTTALEVSCSYGNISASILESGSVRAPLDEELILKNRSQEIQPYLNGRCIYLVGMMGSGKTTVGKIMSQVLGYSFCDSDALVEEEVGGNSVADIFKQHGETFFRNKETEVLHKLSLMHQLVISTGGGAVTRPINWKYMHKGVSVWLDVPVEALAQRIAAVGTNSRPLLHYEAGDPYTRAFMRLSALFEERGEAYANANARVSLKNIAIKLGKRDVSELSPTDIAIEALEQIDNFLKGEGGRYAEC

SEQ ID NO: 5007 - DNA, 570 bp, Populus balsamifera subsp. trichocarpa
  misc_feature (1)..(570): useful for making plants with increased salt and oxidative stress tolerance as described in USSN 12/282,342
  misc_feature (1)..(570): Ceres ANNOT ID no. 1504048
atgatgggctctggaaaaacaacagtgggaaagattctctcgcaagcaattcattattcattctgtgacagtgacacattggtggagaaggatgttggtgtgacttctgtagctgaaatatttcaaatatatggagaggatttcttcagagataaagagactgaggcattagaaaagctatcactagagcaccgatatgtcgtttctactggtggaggtgctgtgatacaggatgaaaactggacgtacatgaggaaggggattagtgtctggttagatgtgcctttggaagaattggcacagaggattgcggctgtaggaaccaagactcgcccccttttggatagagaaccaggagatgcatacaccaaggcgttcaggcgtctgtctgctctgtttgaacagagatataaagcttatgaaaatgctaatgcaagggtttctctggaaaatattgcagccaaattaggatataaagatgtatccaatatcacaccacctatgattgcgattgagaacatggcttgggtgatgcattacgcagcaggtttccgtctattaccagtgtaa

SEQ ID NO: 5008 - protein, 188 aa, Populus balsamifera subsp. trichocarpa
  misc_feature (1)..(188): useful for making plants with increased salt and oxidative stress tolerance as described in USSN 12/282,342
  misc_feature (1)..(188): Ceres ANNOT ID no. 1504048
  misc_feature (1)..(188): Functional Homolog of  Ceres CLONE ID no. 105319 at SEQ ID NO: 5005 with e-value of 5.40E-55 and BLAST sequence identity of 64.2
  misc_feature (1)..(177): Pfam Name: SKI Pfam Description: Shikimate kinase
MGSGKTTVGKILSQAIHYSFCDSDTLVEKDVGVTSVAEIFQIYGEDFFRDKETEALEKLSLEHRYVVSTGGGAVIQDENWTYMRKGISVWLDVPLEELAQRIAAVGTKTRPLLDREPGDAYTKAFRRLSALFEQRYKAYENANARVSLENIAAKLGYKDVSNITPPMIAIENMAWVMHYAAGFRLLPV

SEQ ID NO: 5009 - protein, 189 aa, Zea mays
  misc_feature (1)..(189): useful for making plants with increased salt and oxidative stress tolerance as described in USSN 12/282,342
  misc_feature (1)..(189): Ceres CLONE ID no. 1565097
  misc_feature (1)..(189): Functional Homolog of  Ceres CLONE ID no. 105319 at SEQ ID NO: 5005 with e-value of 3.00E-29 and BLAST sequence identity of 64.0
  misc_feature (100)..(173): Pfam Name: SKI Pfam Description: Shikimate kinase
MEAGGVGLALQTRAAAFGSGQRRGGLQSPIGRLRVAEPAGAAVAVRARGSKPVVPLRAKKSSGGHENLHNSVDEALLLKRKSEEVLFYLNGRCIYLVGMMGSGKSTVGKIMSEVLGYSFFDSDKLVEQAVGMPSVAQIFKVHSEAFFRDNESSVLRDLSSMRRLVVATGGGAVIPTVNWYLEFTPFLSF

SEQ ID NO: 5010 - protein, 307 aa, Zea mays
  misc_feature (1)..(307): useful for making plants with increased salt and oxidative stress tolerance as described in USSN 12/282,342
  misc_feature (1)..(307): Ceres CLONE ID no. 486613
  misc_feature (1)..(307): Functional Homolog of  Ceres CLONE ID no. 105319 at SEQ ID NO: 5005 with e-value of 1.09E-63 and BLAST sequence identity of 63.0
  misc_feature (104)..(280): Pfam Name: SKI Pfam Description: Shikimate kinase
MEAGGIGLALQARAAGFGSGSGRRRGGLQAPTGSLRVADPAGPAVAVRARGSKPVAPLRLRAKKSSGGHENSHNSVDEALLLKRKSEEVLFYLNGRCIYLVGMMGSGKSTVGKIMSEVLGYSFFDSDKLVEQAVGMPSVAQIFKVHSEAFFRDNESSVLRDLSSMRRLVVATGGGAVIRPINWRYMKKGLSVWLDVPLDALARRIAKVGTASRPLLDQPSGDPYAMAFSKLSMLAQQRGDAYANADVRVSLEEIACKQGHDDVSKLTPTDIAIESLHKIESFVIEHTADSSASDAQTESQIQRIQTL

SEQ ID NO: 5011 - protein, 295 aa, Triticum aestivum
  misc_feature (1)..(295): useful for making plants with increased salt and oxidative stress tolerance as described in USSN 12/282,342
  misc_feature (1)..(295): Ceres CLONE ID no. 749796
  misc_feature (1)..(295): Functional Homolog of  Ceres CLONE ID no. 105319 at SEQ ID NO: 5005 with e-value of 7.79E-67 and BLAST sequence identity of 62.5
  misc_feature (108)..(284): Pfam Name: SKI Pfam Description: Shikimate kinase
MDAGVGLRPRPRAAWAGRRKPQGFPPATVPAVRLDQNPARRPLVLRSDAGSRSTDPIRGASLKGLCCHKSAGTEKVHYSADEALVLKQKAEDVLPYLNDRCVYLVGMMGSGKTTVGKIIAEVLGYSFFDSDKLVEQSVGIPSVAEIFQVHSEAFFRDNESEVLRDLSSMHRLIVATGGGAVIRPINWSYMKKGLTIWLDVPLDALARRIAAVGTASRPLLHQESGDPYAKAYAKLTALFEQRMDSYANADARVSLENIALKQGHNDVNVLTPSTIAIEALLKMESFLTEKAMVRN

SEQ ID NO: 5012 - protein, 308 aa, Oryza sativa subsp. japonica
  misc_feature (1)..(308): useful for making plants with increased salt and oxidative stress tolerance as described in USSN 12/282,342
  misc_feature (1)..(308): Public GI no. 56805577
  misc_feature (1)..(308): Functional Homolog of  Ceres CLONE ID no. 105319 at SEQ ID NO: 5005 with e-value of 5.09E-66 and BLAST sequence identity of 62.1
  misc_feature (105)..(281): Pfam Name: SKI Pfam Description: Shikimate kinase
MEAGVGLALQSRAAGFGGSDRRRSALYGGEGRARIGSLRVAEPAVAKAAVWARGSKPVAPLRAKKSSGGHETLHNSVDEALLLKRKSEEVLFYLNGRCIYLVGMMGSGKSTVGKIMSEVLGYSFFDSDKLVEQAVGMPSVAQIFKVHSEAFFRDNESSVLRDLSSMKRLVVATGGGAVIRPVNWKYMKKGLSVWLDVPLDALARRIAKVGTASRPLLDQPSGDPYTMAFSKLSMLAEQRGDAYANADVRVSLEEIASKQGHDDVSKLTPTDIAIESFHKIENFVIEHTVDNPVGDSQADSRAQRIQTL

SEQ ID NO: 5013 - protein, 189 aa, Zea mays
  misc_feature (1)..(189): useful for making plants with increased salt and oxidative stress tolerance as described in USSN 12/282,342
  misc_feature (1)..(189): Ceres CLONE ID no. 294723
  misc_feature (1)..(189): Functional Homolog of  Ceres CLONE ID no. 105319 at SEQ ID NO: 5005 with e-value of 4.69E-56 and BLAST sequence identity of 61.2
  misc_feature (2)..(178): Pfam Name: SKI Pfam Description: Shikimate kinase
MMGSGKTTVGKILSEVLGYSFFDSDKLVEKAVGISSVAEIFQLHSETFFRDNESEVLTDLSSMHRLVVATGGGAVIRPINWSYMKKGLTVWLDVPLDALARRIAAVGTASRPLLHQESGDPYAKAYAKLTSLFEQRMDSYANADARVSLEHIALKQGHNDVTILTPSTIAIEALLKMESFLTEKTMVRN

SEQ ID NO: 5014 - protein, 302 aa, Fagus sylvatica
  misc_feature (1)..(302): useful for making plants with increased salt and oxidative stress tolerance as described in USSN 12/282,342
  misc_feature (1)..(302): Public GI no. 76782196
  misc_feature (1)..(302): Functional Homolog of  Ceres CLONE ID no. 105319 at SEQ ID NO: 5005 with e-value of 3.70E-79 and BLAST sequence identity of 61.0
  misc_feature (114)..(290): Pfam Name: SKI Pfam Description: Shikimate kinase
MDGKVANGLVVSPRIGSERFARRTCGSVRVSRRFREQDRLPVLVSAQLQDKTRNSNWHKTASLEVSCSYKNFPASVLESGGIHAPFDDALILKNKSQEIEPYLSGRCIYLVGMMGSGKTTVGKVLSQVLSYAFFDSDTLVEQDVDANSVAEIFNLYGEGFFRDKETEVLRKLSLMHRLVVSTGGGAVVRPINWKYMQKGISVWLDVPLEALARRIAAVGTGSRPLLHHDSGDAYTKTFMRLTSLMEERSEAYANANARVSLEDVAAKLGHRDVSNLTPTAIAIEALEQIEGFLKEENGDFAL

SEQ ID NO: 5015 - protein, 189 aa, Zea mays
  misc_feature (1)..(189): useful for making plants with increased salt and oxidative stress tolerance as described in USSN 12/282,342
  misc_feature (1)..(189): Ceres CLONE ID no. 1374869
  misc_feature (1)..(189): Functional Homolog of  Ceres CLONE ID no. 105319 at SEQ ID NO: 5005 with e-value of 4.69E-56 and BLAST sequence identity of 60.7
  misc_feature (2)..(178): Pfam Name: SKI Pfam Description: Shikimate kinase
MMGSGRTTVGKILSEVLGYSFFDSDKLVEKAVGISSVAEIFQLHSETFFRDNESEVLRDLSSMHRLVVATGGGAVIRPINWSYMKKGLTVWLDVPLDALARRIAAVGTASRPLLHQESGDPYAKAYAKLTSLFEQRMDSYANADARVSLEHIALKQGHNDVTILTPSTIAIEALLKMESFLTEKTMVRN

SEQ ID NO: 5016 - protein, 307 aa, Oryza sativa subsp. japonica
  misc_feature (1)..(307): useful for making plants with increased salt and oxidative stress tolerance as described in USSN 12/282,342
  misc_feature (1)..(307): Public GI no. 56805579
  misc_feature (1)..(307): Functional Homolog of  Ceres CLONE ID no. 105319 at SEQ ID NO: 5005 with e-value of 4.59E-65 and BLAST sequence identity of 60.6
  misc_feature (103)..(279): Pfam Name: SKI Pfam Description: Shikimate kinase
MEARAGLAMQSRAAVGVGAGPGVGRRGRAVIRVGKRPTAASLRVGGPAGPAAAKPLAPLYCLKASRGHDSLHNSVDEALLLKRKSEEVLFYLNGRCIYLVGMMGSGKSTVAKILAEVLGYSFFDSDKLVEQAVGMPSVAQIFKEHSEAFFRDNESSVLRDLSSMRRLVVATGGGAVIRPVNWKYMKKGLSVWLDVPLDALARRIAQVGTASRPLLDQPSSDPYTAAFSKLSMLAEQRGDAYANADARVSLEEIAAKQGHDDVSKLTPTDIAIEALLKIENFVTEHSTSSGPVGDLIVDSQNRRTKAL

SEQ ID NO: 5017 - protein, 205 aa, Zea mays
  misc_feature (1)..(205): useful for making plants with increased salt and oxidative stress tolerance as described in USSN 12/282,342
  misc_feature (1)..(205): Ceres CLONE ID no. 276706
  misc_feature (1)..(205): Functional Homolog of  Ceres CLONE ID no. 105319 at SEQ ID NO: 5005 with e-value of 2.60E-55 and BLAST sequence identity of 59.3
  misc_feature (2)..(178): Pfam Name: SKI Pfam Description: Shikimate kinase
MMGSGKSTVGKIMSEVLGYSFFDSDKLVEQAVGMPSVAQIFKVHSEAFFRDNESSVLRDLSSMRRLVVATGGGAVIRPVNWKYMKKGLSVWLDVPLDALARRIAKVGTASRPLLDQPSGDPYTMAFSKLSMLAEQRGDAYANADVRVSLEEIASKQGHGDVSKLMPTDIAIESLHKIESFVIEHAADNPASDSQAESQIQRIQTL

SEQ ID NO: 5018 - protein, 305 aa, Triticum aestivum
  misc_feature (1)..(305): useful for making plants with increased salt and oxidative stress tolerance as described in USSN 12/282,342
  misc_feature (1)..(305): Ceres CLONE ID no. 840744
  misc_feature (1)..(305): Functional Homolog of  Ceres CLONE ID no. 105319 at SEQ ID NO: 5005 with e-value of 2.99E-61 and BLAST sequence identity of 59.3
  misc_feature (105)..(281): Pfam Name: SKI Pfam Description: Shikimate kinase
MEAGVGLALQSRAAGFGSGRRRSSMYGGESGARVVSLRVSDLVGSPAAVRARGAKPVVPLRAKKSSGGGHENLHNSVDDALLLKRKSEEVLFQLNGRCIYLVGMMGSGKSTVGKILAEVLGYSFFDSDKLVEQAVGMPSVAQIFKVHSEAFFRDNESSVLRDLSSMRRLVVATGGGAVIRPVNWKNMKKGLSVWLDVPLEALARRIAKVGTASRPLLDQPSGDPYTMAFSKLSTLAEQRGDAYANADVRVSLEEIASKLGHDDVSKLTPIDIALESLHKIESFVVEDTAVADSQTESQAQRIHTL

SEQ ID NO: 5019 - DNA, 936 bp, Populus balsamifera subsp. trichocarpa
  misc_feature (1)..(936): useful for making plants with increased salt and oxidative stress tolerance as described in USSN 12/282,342
  misc_feature (1)..(936): Ceres ANNOT ID no. 1456544
atggaggcaaatcttgcacaaagaatgcaaatttcgacaacatggattgattcatacaagtttccaagaaaaccaactagttccctgcggttttcggggagatttaaggaacagaagagactccaagtgtttgtttctgctcagtttcggcctgtaagagatgaaaatcgacatagacaggcttcttttgaggtttcttgttcttgtaacaattctcaagtttcaacgttggaatctgaaagtctccaggatttgtttggcgaggaagctttgattttgaagaataagtcacaagagattgagccatatttaaatggacgctgtatatatcttgttgggatgatgggctctggaaaaactacagtgggaaagattctctcacgatcaattcgttattcattctgtgactgtgacaaactggtggagcaggatgttggtgtgccttctgtagctgaaatatttgaaatatatggagaggatttcttcagagataaagagactgaggcattagaaaagctatcaatagaacaccggtttgttgtttccactggtggcggtgctgtgatacgggatgaaaactggatatacatgaggaaggggattagtgtctggttagatgtgcctttggaagaattggcacagaggatcgcggctgtaggaaccaagtctcgcccccttttggataatgaatcaggagatgcatacaacactgcattcagacgcctttctactctgtttgagaagagacataaagcttatgaaaatgccaaggcgagggtttctctggaaaatattgcagccaaactaggatataaagatgtatccagtatcacacctgctatgattgcgattgagcagaacatggcttgtgtgatgcatgatgtggaaggtttccatttattaccagcaggatttgggatgcgaaagatgtgttag

SEQ ID NO: 5020 - protein, 303 aa, Populus balsamifera subsp. trichocarpa
  misc_feature (1)..(303): useful for making plants with increased salt and oxidative stress tolerance as described in USSN 12/282,342
  misc_feature (1)..(303): Ceres ANNOT ID no. 1456544
  misc_feature (1)..(303): Functional Homolog of  Ceres CLONE ID no. 105319 at SEQ ID NO: 5005 with e-value of 4.50E-74 and BLAST sequence identity of 59.3
  misc_feature (107)..(283): Pfam Name: SKI Pfam Description: Shikimate kinase
MQISTTWIDSYKFPRKPTSSLRFSGRFKEQKRLQVFVSAQFRPVRDENRHRQASFEVSCSCNNSQVSTLESESLQDLFGEEALILKNKSQEIEPYLNGRCIYLVGMMGSGKTTVGKILSRSIRYSFCDCDKLVEQDVGVPSVAEIFEIYGEDFFRDKETEALEKLSIEHRFVVSTGGGAVIRDENWIYMRKGISVWLDVPLEELAQRIAAVGTKSRPLLDNESGDAYNTAFRRLSTLFEKRHKAYENAKARVSLENIAAKLGYKDVSSITPAMIAIEQNMACVMHDVEGFHLLPAGFGMRKMC

SEQ ID NO: 5021 - DNA, 655 bp, Arabidopsis thaliana
  misc_feature (1)..(655): useful for making plants with increased salt and oxidative stress tolerance as described in USSN 12/282,342
  misc_feature (1)..(655): Ceres CLONE ID no. 29658
  misc_feature (1)..(655): Predicted sequence
attcatctccaaactttcaaaaaaaaacctaaaacaaaaaaaatctctttccttcttctttctccatcaatggcgtcaacaaaacccaccgatcaaatcaaacaactcaaagatatcttcgctcgcttcgacatggacaaggacggaagcttaacgcagctagaactcgccgctcttctgcgttctctcggaatcaaacctcgcggcgatcaaatctctcttctgtaaaaccaaatcgaccgtaacggtaacggatccgtagagttcgacgagctcgtcgtggcgatattgccggatataaacgaagaggtgttgataaatcaagaacagttgatggaggttttccgttcgtttgatcgtgacggtaacggttcaataacggcggcggaacttgctgggtcaatggctaaaatgggacatccgttgacttaccgtgaattaacggaaatgatgacggaagctgattcaaacggtgacggtgttattagttttaatgagttttctcatattatggctaaatcggctgctgattttcttggattaaccgcttcttgatctgttttgttttaattactctctttttttcttctcctgtcaatgcaacttgtgcaattaacaatgtgctaatctttcgtttggtgtgacgtaaaaattt

SEQ ID NO: 5022 - protein, 161 aa, Arabidopsis thaliana
  misc_feature (1)..(161): useful for making plants with increased salt and oxidative stress tolerance as described in USSN 12/282,342
  misc_feature (1)..(161): Ceres CLONE ID no. 29658
  misc_feature (1)..(161): Ceres ANNOT ID no. 842118
  misc_feature (1)..(161): Phenotype: ROSETTE LEAVES Useful for making ornamental plants with modified leaves
  misc_feature (48)..(76): Pfam Name: efhand Pfam Description: EF hand
  misc_feature (1)..(161): Full Length Peptide Sequence for Ceres CLONE ID no. 29658
MASTKPTDQIKQLKDIFARFDMDKDGSLTQLELAALLRSLGIKPRSDQISLLLNQIDRNGNGSVEFDELVVAILPDINEEVLINQEQLMEVFRSFDRDGNGSITAAELAGSMAKMGHPLTYRELTEMMTEADSNGDGVISFNEFSHIMAKSAADFLGLTAS

SEQ ID NO: 5023 - DNA, 483 bp, Populus balsamifera subsp. trichocarpa
  misc_feature (1)..(483): useful for making plants with increased salt and oxidative stress tolerance as described in USSN 12/282,342
  misc_feature (1)..(483): Ceres ANNOT ID no. 1464081
  misc_feature (1)..(483): Encodes the peptide sequence given in SEQ ID NO. 125
atggcaacccttcagaccgatcagctcaagcagctcaaggacatcttcattcgcttcgacatggattccgatggcagcctcacgcagctggagctcgctgcgcttctacgttctcttggcctcaaacctacaggtgatcaacttcatgttctgttatcaaacatggatgctaatggaaatggttatgttgagtttgatgagctggtcagtgctatattgcctgatatgaatgaagaagtattgatcaaccaggagcagttgttggaggtttttcgatcatttgacagggatggcaatggattcattactgctgctgagcttgcaggatcaatggctaaaatgggacaccctttgacgtatcgtgagctatcagatatgatgagagaggctgacaccaatggagatggtgttttgagttttaatgagtttgcaaacgtcatggcaaaatctgctgctgattttcttggcatcaaagttccatag

SEQ ID NO: 5024 - protein, 140 aa, Populus balsamifera subsp. trichocarpa
  misc_feature (1)..(140): useful for making plants with increased salt and oxidative stress tolerance as described in USSN 12/282,342
  misc_feature (1)..(140): Ceres ANNOT ID no. 1464081
  misc_feature (1)..(140): Functional Homolog of  Ceres CLONE ID no. 29658 at SEQ ID NO: 5022 with e-value of 4.20E-55 and BLAST sequence identity of 81.7
  misc_feature (27)..(55): Pfam Name: efhand Pfam Description: EF hand
MDSDGSLTQLELAALLRSLGLKPTGDQLHVLLSNMDANGNGYVEFDELVSAILPDMNEEVLINQEQLLEVFRSFDRDGNGFITAAELAGSMAKMGHPLTYRELSDMMREADTNGDGVLSFNEFANVMAKSAADFLGIKVP

SEQ ID NO: 5025 - protein, 158 aa, Glycine max
  misc_feature (1)..(158): useful for making plants with increased salt and oxidative stress tolerance as described in USSN 12/282,342
  misc_feature (1)..(158): Ceres CLONE ID no. 651548
  misc_feature (1)..(158): Functional Homolog of  Ceres CLONE ID no. 29658 at SEQ ID NO: 5022 with e-value of 2.80E-58 and BLAST sequence identity of 78.9
  misc_feature (120)..(148): Pfam Name: efhand Pfam Description: EF hand
MLETDQIKQLNDIFKRFDMDQDGSLTHLELAALLRSLGIKPTGDEIYALLSNMDENGNGYIEFDELVHAIMPDLTESVLINQEQLLEVFRSFDRDGNGYITASELAGSMAKMGQPLTYRELASMMAEADSNGDGVISFNEFAALMAKSAAEFLGVKVA

SEQ ID NO: 5026 - protein, 173 aa, Oryza sativa subsp. japonica
  misc_feature (1)..(173): useful for making plants with increased salt and oxidative stress tolerance as described in USSN 12/282,342
  misc_feature (1)..(173): Public GI no. 50932815
  misc_feature (1)..(173): Functional Homolog of  Ceres CLONE ID no. 29658 at SEQ ID NO: 5022 with e-value of 4.80E-47 and BLAST sequence identity of 65.3
  misc_feature (61)..(89): Pfam Name: efhand Pfam Description: EF hand
MTTMAARRSEAAPAPQQLRGSQLKQLRELFRRFDMNGDGSLTQLELAALLRSLGLRPTGDEVHALLAGMDANGNGSVEFDELAAAIAPVLTTQTHLVDQAQLLEVFRAFDRDGNGFISAAELARSMARLGQPLTFEELTRMMRDADTDGDGVISFKEFAAVMAKSALDFLGVA

SEQ ID NO: 5027 - protein, 172 aa, Zea mays
  misc_feature (1)..(172): useful for making plants with increased salt and oxidative stress tolerance as described in USSN 12/282,342
  misc_feature (1)..(172): Ceres CLONE ID no. 287120
  misc_feature (1)..(172): Functional Homolog of  Ceres CLONE ID no. 29658 at SEQ ID NO: 5022 with e-value of 1.49E-45 and BLAST sequence identity of 64.0
  misc_feature (60)..(88): Pfam Name: efhand Pfam Description: EF hand
MTRSAPPASPPAPKPVLRGSQLEQLREIFRRFDMDGDGSLTQLELGALLRSLGLRPTGEEARALLAAMDSNGNGAVEFGELAAAIAPLLTTQTHLVDQAQLLEVFRAFDRDGNGYISAAELARSMARIGQPLTFEELTRMMRDADADGDGVISFNEFAAVMAKSALDFLGVA

SEQ ID NO: 5028 - protein, 177 aa, Triticum aestivum
  misc_feature (1)..(177): useful for making plants with increased salt and oxidative stress tolerance as described in USSN 12/282,342
  misc_feature (1)..(177): Ceres CLONE ID no. 759217
  misc_feature (1)..(177): Functional Homolog of  Ceres CLONE ID no. 29658 at SEQ ID NO: 5022 with e-value of 1.29E-44 and BLAST sequence identity of 63.3
  misc_feature (62)..(90): Pfam Name: efhand Pfam Description: EF hand
MTKPSPSPSPAPAKGAGSLRGSQLKQLRSLFDRFDMDGDGSLTQLELAALLRSLGLRPTGDESRALLLAIDADGSGTVEFDELARAIAPVLTAHAPRLVDQAQLLEVFRAFDRDGNGYISAAELARSMAKLGQPLTFEELRTMMRDADADGDGVISFGEFAAVMARSALDFLGVPAA

SEQ ID NO: 5029 - protein, 149 aa, Malus x domestica
  misc_feature (1)..(149): useful for making plants with increased salt and oxidative stress tolerance as described in USSN 12/282,342
  misc_feature (1)..(149): Public GI no. 505152
  misc_feature (1)..(149): Functional Homolog of  Ceres CLONE ID no. 29658 at SEQ ID NO: 5022 with e-value of 2.29E-24 and BLAST sequence identity of 43.3
  misc_feature (12)..(40): Pfam Name: efhand Pfam Description: EF hand
MADQLTDDQISEFKEAFSLFDKDGDGCITTKELGTVMRSLGQNPTEAELQDMINEVDADGNGTIDFPEPLNLMARKMKDTDSEEELKEAFRVFDKDQNGFISAAELRHVMTNLGEKLTDEEVDEMIREADVDGDGQINYEEFVKVMMAK

SEQ ID NO: 5030 - DNA, 679 bp, Arabidopsis thaliana
  misc_feature (1)..(679): useful for making plants with increased salt and oxidative stress tolerance as described in USSN 12/282,342
  misc_feature (1)..(679): Ceres CLONE ID no. 2767
  misc_feature (1)..(679): Ceres Seed Line ID no. ME00774
agaagctagaagaagaaaggagaagaagaaacaaagagagaagatgaagaatgttatgctgattattgacgagagcaacgcaagttatgatttactcatttgggcacttgaaaaccaaaaagataccattgagagctccaaagtttatatctttgcaaaacagccacaaaattcctttactcctcctaccgtactttcttcatcagtcggctttgctcaaattttctatccattttcacctaattcagaactcataagattggctcaagaaaagaatatgaaaattgctttgggtatattagagaaagccaagaagatatgtttaaatcatgggatcaaggcagagacatttactaatgttggagaccctaaagatctaatccgcaagataattcaagaacgaaatatcaatttaatagttacgagcgatcaacaaagtctcaaaaagtgtacacaaaatacagattgttctcttcttgtcgtgaagaaaagacttcgcaaagattaaagattaaggaagttacaaaattcaccaatatatataattttctatgtggttaattgagattgtgtaatgatttggggttgtagtttcaggtgttgatttggggttgtagtttgaacttataattgtgttatgtgtataaatatttgtgtttatatatatcaagttagtatg

SEQ ID NO: 5031 - protein, 154 aa, Arabidopsis thaliana
  misc_feature (1)..(154): useful for making plants with increased salt and oxidative stress tolerance as described in USSN 12/282,342
  misc_feature (1)..(154): Ceres CLONE ID no. 2767
  misc_feature (1)..(154): Ceres Seed Line ID no. ME00774
  misc_feature (1)..(148): Pfam Name: Usp Pfam Description: Universal stress protein family
MKNVMLIIDESNASYDLLIWALENQKDTIESSKVYIFAKQPQNSFTPPTVLSSSVGFAQIFYPFSPNSELIRLAQEKNMKIALGILEKAKKICLNHGIKAETFTNVGDPKDLIRKIIQERNINLIVTSDQQSLKKCTQNTDCSLLVVKKRLRKD

SEQ ID NO: 5032 - DNA, 597 bp, Populus balsamifera subsp. trichocarpa
  misc_feature (1)..(597): useful for making plants with increased salt and oxidative stress tolerance as described in USSN 12/282,342
  misc_feature (1)..(597): Ceres ANNOT ID no. 1486744
atggagaaacaaatagaagggtctaagaagagggtgatggtgatcatagatgagagcgagtacagttatcattccttcatgtgggtagttgacaatctcaaagaatttatcactgagtcgccgcttgtcatccttgctgcacttcctgctcctaactgtaaatttttttatggggcacagtttggcaccgctgccctctgttgtccagtctctcccaccctagatttgatctgtgccattcaagaaaaaaacaagaagatcttattaggtatcttggagaaagctgtgaatatctgtgctagtcgaggggtgaaagcagaaacaattttagaagccggggagccttatgaactcacatgcaatgctgttcagaagaacaatattaatctcctcgtgattggtaacacatccattaatggaactctcaaaaggttaggaaatttctttgtaacttcaaaaatcatttcgacagctctcgaaagtcgcataaattgtatgaacctgattcaaaatgagttatttcaagaacttgaacatgctggcatggttgtcaaccctattaactcttgcaacaagctccactaccagaagcactga

SEQ ID NO: 5033 - protein, 186 aa, Populus balsamifera subsp. trichocarpa
  misc_feature (1)..(186): useful for making plants with increased salt and oxidative stress tolerance as described in USSN 12/282,342
  misc_feature (1)..(186): Ceres ANNOT ID no. 1486744
  misc_feature (1)..(186): Functional Homolog of  Ceres CLONE ID no. 2767 at SEQ ID NO: 5031 with e-value of 1.90E-18 and BLAST sequence identity of 43.4
MVIIDESEYSYHSFMWVVDNLKEFITESPLVILAALPAPNCKFFYGAQFGTAALCCPVSPTLDLICAIQEKNKKILLGILEKAVNICASRGVKAETILEAGEPYELTCNAVQKNNINLLVIGNTSINGTLKRLGNFFVTSKIISTALESRINCMNLIQNELFQELEHAGMVVNPINSCNKLHYQKH

SEQ ID NO: 5034 - DNA, 540 bp, Populus balsamifera subsp. trichocarpa
  misc_feature (1)..(540): useful for making plants with increased salt and oxidative stress tolerance as described in USSN 12/282,342
  misc_feature (1)..(540): Ceres ANNOT ID no. 1463968
atggagaaacaaatagaagggtctaatcagaaggtgatggtgatcatagatgagagtgagtgcagttatcatgcactcatgtgggtgcttgaaaatctcaaaggattcattactgactcaccgcttgtcatgtttgctgcactacctactcctaactgtaactttgcatatggggcacaacttggcaccactgcgttgtattgtacagtctcacccaccctaggtttgatttgttccatgcaagaaaaaagcaagaaaatcttattgggtgtcttggagaaagctgtggatatctgtgatagtcgaggggtgaaagcagagacaatcacagaagctggggagccttatgagctcataagcagtgctgttcaaaagaacaagattaatctactagtgatcggtgacacactcgttaatggaacccttaaaagtcacatgtctcttgatactggaatggttacagtgacgttaacctgttacccaaaacctcatcctactcaaaatatagattatcattcagatgggtaccaatacaaatga

SEQ ID NO: 5035 - protein, 167 aa, Populus balsamifera subsp. trichocarpa
  misc_feature (1)..(167): useful for making plants with increased salt and oxidative stress tolerance as described in USSN 12/282,342
  misc_feature (1)..(167): Ceres ANNOT ID no. 1463968
  misc_feature (1)..(167): Functional Homolog of  Ceres CLONE ID no. 2767 at SEQ ID NO: 5031 with e-value of 7.09E-19 and BLAST sequence identity of 43.0
MVIIDESECSYHALMWVLENLKGFITDSPLVMFAALPTPNCNFAYGAQLGTTALYCTVSPTLGLICSMQEKSKKILLGVLEKAVDICDSRGVKAETITEAGEPYELISSAVQKNKINLLVIGDTLVNGTLKSHMSLDTGMVTVTLTCYPKPHPTQNIDYHSDGYQYK

SEQ ID NO: 5036 - DNA, 447 bp, Populus balsamifera subsp. trichocarpa
  misc_feature (1)..(447): useful for making plants with increased salt and oxidative stress tolerance as described in USSN 12/282,342
  misc_feature (1)..(447): Ceres ANNOT ID no. 1517263
atggagaaacaaatagaagggtctaatcagaaggtgatggtgatcatagatgagagtgagtgcagttatcatgcactcatgtgggtgcttgaaaatctcaaaggattcattactgactcaccgcttgtcatgtttgctgcactacctactcctaactgtaactttgcatatggggcacaacttggcaccactgcgttgtattgtacagtctcacccaccctaggtttgatttgttccatgcaagaaaaaagcaagaaaatcttattgggtgtcttggagaaagctgtggatatctgtgatagtcgaggggtgaaagcagagacaatcacagaagctggggagccttatgagctcataagcagtgctgttcaaaagaacaagattaatctactagtgatcggtgacacactcgttaatggaacccttaaaagttcccgaccccactag

SEQ ID NO: 5037 - protein, 136 aa, Populus balsamifera subsp. trichocarpa
  misc_feature (1)..(136): useful for making plants with increased salt and oxidative stress tolerance as described in USSN 12/282,342
  misc_feature (1)..(136): Ceres ANNOT ID no. 1517263
  misc_feature (1)..(136): Functional Homolog of  Ceres CLONE ID no. 2767 at SEQ ID NO: 5031 with e-value of 7.09E-19 and BLAST sequence identity of 43.0
MVIIDESECSYHALMWVLENLKGFITDSPLVMFAALPTPNCNFAYGAQLGTTALYCTVSPTLGLICSMQEKSKKILLGVLEKAVDICDSRGVKAETITEAGEPYELISSAVQKNKINLLVIGDTLVNGTLKSSRPH

SEQ ID NO: 5038 - protein, 162 aa, Triticum aestivum
  misc_feature (1)..(162): useful for making plants with increased salt and oxidative stress tolerance as described in USSN 12/282,342
  misc_feature (1)..(162): Ceres CLONE ID no. 684584
  misc_feature (1)..(162): Functional Homolog of  Ceres CLONE ID no. 2767 at SEQ ID NO: 5031 with e-value of 2.29E-13 and BLAST sequence identity of 37.6
  misc_feature (11)..(159): Pfam Name: Usp Pfam Description: Universal stress protein family
MAAQAPPPPPPEQKMMVAIDESECSHYALEWALRNLAPRRLILFTVQPFSPLSYLPVGSPLGPSVASPELIRSVTEHQRQLAQALVDKAKAICAEHGVDAETVIEVGDPKETICEAAEKLNVDLLILGSHSRGPVQRFFLGSVSNYCSHHAKCPVLVVKKKE

SEQ ID NO: 5039 - DNA, 468 bp, Populus balsamifera subsp. trichocarpa
  misc_feature (1)..(468): useful for making plants with increased salt and oxidative stress tolerance as described in USSN 12/282,342
  misc_feature (1)..(468): Ceres ANNOT ID no. 1463969
atggcggagcacgtgacggaaaatggaggggtaccacttgagaggaaagtgatggttgccgttgatgatggtgagtatagccactatgctctcatgtgggtacttgacaatcttgaggaatctatcactaaatcacctctagttatcttcaccgcacagcctcctcccagcaataaccattcttttactgccgctgctctcagttctgctcgcatgtactgctcggtttcagccaatccggagtatacttacactatccaagaccagaataagaagatcgcgtttgctttgctggagaaagctaaagaaatttgtgctggtcgaggagttgatgctgagacattaacagaggtgggtgatcctcaaacagccatatgcgatgcagttcaaaggctcaatattagcctgcttgttttaggggagcgcggcattggcaaaatcaaaaggtgggatgatggcgcaagttaa

SEQ ID NO: 5040 - protein, 138 aa, Populus balsamifera subsp. trichocarpa
  misc_feature (1)..(138): useful for making plants with increased salt and oxidative stress tolerance as described in USSN 12/282,342
  misc_feature (1)..(138): Ceres ANNOT ID no. 1463969
  misc_feature (1)..(138): Functional Homolog of  Ceres CLONE ID no. 2767 at SEQ ID NO: 5031 with e-value of 1.19E-16 and BLAST sequence identity of 36.0
  misc_feature (1)..(136): Pfam Name: Usp Pfam Description: Universal stress protein family
MVAVDDGEYSHYALMWVLDNLEESITKSPLVIFTAQPPPSNNHSFTAAALSSARMYCSVSANPEYTYTIQDQNKKIAFALLEKAKEICAGRGVDAETLTEVGDPQTAICDAVQRLNISLLVLGERGIGKIKRWDDGAS

SEQ ID NO: 5041 - protein, 148 aa, Glycine max
  misc_feature (1)..(148): useful for making plants with increased salt and oxidative stress tolerance as described in USSN 12/282,342
  misc_feature (1)..(148): Ceres CLONE ID no. 1059727
  misc_feature (1)..(148): Functional Homolog of  Ceres CLONE ID no. 2767 at SEQ ID NO: 5031 with e-value of 1.90E-9 and BLAST sequence identity of 31.6
  misc_feature (1)..(145): Pfam Name: Usp Pfam Description: Universal stress protein family
MVAIDDSDCSKHALRWTLSYLKDSLADSDIILFTAQPQLDLSSVYASSYGAAPIELINSMQQNYKNAALNRIEEGTKICAESGVTPKKVMEFGNPKEAICDAVEKLGVDLLIVGSHGKGALERTFLGSVSNYCVNKAKCPVLVVRTKA

SEQ ID NO: 5042 - protein, 165 aa, Zea mays
  misc_feature (1)..(165): useful for making plants with increased salt and oxidative stress tolerance as described in USSN 12/282,342
  misc_feature (1)..(165): Ceres CLONE ID no. 1272732
  misc_feature (1)..(165): Functional Homolog of  Ceres CLONE ID no. 2767 at SEQ ID NO: 5031 with e-value of 2.29E-6 and BLAST sequence identity of 27.7
  misc_feature (12)..(161): Pfam Name: Usp Pfam Description: Universal stress protein family
METAAVAASSAGRRIMVAVDEGEESLHALNWCLANVVSPAGGDTLVLVHARRPRPVYAAMDSAGYMMTSDVLASVERHANAVSAAAVDKAKRVCADHPHVKVETTVESGDPRDVICDAANKMAADLLVMGSHGYGFIQRAFLGSVSNHCAQNCKCPVLIVKRPKE

SEQ ID NO: 5043 - protein, 145 aa, Zea mays
  misc_feature (1)..(145): useful for making plants with increased salt and oxidative stress tolerance as described in USSN 12/282,342
  misc_feature (1)..(145): Ceres CLONE ID no. 283925
  misc_feature (1)..(145): Functional Homolog of  Ceres CLONE ID no. 2767 at SEQ ID NO: 5031 with e-value of 2.29E-6 and BLAST sequence identity of 27.6
  misc_feature (1)..(141): Pfam Name: Usp Pfam Description: Universal stress protein family
MVAVDEGEESLHALNWCLANVVSPAGGDTLVLVHARRPRPVYAAMDSAGYMMTSDVLASVERHANAVSAAAVDKAKRVCADHPHVKVETMVESGDPRDVICDAANKMAVGSHGYGFIQRAFLGSVSNHCAQNCKCPVLIVKRPKE

SEQ ID NO: 5044 - DNA, 901 bp, Arabidopsis thaliana
  misc_feature (1)..(901): useful for making plants with increased salt and oxidative stress tolerance as described in USSN 12/282,342
  misc_feature (1)..(901): Ceres CLONE ID no. 16403
  misc_feature (1)..(901): Ceres Seed Line ID no. ME01468
gtcttgtgaattgtagccactatggcagtctcctcactctcaatccgctgtggtggtttctcaccaacaatctcccacaagacagaaattctctgtccaaatccatcactcaaagcttgttgtttactttcatccggtggtaaggccgactcctcggagagtacttaccaaaaaggcagcggaaacaattggaagagaaggcaagctcttgtgggagtaggaactttagtggcaacttcaattccagcaactttgcttcttgctgaagagataccaaaaagctactcgccttttgtggatcgagaagacgggtattcttactattacccatcagactggagggaatttgacttcagggcacatgattcagccttcaaagatagatacttgcaactgcagaatgtgcgggtcaggttcataccaacggagaaaaacgacatccatgaagtaggtcctatggaagaggtggtttatgatctagtgaagcataagtttgcagcaccaaaccaagtagctaccatctacgatatgaaagagagggtggaagatggaaagaactattacacgtttgagtatggactaagaactcctatctatgcaaccacttcctttgcaacagtggcagttggaaacaacagatactacactctcatagttggagcaaatgagagaaggtggaggaaagtgaaaaagcagcttcaagttgtggccgactctttgaagatccttcagatttgacaaacacaagaaacatcttactcctatatatctttctctctctgtggttacaaaactgtctgtagataacaatttgatattttcatattctctataactccaacgatggttttggcattgtgagttagattctgagttggttcagtaattcaatcaaacttgc

SEQ ID NO: 5045 - protein, 238 aa, Arabidopsis thaliana
  misc_feature (1)..(238): useful for making plants with increased salt and oxidative stress tolerance as described in USSN 12/282,342
  misc_feature (1)..(238): Ceres CLONE ID no. 16403
  misc_feature (1)..(238): Ceres Seed Line ID no. ME01468
  misc_feature (1)..(238): Phenotype: Cold Germination Useful for making plants with increased tolerance to cold stress
  misc_feature (1)..(238): Phenotype: Cold Growth Useful for making plants with increased tolerance to cold stress
  misc_feature (54)..(236): Pfam Name: PsbP Pfam Description: PsbP
MAVSSLSIRCGGFSPTISHKTEILCPNPSLKACCLLSSGGKADSSESTYQKGSGNNWKRRQALVGVGTLVATSIPATLLLAEEIPKSYSPFVDREDGYSYYYPSDWREFDFRAHDSAFKDRYLQLQNVRVRFIPTEKNDIHEVGPMEEVVYDLVKHKFAAPNQVATIYDMKERVEDGKNYYTFEYGLRTPIYATTSFATVAVGNNRYYTLIVGANERRWRKVKKQLQVVADSLKILQI

SEQ ID NO: 5046 - protein, 234 aa, Glycine max
  misc_feature (1)..(234): useful for making plants with increased salt and oxidative stress tolerance as described in USSN 12/282,342
  misc_feature (1)..(234): Ceres CLONE ID no. 611156
  misc_feature (1)..(234): Functional Homolog of  Ceres CLONE ID no. 16403 at SEQ ID NO: 5045 with e-value of 7.29E-67 and BLAST sequence identity of 58.9
  misc_feature (63)..(232): Pfam Name: PsbP Pfam Description: PsbP
MVVSSCSLSWISPCLSHKLNLPHTNCLPRNIATSSSNTVFCELDTTPSGESHCRRRPLLLGIGALTANLQPTNLVFAQEKPDRYRAFVDYEDGYSYVYPIDWKEFDFRAHDSAFKDRYLQLQNVRVRFIPTEKKDIRDLGPMEEVIYDLVKHRYAAPNQRPTINDMQEKTIDGKHYYTFEYILTSPNYSSASFATIAIGNGRYYTLIVGANERRWKRFRDQLKVVADSFRLLDI

SEQ ID NO: 5047 - DNA, 699 bp, Populus balsamifera subsp. trichocarpa
  misc_feature (1)..(699): useful for making plants with increased salt and oxidative stress tolerance as described in USSN 12/282,342
  misc_feature (1)..(699): Ceres ANNOT ID no. 1464944
atggcaatatcttcactctcattgagttgggcttccactaccttatcccaaaagttaagtgtccctggttcaaatgaaatattgcctagagtagcagcattttctggcaataactctgtaacatgcacggcagaggcaaccttcaatgaagaaagcaattgcaagagacgtctgctactgctaggagttggagcactaacgacaagtttagtcccagcaaatttcctttttgctgaagagataccaaagaactacacatcttttgtggactttgaagatgggtattcatattattacccctcagactggattgattttgacttcaggggacatgattctgcatttaaggacagaacgaagcaattgcagaatgttagggtgagatttataccaaccgagaaaaaagacattcatgaattgggtccaatggaagagtatgacagtcacatgcagcaagaaattatgaacgtgaaactttcaaattttcttgaaaaccagaaaaccgtagagggaaaaaactactacaccttcgagtacgaacttacatctccaaactactcaagtgtttcatttgcaaccatagttattgccaatgggagattttacactctgatagttggcgcaaatgaaagacggtggagaagatatcgcagtcagctaaaagtggtagcagactctttcaaggtgcttgacatctaa

SEQ ID NO: 5048 - protein, 232 aa, Populus balsamifera subsp. trichocarpa
  misc_feature (1)..(232): useful for making plants with increased salt and oxidative stress tolerance as described in USSN 12/282,342
  misc_feature (1)..(232): Ceres ANNOT ID no. 1464944
  misc_feature (1)..(232): Functional Homolog of  Ceres CLONE ID no. 16403 at SEQ ID NO: 5045 with e-value of 4.39E-60 and BLAST sequence identity of 56.2
  misc_feature (53)..(230): Pfam Name: PsbP Pfam Description: PsbP
MAISSLSLSWASTTLSQKLSVPGSNEILPRVAAFSGNNSVTCTAEATFNEESNCKRRLLLLGVGALTTSLVPANFLFAEEIPKNYTSFVDFEDGYSYYYPSDWIDFDFRGHDSAFKDRTKQLQNVRVRFIPTEKKDIHELGPMEEYDSHMQQEIMNVKLSNFLENQKTVEGKNYYTFEYELTSPNYSSVSFATIVIANGRFYTLIVGANERRWRRYRSQLKVVADSFKVLDI

SEQ ID NO: 5049 - protein, 178 aa, Oryza sativa subsp. japonica
  misc_feature (1)..(178): useful for making plants with increased salt and oxidative stress tolerance as described in USSN 12/282,342
  misc_feature (1)..(178): Public GI no. 31432520
  misc_feature (1)..(178): Functional Homolog of  Ceres CLONE ID no. 16403 at SEQ ID NO: 5045 with e-value of 4.20E-32 and BLAST sequence identity of 39.8
  misc_feature (20)..(175): Pfam Name: PsbP Pfam Description: PsbP
MLLAAGAAVFLSWPNLAANAAEAKKGFLPVTDKKDGYSFLYPFGWQEVVVQGQDKVYKDVIEPLESVSVNTIPTSKQDIRELGPPDQVAEALIRKVLAAPTQKTKLIEAKENDVDGRTYYTFEFTAQAPNFTRHALGAIAIANGKFYTLTTGANERRWEKIKDRLHTVVDSFKIEARV

SEQ ID NO: 5050 - protein, 257 aa, Oryza sativa subsp. japonica
  misc_feature (1)..(257): useful for making plants with increased salt and oxidative stress tolerance as described in USSN 12/282,342
  misc_feature (1)..(257): Public GI no. 50944591
  misc_feature (1)..(257): Functional Homolog of  Ceres CLONE ID no. 16403 at SEQ ID NO: 5045 with e-value of 4.69E-33 and BLAST sequence identity of 39.5
  misc_feature (86)..(241): Pfam Name: PsbP Pfam Description: PsbP
MATHSTSAPAAPAFSAFPLAAAVRFPCASATSNTCAFSLAEHLTREGMFFDLQSIKREAEERSRRRMLLAAGAAMFLSWPNPAAYAAEAKKGFLPVTDKKDGYSFLYPFGWQEVVVQGQDKVYKDVIEPLESVSVNTIPTSKQDIRELGPPDQVAEALIRKVLAAPTQKTKLIEAKENDVDGRTYYTFEFTAQAPNFTRHALGAIAIANGKFYTLTTGANERRWEKIKDRLHTVVDSFKIEAREVRFNGKCREHGSY

SEQ ID NO: 5051 - protein, 242 aa, Zea mays
  misc_feature (1)..(242): useful for making plants with increased salt and oxidative stress tolerance as described in USSN 12/282,342
  misc_feature (1)..(242): Ceres CLONE ID no. 1551032
  misc_feature (1)..(242): Functional Homolog of  Ceres CLONE ID no. 16403 at SEQ ID NO: 5045 with e-value of 2.39E-32 and BLAST sequence identity of 39.2
  misc_feature (59)..(239): Pfam Name: PsbP Pfam Description: PsbP
MATAVPAACLRAPCSSPAAVARRLGAGGPSLRKRHCAVAPVAAACGPAPPRLLDNEEAVCSVRRRVLVAGAAAFLSRPNPAAFAAEAKKGFLPVVDKKAGYSFLYPFGWEEVAVQGQDKVYKDVIEPLESVSVNSIPTSKEDIRDLGPPDKVAEALIKKVLAPSTQKTKLIEAKENDVDGRAYYTFEFTAQAPNYTRHALGAIVIANGKFYTLTTGANERRWEKMKDRLHTVVDSFKIENRI

SEQ ID NO: 5052 - DNA, 1172 bp, Arabidopsis thaliana
  misc_feature (1)..(1172): useful for making plants with increased salt and oxidative stress tolerance as described in USSN 12/282,342
  misc_feature (1)..(1172): Ceres CLONE ID no. 3964
  misc_feature (1)..(1172): Ceres Seed Line ID no. ME00199
aaagcatcaaataagtaaataaaaactcttttatgttcacctttttcactatcctctctttgtgtttcaaatcgtgggaacaaattatcacaatggaggcttctaaagaagctcatcaccttccaaactacatgaaagacgacaacgttagtcaagaaaccaagaacttgatcacttctctaccttcagacaaagatttcatgggttatggtctctacaactacaaaggttgttggtactatccaaacacactccaagccgttcttgacgtccaaaaacacttcaagccacgagatactgatataatcctcgcttctttgcccaaaggtggaaccacttggctcaaatccctaattttcgctgttgtacatagagaaaagtaccgcggaacccctcaaacacatcctttgctcttacaaaaccctcatgaccttgtcccatttcttgaggttgagttatacgctaatagccaaattccggatctcgcaaagtattcttctcctatgatcttttctacacacatgcacttacaagcattgcgtgaagccaccacaaaagcttgcaaaaccgtatatgtgtgtagaggtatcaaagatacgtttgtctccggctggcattatagaaacatgttgcatcgcaccaagatggatcaagccacttttgagctcatgtttgatgcttattgtagaggagttctcttatatggaccttattgggaacatgtattgagctattggaaagggagcttggaagcaaaggagaatgttcttttcatgaagtacgaagagataattgaggagcctcgtgttcaagtcaagagactcgccgagttcttggaatgtccattcaccaaggaagaagaagaaagtggatcggtggaggagatcttgaagttgtgtagtttacgaaatttaagcaatttggaggttaataagaatgggacaacgagaattggtgtagattctcaggtgttctttaggaaaggtgaagttggtgattggaagaatcatcttacgccacaaatggcgaaaacctttgatgagattattgactatagactaggagactccggtttgatatttcaataaggttgtgttgtgttttttttcttttgtcatccgaaaataaattaggactcaaacgagtcattcttgaaaaaaaaaaaaaaaaaa

SEQ ID NO: 5053 - protein, 351 aa, Arabidopsis thaliana
  misc_feature (1)..(351): useful for making plants with increased salt and oxidative stress tolerance as described in USSN 12/282,342
  misc_feature (1)..(351): Ceres CLONE ID no. 3964
  misc_feature (1)..(351): Ceres Seed Line ID no. ME00199
  misc_feature (1)..(351): Phenotype: Dark Green Useful for increasing chlorophyll and photosynthetic capacity
  misc_feature (1)..(351): Phenotype: WHOLE PLANT Useful for making bigger plants
  misc_feature (1)..(351): Phenotype: Curled 3 Useful for making plants with altered leaf shape eg curled leaves
  misc_feature (1)..(351): Phenotype: Standing Rosette Shaped Useful for making plants with increased biomass and foliage
  misc_feature (88)..(347): Pfam Name: Sulfotransfer_1 Pfam Description: Sulfotransferase domain
MFTFFTILSLCFKSWEQIITMEASKEAHHLPNYMKDDNVSQETKNLITSLPSDKDFMGYGLYNYKGCWYYPNTLQAVLDVQKHFKPRDTDIILASLPKGGTTWLKSLIFAVVHREKYRGTPQTHPLLLQNPHDLVPFLEVELYANSQIPDLAKYSSPMIFSTHMHLQALREATTKACKTVYVCRGIKDTFVSGWHYRNMLHRTKMDQATFELMFDAYCRGVLLYGPYWEHVLSYWKGSLEAKENVLFMKYEEIIEEPRVQVKRLAEFLECPFTKEEEESGSVEEILKLCSLRNLSNLEVNKNGTTRIGVDSQVFFRKGEVGDWKNHLTPQMAKTFDEIIDYRLGDSGLIFQ

SEQ ID NO: 5054 - protein, 337 aa, Oryza sativa subsp. japonica
  misc_feature (1)..(337): useful for making plants with increased salt and oxidative stress tolerance as described in USSN 12/282,342
  misc_feature (1)..(337): Public GI no. 77552973
  misc_feature (1)..(337): Functional Homolog of  Ceres CLONE ID no. 3964 at SEQ ID NO: 5053 with e-value of 1.49E-61 and BLAST sequence identity of 48.6
  misc_feature (73)..(324): Pfam Name: Sulfotransfer_1 Pfam Description: Sulfotransferase domain
MAPSFRLSSAPESADEATAHKEIYDQLRRVAETFPSAPSLIGLPCSRHPDGWYTFTNGVVSSMVIKEHLTARATDIFLTTFPKSGTTWLKVLLYSTLHRGTDELVAHSPHQLVPFLESQVFVNDRIPDLSSLSSPRLFMTHIPSQSLPNSVATSGCKVVYLCRDPKDCFVSLWHFWNRFMPWDIDEAHRQFCDGVSQFGPFWEHILGYWRWHVEKPNQVLFLTYEELAADTLGQLRRLAEFVGCPFTTEEQKHGVDRNIVEACALENMSGLEVNRSGTITIVDSTVPNNTFFRRGVVGDWRNHLTPEMARRIDEITKSKFKGSGLLLHPQFLQVKRE

SEQ ID NO: 5055 - DNA, 1119 bp, Populus balsamifera subsp. trichocarpa
  misc_feature (1)..(1119): useful for making plants with increased salt and oxidative stress tolerance as described in USSN 12/282,342
  misc_feature (1)..(1119): Ceres ANNOT ID no. 1448303
atgcctgcctctactacaacttccatggttctcaaccatttcacaaagaatcaagcaaatgacaatggagaggatttagagagattaaccaatgagtgcaaggaattgctgctttcactcccaagagagaagggttggagaactgcatgcctctataaatacaaagggttttggtgccaaccaaaagaaatccaagcgataatctcttttcaaaaacactttgaaccaagagacactgatgttatcctagcatcaatacctaaatcaggaactacctggctcaaagccctatcttttgccatcttgaatcgcaagaaatttgcaatctctagtaatgaccaccctttgctcgtctctaatcctcacgatcttgcacctttctttgagtacaagctttatgcagacaagcaagttcctgacctctcgaaactccctgatcctagactttttgccacccacattccatttgcttcacttcaagactccatcaagaagtctaattgccggattatttatatctgtagaaacccttttgacacttttatttcctcatggactttcagcaacaagctgagatcagaaactgttcctccactgttactagaggaaaccttcaaaatgtattgcgaaggggttgtagggttcggtcccttctgggaccatatgttgggatactggaaggaaagcttggagagacaagacaaggtgttgttcttgaagtatgaggacatgaaagcagatgttacgttttacttgaagaagattgccaaatttcttggctgccctttttcaatggaagaagaaaaggaaggtgtagtggaaaagatagccagcctttgtagctttgagaagatgaagaatttagaagttaacaaatctggaaggtctattacgaacttcgaaaataagcacttgtttaggaaagctgaagtcggagattgggtgaattatctgtctccttcaatggtgaagcaattatctcaattaatagaggaaaagttgggtggatctggaggtgtccaagctgctgctgctgctgcttcttcttcttcttctgttataaagaagaaattcgagctacagagatatggagagaataagaatacaaatgtcaattga

SEQ ID NO: 5056 - protein, 364 aa, Populus balsamifera subsp. trichocarpa
  misc_feature (1)..(364): useful for making plants with increased salt and oxidative stress tolerance as described in USSN 12/282,342
  misc_feature (1)..(364): Ceres ANNOT ID no. 1448303
  misc_feature (1)..(364): Functional Homolog of  Ceres CLONE ID no. 3964 at SEQ ID NO: 5053 with e-value of 2.89E-72 and BLAST sequence identity of 47.4
  misc_feature (70)..(330): Pfam Name: Sulfotransfer_1 Pfam Description: Sulfotransferase domain
MVLNHFTKNQANDNGEDLERLTNECKELLLSLPREKGWRTACLYKYKGFWCQPKEIQAIISFQKHFEPRDTDVILASIPKSGTTWLKALSFAILNRKKFAISSNDHPLLVSNPHDLAPFFEYKLYADKQVPDLSKLPDPRLFATHIPFASLQDSIKKSNCRIIYICRNPFDTFISSWTFSNKLRSETVPPLLLEETFKMYCEGVVGFGPFWDHMLGYWKESLERQDKVLFLKYEDMKADVTFYLKKIAKFLGCPFSMEEEKEGVVEKIASLCSFEKMKNLEVNKSGRSITNFENKHLFRKAEVGDWVNYLSPSMVKQLSQLIEEKLGGSGGVQAAAAAASSSSSVIKKKFELQRYGENKNTNVN

SEQ ID NO: 5057 - DNA, 1233 bp, Populus balsamifera subsp. trichocarpa
  misc_feature (1)..(1233): useful for making plants with increased salt and oxidative stress tolerance as described in USSN 12/282,342
  misc_feature (1)..(1233): Ceres ANNOT ID no. 1501305
atgcctgcctctactacaacttccatggttctcaaccatttcacaaagaatcaagcaaatgacaatggagaggatttagagagattaaccaatgagtgcaaggaattgctgctttcactcccaagagagaagggttggagaactgcatgcctctataaatacaaagggttttggtgccaaccaaaagaaatccaagcgataatctcttttcaaaaacactttgaaccaagagacactgatgttatcctagcatcaatacctaaatcaggaactacctggctcaaagccctatcttttgccatcttgaatcgcaagaaatttgcaatctctagtaatgaccaccctttgctcgtctctaatcctcacgatcttgcacctttctttgagtacaagctttatgcagacaagcaagttcctgacctctcgaaactccctgatcctagactttttgccacccacattccatttgcttcacttcaagactccatcaagaagtctaattgccggattatttatatctgtagaaacccttttgacacttttatttcctcatggactttcagcaacaagctgagatcagaaactgttcctccactgttactagaggaaaccttcaaaatgtattgcgaaggggttgtagggttcggtcccttctgggaccatatgttgggatactggaaggaaagcttggagagacaagacaaggtgttgttcttgaagtatgaggacatgaaagcagatgttacgttttacttgaagaagattgccaaatttcttggctgccctttttcaatggaagaagaaaaggaaggtgtagtggaaaagatagccagcctttgtagctttgagaagatgaagaatttagaagttaacaaatctggaaggtctattacgaacttcgaaaataagcacttgtttaggaaagctgaagtcggagattgggtgaattatctgtctccttcaatggtgaagcaattatctcaattaatagaggaaaagttgggtggatctggtattgaattcaaagtgtttccttatactagcactactccgtctacatctccaaggcttttcgctgctcacattccctattcatcattgcccgaatccatcaagaagtctaattgtcgtgaagtttacatttatcgtaacccttttaacgtggtggcatcctggtttcatttttccaatgttgaaggtgaaccagagaagctggatgaggagtatttttga

SEQ ID NO: 5058 - protein, 410 aa, Populus balsamifera subsp. trichocarpa
  misc_feature (1)..(410): useful for making plants with increased salt and oxidative stress tolerance as described in USSN 12/282,342
  misc_feature (1)..(410): Ceres ANNOT ID no. 1501305
  misc_feature (1)..(410): Functional Homolog of  Ceres CLONE ID no. 3964 at SEQ ID NO: 5053 with e-value of 6.70E-73 and BLAST sequence identity of 47.0
  misc_feature (353)..(397): Pfam Name: Sulfotransfer_1 Pfam Description: Sulfotransferase domain
MPASTTTSMVLNHFTKNQANDNGEDLERLTNECKELLLSLPREKGWRTACLYKYKGFWCQPKEIQAIISFQKHFEPRDTDVILASIPKSGTTWLKALSFAILNRKKFAISSNDHPLLVSNPHDLAPFFEYKLYADKQVPDLSKLPDPRLFATHIPFASLQDSIKKSNCRIIYICRNPFDTFISSWTFSNKLRSETVPPLLLEETFKMYCEGVVGFGPFWDHMLGYWKESLERQDKVLFLKYEDMKADVTFYLKKIAKFLGCPFSMEEEKEGVVEKIASLCSFEKMKNLEVNKSGRSITNFENKHLFRKAEVGDWVNYLSPSMVKQLSQLIEEKLGGSGIEFKVFPYTSTTPSTSPRLFAAHIPYSSLPESIKKSNCREVYIYRNPFNVVASWFHFSNVEGEPEKLDEEYF

SEQ ID NO: 5059 - protein, 312 aa, Flaveria chloraefolia
  misc_feature (1)..(312): useful for making plants with increased salt and oxidative stress tolerance as described in USSN 12/282,342
  misc_feature (1)..(312): Public GI no. 68067679
  misc_feature (1)..(312): Functional Homolog of  Ceres CLONE ID no. 3964 at SEQ ID NO: 5053 with e-value of 6.40E-61 and BLAST sequence identity of 46.6
  misc_feature (49)..(308): Pfam Name: Sulfotransfer_1 Pfam Description: Sulfotransferase domain
MEDIIKTLPQHTCSFLKHRFTLYKYKDAWNHQEFLEGRILSEQKFKAHPNDVFLASYPKSGTTWLKALAFAIITREKFDDSTSPLLTTMPHDCIPLLEKDLEKIQENQRNSLYTPISTHFHYKSLPESARTSNCKIVYIYRNMKDVIVSYYHFLRQIVKLSVEEAPFEEAFDEFCQGISSCGPYWEHIKGYWKASLEKPEIFLFLKYEDMKKDPVPSVKKLADFIGHPFTPKEEEAGVIEDIVKLCSFEKLSSLEVNKSGMHRPEEAHSIENRLYFRKGKDGDWKNYFTDEMTQKIDKLIDEKLGATGLVLK

SEQ ID NO: 5060 - protein, 343 aa, Triticum aestivum
  misc_feature (1)..(343): useful for making plants with increased salt and oxidative stress tolerance as described in USSN 12/282,342
  misc_feature (1)..(343): Ceres CLONE ID no. 703785
  misc_feature (1)..(343): Functional Homolog of  Ceres CLONE ID no. 3964 at SEQ ID NO: 5053 with e-value of 1.30E-60 and BLAST sequence identity of 46.2
  misc_feature (74)..(332): Pfam Name: Sulfotransfer_1 Pfam Description: Sulfotransferase domain
MASSPQSSSSAPKADDKAASHKEIYDQLLEVVSTYPTAPSGIGRPYTHHPDGWYAFTPAVVNAMVIKRHLKACDTDVFLSTFPKSGTTWLKALLFATLRRTADGPAIAALAAHSPHQLIPFLEVQVFSNGRIPDLSSLPAPRLLMTHIPSRSLPESVAASGCKVVYLCRDPKDCFVSLWHFWNRFAPSPWDLGEALQQFCDGVSLFGPFWEHVLGYWRWHVERPEQVLFLTYEELAADTLGQLKRLAAFLGRPFTSEEREARVDREIVEACAMESLAGLEVNRSGKTDMTESSVANNIFFRRGVVGDWKNHLTPEMARRIDEITDSKFRGSGLALTPATADQN

SEQ ID NO: 5061 - protein, 325 aa, Brassica napus
  misc_feature (1)..(325): useful for making plants with increased salt and oxidative stress tolerance as described in USSN 12/282,342
  misc_feature (1)..(325): Public GI no. 3420008
  misc_feature (1)..(325): Functional Homolog of  Ceres CLONE ID no. 3964 at SEQ ID NO: 5053 with e-value of 4.99E-61 and BLAST sequence identity of 45.8
  misc_feature (65)..(320): Pfam Name: Sulfotransfer_1 Pfam Description: Sulfotransferase domain
MSSSSSVPDYLRDEKLTQETRDLISSLPSEKGWLVSQIYQFQGRWHTEALLQGILTCQKHFKAKDSDIILVTNPKSGTTWLKSLVFALINRHKFPVSSGDHPLLVTNPHLLVPFMEGVYYESPDFDFSLLPFPRLMNTHISHLSLPESVKSSSCQIVYCCRNPKDMFVSLWHFGKKLAPQETADYPLEKAVEAFCQGKFIAGPFWDHVLEYWYASLENPNKVLFVTYEELKKQTEVEVKRIAEFIGCGFTAEEEVSEIVKLCSFESLSRLEVNRQGKLPNGIETNAFFRKGEIGGWRDTLSESLADAIDRTTEEKFGGSGLKFSC

SEQ ID NO: 5062 - protein, 312 aa, Flaveria bidentis
  misc_feature (1)..(312): useful for making plants with increased salt and oxidative stress tolerance as described in USSN 12/282,342
  misc_feature (1)..(312): Public GI no. 1706738
  misc_feature (1)..(312): Functional Homolog of  Ceres CLONE ID no. 3964 at SEQ ID NO: 5053 with e-value of 2.70E-60 and BLAST sequence identity of 45.8
  misc_feature (49)..(308): Pfam Name: Sulfotransfer_1 Pfam Description: Sulfotransferase domain
MEDIIKTLPQHTCSFLKQRFTLYKYQDVWNHQEFLEGRMLSEQTFKAHPNDVFLASYPKSGTTWLKALAFAIITREKFDDSTSPLLTTMPHDCIPLLEKDLEKIQENQRNSLYTPISTHFHYKSLPESARTSNCKIVYIYRNMKDVIVSYYHFLRQIVKLSVEEAPFEEAVDEFCQGISSCGPYWEHILGYWKASLEKPEIFLFLKYEDMKKDPVPSVKKLADFIGHPFTPKEEEAGVIENIIKLCSFEKLSSLEVNKSGMHRPEEAHSIENRLYFRKGKDGDWKNYFTDEMIEKIDKLIDEKLGATGLVLK

SEQ ID NO: 5063 - protein, 323 aa, Brassica napus
  misc_feature (1)..(323): useful for making plants with increased salt and oxidative stress tolerance as described in USSN 12/282,342
  misc_feature (1)..(323): Public GI no. 3420004
  misc_feature (1)..(323): Functional Homolog of  Ceres CLONE ID no. 3964 at SEQ ID NO: 5053 with e-value of 1.30E-60 and BLAST sequence identity of 44.4
  misc_feature (64)..(318): Pfam Name: Sulfotransfer_1 Pfam Description: Sulfotransferase domain
MESSSVPVYLKDENLTQETRDLLSSLPSEKGWLVSQMYQFEGIWQTQALVQGIVNCQKHFEANDSDVILATLAKSGTTWLKALLFALIHRHKFPVSGKHPLLVTNPHSLVPYLEGDYCSSPEVNFAELPSPRLMQTHLTHHSLPVSIKSSSCKIIYCCRNPKDMFVSIWHFGRKLAPEKTAEYPIETAVAAFCKGKFIGGPFWDHVLEYWYESLKNPNKVLFVTYEELKKQTEVEVKRIAEFIGCGFTAEEEVSEIVKLCSFESLSSLEVNRQGKLPNGIESNAFFRKGETGGWRDTLSESLADVIDRTTEQKFGGSGLKFSS

SEQ ID NO: 5064 - protein, 323 aa, Brassica napus
  misc_feature (1)..(323): useful for making plants with increased salt and oxidative stress tolerance as described in USSN 12/282,342
  misc_feature (1)..(323): Public GI no. 38230552
  misc_feature (1)..(323): Functional Homolog of  Ceres CLONE ID no. 3964 at SEQ ID NO: 5053 with e-value of 2.20E-58 and BLAST sequence identity of 44.4
  misc_feature (63)..(318): Pfam Name: Sulfotransfer_1 Pfam Description: Sulfotransferase domain
MSSSSSSYLRDEDLTQETRDLISSLPSEKGWLVSQMYQFQGRWHTQALLQGLLQYQKHFEAKDSDIILVTNPKSGTTWLKALVFSLINRHKFPVSSGDHPLLVTNPHLLIPFLEGVYYESPNFDFTELPSPRLMNTHISLLSLPESVKSSSCKIVYCCRNPKDMFVSLWHFGKKLASQETADYPIEKAVEAFCQGKFIGGPFWDHVLEYWYASLENPNKVLFVTYEELKKQTGDTIKRIAEFLGCGFIEEEEVGGIVKLCSFESLSSLEANREGKLPNGVETKAFFRKGEVGGWRDTLSESLAEEIDRTMEEKFQGSGLKFSC

SEQ ID NO: 5065 - protein, 324 aa, Brassica napus
  misc_feature (1)..(324): useful for making plants with increased salt and oxidative stress tolerance as described in USSN 12/282,342
  misc_feature (1)..(324): Public GI no. 3420006
  misc_feature (1)..(324): Functional Homolog of  Ceres CLONE ID no. 3964 at SEQ ID NO: 5053 with e-value of 9.20E-53 and BLAST sequence identity of 44.1
  misc_feature (65)..(319): Pfam Name: Sulfotransfer_1 Pfam Description: Sulfotransferase domain
MSSSSSVPDYLRDENLTQKTKDLISSLPSEKGWLVCQMYQFQGRWHTQALLQGILTCQKHFEAKDSDIILVTNPKSGTTWLKALVFALINRHKFPVYSVIILSCYQSALLVPFLGRSLLRSPDFDFSQLSSPRLMNTHISHLSLPESVKSSSCKIVYCCRNPKDMFVSLWHFGKKLAPEETADYPIEKAVEAFCQGKFIGGPFWDHVLEYWYASLENPNKVLFVSYEEPKKKTGETIKRIAEFLGCGLVGEEEVRAIVKLCSFESLSSLEVNREGKLPSGMETRAFFRKGEVGGWRDTLTESLAEVIDRTIEEKFQGSGLKFSC

SEQ ID NO: 5066 - protein, 290 aa, Oryza sativa subsp. japonica
  misc_feature (1)..(290): useful for making plants with increased salt and oxidative stress tolerance as described in USSN 12/282,342
  misc_feature (1)..(290): Public GI no. 77552976
  misc_feature (1)..(290): Functional Homolog of  Ceres CLONE ID no. 3964 at SEQ ID NO: 5053 with e-value of 3.59E-42 and BLAST sequence identity of 44.1
  misc_feature (182)..(290): Pfam Name: Sulfotransfer_1 Pfam Description: Sulfotransferase domain
MAPSFPLSFAPQSADEAAAHKEIYDQLRQTVETFPTAPNSSNSFTYSRHPDGWYTFPEGVVSAMVIKSHLTARTTDIFMVTFPKSGTTWLKTLLHSALHRGANDLAAHSPHQLVPFLETQVFIKDRIPDLSSLPAPRLLMTHIPSQSLPDSVADSGCKVVYLCRDPNRKFRPWDINEAHRHFCDGVSLFGPYWEHVLGYWRWHTKRPSQVLFLTYEELTTDTLGQLRHLAEFVGCPFMVEEQELGVDRKIVEACAMESLSRLEVNQSGTTDMVDKTYVNNIFFRRGVVGD

SEQ ID NO: 5067 - protein, 345 aa, Zea mays
  misc_feature (1)..(345): useful for making plants with increased salt and oxidative stress tolerance as described in USSN 12/282,342
  misc_feature (1)..(345): Ceres CLONE ID no. 1064128
  misc_feature (1)..(345): Functional Homolog of  Ceres CLONE ID no. 3964 at SEQ ID NO: 5053 with e-value of 1.19E-59 and BLAST sequence identity of 43.8
  misc_feature (74)..(332): Pfam Name: Sulfotransfer_1 Pfam Description: Sulfotransferase domain
MATVFPRDAGVSTPEADEAKKIYDEARRVVSTYETVPSPSGTLQDYCRHPSGWCITLPIMVSSMVAEQHFEARGTDVLLVTMPKSGTTWIKALLYAAAHRTDDTSSSILRQLASHNSHQLVPFLEAQVYTKDQIPDLSSLPAPRLFATHIPAESLPPSVVASGCKVVYLCRDPKDCFVSLWHFMNKFTPWDIDEAHGRFCEGVSLYGPFWEHVLSYWRWHVDRPGQVLFLTYEELSADPLGQLRRLAEFIGRPFTPGEQEAGVDREIAEACAMKSMVNQEVNQSRTTEIVEMPIPNGIFFRRGVVGDWTNYLTPEMAGRIDEITKSKFEGSGLMLPKTISEISKI

SEQ ID NO: 5068 - protein, 279 aa, Oryza sativa subsp. japonica
  misc_feature (1)..(279): useful for making plants with increased salt and oxidative stress tolerance as described in USSN 12/282,342
  misc_feature (1)..(279): Public GI no. 77552975
  misc_feature (1)..(279): Functional Homolog of  Ceres CLONE ID no. 3964 at SEQ ID NO: 5053 with e-value of 1.90E-54 and BLAST sequence identity of 43.0
  misc_feature (11)..(262): Pfam Name: Sulfotransfer_1 Pfam Description: Sulfotransferase domain
MVVKSHLTARATDIFLVTFPKSGTTWIKALPYSALHRRADELLAHSPHQLISFLESQVFVKDRIPDLSSLPEPWLLMTHIPSQSLPDSVAASGCKVVYLCRDPKDCFVSLWHFWNRFMPWNIDDAHRQFCNGVSLFGLYWEHVLSYWNWHVERPSEVLFLTYEELAADTLGHLRRLAEFVGRPFTTEEQDARVDRKIVEICAMESLSGLEVNRSGMTNFTKKDVPNNISFRRGVVGDWRNHLTPEMARRIDEITEVKFKGSGLLLHPPFLQVKRELNEL

SEQ ID NO: 5069 - protein, 250 aa, Triticum monococcum
  misc_feature (1)..(250): useful for making plants with increased salt and oxidative stress tolerance as described in USSN 12/282,342
  misc_feature (1)..(250): Public GI no. 30349136
  misc_feature (1)..(250): Functional Homolog of  Ceres CLONE ID no. 3964 at SEQ ID NO: 5053 with e-value of 6.29E-38 and BLAST sequence identity of 39.0
  misc_feature (55)..(248): Pfam Name: Sulfotransfer_1 Pfam Description: Sulfotransferase domain
MNKRLLDSRHCLANANCGLALPLVLFNVCCYEGLWVHYFHVAGAVALQLRLAPLQDDVIVASFPKSGTTWLNALTFATMARRTNPAAGAGHPLLRLNPHQCIPFLDKLFQSCTEAKLEALPSPRLMNTHMPIDMIMPGGGGCKVVYICREPKDMVISQWHFLRRLQPDLPLADLLESVCSGAMPYGPVWDHILGYWRASTARPDGVLFLRYEELLRNPAEKVRELARFVGLPFSDAEEEAGVVHDIVKLE

SEQ ID NO: 5070 - DNA, 865 bp, Brassica napus
  misc_feature (1)..(865): useful for making plants with increased salt and oxidative stress tolerance as described in USSN 12/282,342
  misc_feature (1)..(865): Ceres CLONE ID no. 965405
  misc_feature (1)..(865): Ceres Seed Line ID no. ME09814
agtcgtcgtcttctgtgtaagaaatatcttatcttaggtgtgcagaccgaagtctagagtatcttcaagcttcaacttcttagctatgtcggccgatgattcttcaaatgctacagatgttgacgggaagctcggctccgatttaaacgttaactctgacggtgaagatgcggcggataatgattcctcaaagacattgactattcctgctcccgccgtttgtcttgtccggttcgccggagatgcagctggtggtgccgtcatgggctctatctttggatatggttcaggattgttcaagaagaaaggctttaaaggatcatttgcagatgcaggacagtctgcaaagacttttgctgttttgtccggagtacacagtttggttgtttgccttctgaaacaactcagagggaaagatgatgccattaatgttggagttgctgggtgctgcaccggtcttgctcttagtttccctggtgctccacaggctcttctacagagttgcctcacttttggggctttctcttttatccttgagggactaaacaaaagacaaacagccttggctcactctgtctccttaagacaccaaaccggaaactttggagatcatcaacaacgtcctttacaactctccctggctctcccaatccatgaagaaatcaaaggattctcttctttctgcaagtccttaactaaacccaagaagatctaatttcgccatgattatccttttcttgttccttatgttctctctgtagattcttaatgattccctgcttttgctgtactttgtgagagaatattttatgaaagatcttttgatataaattttgcaccgtttgctctaaaaaaaaaaaaaaaa

SEQ ID NO: 5071 - protein, 209 aa, Brassica napus
  misc_feature (1)..(209): useful for making plants with increased salt and oxidative stress tolerance as described in USSN 12/282,342
  misc_feature (1)..(209): Ceres CLONE ID no. 965405
  misc_feature (1)..(209): Ceres Seed Line ID no. ME09814
  misc_feature (39)..(157): Pfam Name: Tim17 Pfam Description: Tim17/Tim22/Tim23 family
MSADDSSNATDVDGKLGSDLNVNSDGEDAADNDSSKTLTIPAPAVCLVRFAGDAAGGAVMGSIFGYGSGLFKKKGFKGSFADAGQSAKTFAVLSGVHSLVVCLLKQLRGKDDAINVGVAGCCTGLALSFPGAPQALLQSCLTFGAFSFILEGLNKRQTALAHSVSLRHQTGNFGDHQQRPLQLSLALPIHEEIKGFSSFCKSLTKPKKI

SEQ ID NO: 5072 - protein, 210 aa, Arabidopsis thaliana
  misc_feature (1)..(210): useful for making plants with increased salt and oxidative stress tolerance as described in USSN 12/282,342
  misc_feature (1)..(210): Ceres CLONE ID no. 5367
  misc_feature (1)..(210): Functional Homolog of  Ceres CLONE ID no. 965405 at SEQ ID NO: 5071 with e-value of 6.89E-87 and BLAST sequence identity of 85.5
  misc_feature (40)..(158): Pfam Name: Tim17 Pfam Description: Tim17/Tim22/Tim23 family
MAANDSSNAIDIDGNLDSDSNLNTDGDEATDNDSSKALVTIPAPAVCLFRFAGDAAGGAVMGSIFGYGSGLFKKKGFKGSFADAGQSAKTFAVLSGVHSLVVCLLKQIRGKDDAINVGVAGCCTGLALSFPGAPQALLQSCLTFGAFSFILEGLNKRQTALAHSVSLRHQTGLFQDHHRALPLSLALPIPEEIKGAFSSFCKSLAKPRKF

SEQ ID NO: 5073 - protein, 214 aa, Arabidopsis thaliana
  misc_feature (1)..(214): useful for making plants with increased salt and oxidative stress tolerance as described in USSN 12/282,342
  misc_feature (1)..(214): Public GI no. 79537394
  misc_feature (1)..(214): Functional Homolog of  Ceres CLONE ID no. 965405 at SEQ ID NO: 5071 with e-value of 4.30E-78 and BLAST sequence identity of 79.6
  misc_feature (40)..(158): Pfam Name: Tim17 Pfam Description: Tim17/Tim22/Tim23 family
MAAENSSNAINVDTSLDSDSKPNRDANDMTDHDSSSKALVIPAPAVCLVRFAGDAASGAFMGSVFGYGSGLFKKKGFKGSFVDAGQSAKTFAVLSGVHSLVVCLLKQIRGKDDAINVGVAGCCTGLALSFPGAPQAMLQSCLTFGAFSFILEGLNKRQTALAHSVSFRQQTRSPQHDLPLLSLAIPIHDEIKGAFSSFCNSLTKPKKLKFPHAR

SEQ ID NO: 5074 - protein, 212 aa, Arabidopsis thaliana
  misc_feature (1)..(212): useful for making plants with increased salt and oxidative stress tolerance as described in USSN 12/282,342
  misc_feature (1)..(212): Public GI no. 9758183
  misc_feature (1)..(212): Functional Homolog of  Ceres CLONE ID no. 965405 at SEQ ID NO: 5071 with e-value of 7.30E-76 and BLAST sequence identity of 79.4
  misc_feature (40)..(156): Pfam Name: Tim17 Pfam Description: Tim17/Tim22/Tim23 family
MAAENSSNAINVDTSLDSDSKPNRDANDMTDHDSSSKALVIPAPAVCLVRFAGDAASGAFMGSVFGYGLFKKKGFKGSFVDAGQSAKTFAVLSGVHSLVVCLLKQIRGKDDAINVGVAGCCTGLALSFPGAPQAMLQSCLTFGAFSFILEGLNKRQTALAHSVSFRQQTRSPQHDLPLLSLAIPIHDEIKGAFSSFCNSLTKPKKLKFPHAR

SEQ ID NO: 5075 - protein, 213 aa, Zea mays
  misc_feature (1)..(213): useful for making plants with increased salt and oxidative stress tolerance as described in USSN 12/282,342
  misc_feature (1)..(213): Ceres CLONE ID no. 1060894
  misc_feature (1)..(213): Functional Homolog of  Ceres CLONE ID no. 965405 at SEQ ID NO: 5071 with e-value of 3.50E-76 and BLAST sequence identity of 77.5
  misc_feature (39)..(157): Pfam Name: Tim17 Pfam Description: Tim17/Tim22/Tim23 family
MAAENPSNGVDVDTSLASDSNDNRKASDLTNHDSSMALTVPSTAVCLGRFAGDAAGGAVMGSIFGYGSGLFKKKGFKGSFADAGQSAKNFAILSGVHSLVVCLLKKLRGKDDAINVGIAGCCTGLALSYPGAPQAMLQSCVTFGAFSFILEGLNKRQTALAHSVSSRHDQTRSLKDDLPLSLALPIHEEIKGAFSSFCKSLTKPKKLAFPSSR

SEQ ID NO: 5076 - protein, 203 aa, Triticum aestivum
  misc_feature (1)..(203): useful for making plants with increased salt and oxidative stress tolerance as described in USSN 12/282,342
  misc_feature (1)..(203): Ceres CLONE ID no. 639280
  misc_feature (1)..(203): Functional Homolog of  Ceres CLONE ID no. 965405 at SEQ ID NO: 5071 with e-value of 6.40E-45 and BLAST sequence identity of 68.0
  misc_feature (29)..(147): Pfam Name: Tim17 Pfam Description: Tim17/Tim22/Tim23 family
MAARSENESDGDVGTNPAEGGSSLSLPPLAAGPAVCVLRSAGDFAGGAFVGSIFGYGQGLLSKKGLKGSLGNAGSSAKSFAVLSGVQSLVLCLLRKLRGKDDIINSGIAGCCTGLALSFPGTPQALLQNCATFAAFSCIMEGLNKQQTAMAHTLTGNALTFAHDNGAGVLPPSLSPQSSMLPMLSPHAARPWSPSLRSTRQQH

SEQ ID NO: 5077 - DNA, 645 bp, Populus balsamifera subsp. trichocarpa
  misc_feature (1)..(645): useful for making plants with increased salt and oxidative stress tolerance as described in USSN 12/282,342
  misc_feature (1)..(645): Ceres ANNOT ID no. 1494390
atggcgacggcgaattctccaaacaccagcaacaactctgattccgatgtcgaagaccctaaccctaatccttcaagtaataataacaatgcatcaattattccttctgctgagtccagtaccccttccgtctgcctcatccgcttcgctggtgactccgctgcaggcgcctttatgggctccatcttcggctacggttcgggattgattaagaagaaaggcttcaaaggatcctttggggaagcaggatcttgtgccaagacttttgcagttctatctggagtacacagtttggttgtctgctttctgaagaggctgcgagggaaggatgatgtcatcaatgctggagtagctggatgttgtactggtcttgctctgagttttccaggtgcacctcaggcacttctgcagagttgccttacttttggagcattctcattcatcatcgaagggctgaacaagaagcaagcagcactggctcactctatttcttcaaggaataaatgtgactatcacagcaaaccttgtccgctagcactccctctttcagtccctcttccagatgaactaaaaggggccttctcctttttctgcaagtccttaaggaaacccaagagtgccaattttcccgccgccgccccctga

SEQ ID NO: 5078 - protein, 214 aa, Populus balsamifera subsp. trichocarpa
  misc_feature (1)..(214): useful for making plants with increased salt and oxidative stress tolerance as described in USSN 12/282,342
  misc_feature (1)..(214): Ceres ANNOT ID no. 1494390
  misc_feature (1)..(214): Functional Homolog of  Ceres CLONE ID no. 965405 at SEQ ID NO: 5071 with e-value of 8.10E-61 and BLAST sequence identity of 67.1
  misc_feature (38)..(156): Pfam Name: Tim17 Pfam Description: Tim17/Tim22/Tim23 family
MATANSPNTSNNSDSDVEDPNPNPSSNNNNASIIPSAESSTPSVCLIRFAGDSAAGAFMGSIFGYGSGLIKKKGFKGSFGEAGSCAKTFAVLSGVHSLVVCFLKRLRGKDDVINAGVAGCCTGLALSFPGAPQALLQSCLTFGAFSFIIEGLNKKQAALAHSISSRNKCDYHSKPCPLALPLSVPLPDELKGAFSFFCKSLRKPKSANFPAAAP

SEQ ID NO: 5079 - protein, 136 aa, Artificial Sequence
  misc_feature (1)..(136): useful for making plants with increased salt and oxidative stress tolerance as described in USSN 12/282,342
  misc_feature (1)..(136): Ceres CDNA ID no. 23799376
  misc_feature (1)..(136): Ceres Clone ID no. 375578
  misc_feature (1)..(136): Ceres Seed Line ID no. ME02064
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSRE

SEQ ID NO: 5080 - DNA, 1020 bp, Arabidopsis thaliana
  misc_feature (1)..(1020): useful for making plants with increased salt and oxidative stress tolerance as described in USSN 12/282,342
  misc_feature (1)..(1020): Ceres CLONE ID no.19199
acccactagaaccgttgtaacctacgacccataataatgtaccatctccttatcattatcactacactctccttctcttcaattaacataaccttcgccgtcgatgaagctttcccttcaattcccactaccttcagcgtcgcaacgaaacaacactacgacgtaaaaccaatccaccatgaagtttatgacggagaaaggaagatatacgacatcagccaccagtacacgccggagttgccggtttgggagtcttcagaaggactagggaactttcttagacttgccgtgagtatgaagaatggatccgatgctaatatctcgaagatggaactatctgttcactctggaactcatgttgatgcaccaggccatttccatgaccattattatgagtctggttttgatactgattcacttgatcttcaaatccttaatggtcctgctttattggttgatgttccaagagataagaacatttcagctgaggttatgaaatcactacatattccaagagggatccgtcgtgttctctttaaaacattgaacactgataggaggcttatgtttaagaaagaatttgattcaagctttgtcgggtttatggtcgatggggcgaaatggttggttgaaaatacagacatcaaacttgttgggcttgattatctttcatttgctgcttatgatgaagcacctgcgacgcataggtttatacttgaacgacgggatataatccctgtcgaagcgctgaagctggatgacgtggaggtaggaatgtacacgcttcattgcttaccgttaagattggttggagcggaaggagcaccaacgagatgcattctcatcaagtgattcagttcatctttttctatctaagttgtatatgaattactgataataaacaataggctttttggcttcttgcttccaagatctcataaccatatcgaagatgttaacatatgggatgattttgttgtaaaagaagcgtctaatcttattatataaagtatggttttc

SEQ ID NO: 5081 - protein, 271 aa, Arabidopsis thaliana
  misc_feature (1)..(271): useful for making plants with increased salt and oxidative stress tolerance as described in USSN 12/282,342
  misc_feature (1)..(271): Ceres CLONE ID no. 19199
  misc_feature (57)..(257): Pfam Name: Cyclase Pfam Description: Putative cyclase
  misc_feature (1)..(271): Functional Homolog of Ceres CLONE ID no. 8686 with e-value of 2.60E-100 and BLAST sequence identity of 83.4
MYHLLIIITTLSFSSINITFAVDEAFPSIPTTFSVATKQHYDVKPIHHEVYDGERKIYDISHQYTPELPVWESSEGLGNFLRLAVSMKNGSDANISKMELSVHSGTHVDAPGHFHDHYYESGFDTDSLDLQILNGPALLVDVPRDKNISAEVMKSLHIPRGIRRVLFKTLNTDRRLMFKKEFDSSFVGFMVDGAKWLVENTDIKLVGLDYLSFAAYDEAPATHRFILERRDIIPVEALKLDDVEVGMYTLHCLPLRLVGAEGAPTRCILIK

SEQ ID NO: 5082 - DNA, 1291 bp, Gossypium hirsutum
  misc_feature (1)..(1291): useful for making plants with increased salt and oxidative stress tolerance as described in USSN 12/282,342
  misc_feature (1)..(1291): Ceres CLONE ID no.1940431
agggtatcacgatcccttaaaagcggcacagcaagccaatgagtggagcgcagattttaaacgcaaaaaaccaacttcacttcccatttcctagtcttccacgatgactcccctccacttcttcctcctcctcctcctttcgtcagctgctttaatctccgcggccgccgccaccgccaccaccgcatatccttccatcccgggcaccgattccacaactgattgtggcctatccggaggggacgagaatccagttcccatccgtcgcgaagtctacggtaacggcaagatattcgacatcagccataggtacaccgtcgacatgccgtcttgggaatccaaggacggcgtgggacagttcctatggttgcctaaaagcatgaagaacggttccctcgctaataattcggagatgaaactcccaactcacaccggcacccaccttgacgctcccggacacgtcatcgatcggtacttcgatgccggcttcgatgtcgataccctagatttggaagtacttaatggtcctgccctgttgatagatgttccaagggataaaaacattactgccgaggttatggagtctttgaaaataccaaagggagtacgtagagttcttttcagaacattaaatactgacaggcggctaatgtttaagaaagagtttgatacaagctacgttggatttatgaaggatggagcagagtggttggttaaacacactgacataaaacttattggaattgattacttatctgttgctgcctttgatgatttgattccatctcatatagttttcctagaagaccgggatatcattcttgtggaaggtttaaaactcgataacgttcaacctggaatatattcagtccattgcttaccattaagattgcttggtgctgaaggatcaccaacaagatgcattctcatcaaatgatgttgttgtccttgttactataaaagacttgagataagtgggtacgttttcaaggcaatgatgatgctaatggcacaccgtcatcttacaccgtcgtcttattaggcatgttgtttggaaagaggaaatgggcgggtgacattaagggtggtgtttgattggaacaaggcaaataacgggtttatgagttagaacttgacgctgttaggaatcctagaagggagcttcagtatagaaatttggttgcagtgaactacacttttcgtgtaatatatcattatgatatttcttttaagttcccttttatttcataaataataatacacttacgccatatttttggttggttggagt

SEQ ID NO: 5083 - protein, 277 aa, Gossypium hirsutum
  misc_feature (1)..(277): useful for making plants with increased salt and oxidative stress tolerance as described in USSN 12/282,342
  misc_feature (1)..(277): Ceres CLONE ID no. 1940431
  misc_feature (63)..(263): Pfam Name: Cyclase Pfam Description: Putative cyclase
  misc_feature (1)..(277): Functional Homolog of Ceres CLONE ID no. 8686 with e-value of 1.49E-86 and BLAST sequence identity of 72.1
MTPLHFFLLLLLSSAALISAAAATATTAYPSIPGTDSTTDCGLSGGDENPVPIRREVYGNGKIFDISHRYTVDMPSWESKDGVGQFLWLPKSMKNGSLANNSEMKLPTHTGTHLDAPGHVIDRYFDAGFDVDTLDLEVLNGPALLIDVPRDKNITAEVMESLKIPKGVRRVLFRTLNTDRRLMFKKEFDTSYVGFMKDGAEWLVKHTDIKLIGIDYLSVAAFDDLIPSHIVFLEDRDIILVEGLKLDNVQPGIYSVHCLPLRLLGAEGSPTRCILIK

SEQ ID NO: 5084 - DNA, 1349 bp, Glycine max
  misc_feature (1)..(1349): useful for making plants with increased salt and oxidative stress tolerance as described in USSN 12/282,342
  misc_feature (1)..(1349): Ceres CLONE ID no.1646125
aatatgtcgccgcctcaatttttcagaccaaaatgattttttaaaatttttttgtcattgttgtaaaaataacaaataataaataaaaaaattaaaaaataacattctgtcaagagatggatgtgtttcattcatctttgtgtttcattcatctttctcagtcaaccatgaactctcgatcactctttgccttcctcttcgcaatttgcgcgcactccgtcgccgttgccgacacctcctccgcgtatccttccatccccggcacggaaaccggtgagtgctccctccgcggcgtgggcgtgggcgacggtgttctggttcctccacggcgagaagtatacgaggaggggcgaatcttcgacatcactcacagatatgtccccgagatgccggtgtgggactcgacggaggggctcgggcaacacttcctgtggctcgataagagcatgaagaatggctcgctcgctaacagctctaacatgaagctcggtgttcacaccggcacccatgtcgacgcgcccggtcacttttacgacaattactacgacgctggcttcgacgttgactcactcgacctaacgctcctcaatggccttgcacttctggttgatgttccgcgggataaaaacattactgctgaggttatgaggtccctgaatatccctagaggtgtaagccgtgtgcttttcagaactttaaacactgacaggcgactcatgtttaagaaagaatttgacacaagctatgtgggattcaaggaggatggtgcaaaatggctggcagagaacactgacatcaaacttgtaggagttgattacttatctgttgctgcttatgatcactccattccatctcatcttgtttttctggaaagcaaggaaatcattcttgtggaaggcctaaagcttgatgatgtcccagcaggaatatattcattgaattgcttgcctcttaggttggttcactctgaggcatcaccaattcgatgtattctgatcagatgatccatgatggggtcaaacctggttttcaattgcacggatgaacctgccattagaagcaacgtagccccgaatacaattagtggtgtccataagaagcagtttgatgcaaattgcaagctaagctgatagtagtacgttgaaattactcgtattttacgtccttgggttgtaaactaccgagttattgtgattaaacttcagttgcggactaggggtccacctgtattaacttatgtttttaatatttacctaggcaagtacttgcgcaattctgaatacgcatgcttgtacgcctcaataattatatctatttctctatgaaaaataaaaaaaaaaaaaaaaaaa

SEQ ID NO: 5085 - protein, 278 aa, Glycine max
  misc_feature (1)..(278): useful for making plants with increased salt and oxidative stress tolerance as described in USSN 12/282,342
  misc_feature (1)..(278): Ceres CLONE ID no. 1646125
  misc_feature (63)..(264): Pfam Name: Cyclase Pfam Description: Putative cyclase
  misc_feature (1)..(278): Functional Homolog of Ceres CLONE ID no. 8686 with e-value of 5.39E-84 and BLAST sequence identity of 71.3
MNSRSLFAFLFAICAHSVAVADTSSAYPSIPGTETGECSLRGVGVGDGVLVPPRREVYEEGRIFDITHRYVPEMPVWDSTEGLGQHFLWLDKSMKNGSLANSSNMKLGVHTGTHVDAPGHFYDNYYDAGFDVDSLDLTLLNGLALLVDVPRDKNITAEVMRSLNIPRGVSRVLFRTLNTDRRLMFKKEFDTSYVGFKEDGAKWLAENTDIKLVGVDYLSVAAYDHSIPSHLVFLESKEIILVEGLKLDDVPAGIYSLNCLPLRLVHSEASPIRCILIR

SEQ ID NO: 5086 - DNA, 953 bp, Panicum virgatum
  misc_feature (1)..(953): useful for making plants with increased salt and oxidative stress tolerance as described in USSN 12/282,342
  misc_feature (1)..(953): Ceres CLONE ID no.1759790
acgtgtcaactgcacttccagaaaggcaaatccattccatggagctcgcgccgctgctcctgctccccccgctgctgctgctcccggcggcggccgtcgcctccggcggtgagccgccgctggcgcacccggcctatgcgcgcggcgccgaggaggcatgcggcgtggcggcgctgccagcgccggagcggcgcgaggagttcgacggcgggcggatcgtggacatcagccactactaccgcgcggacatgccggcgtgggagtcggcggagggctccggcgagttcctgcggctggcgcggtccatgcgcaacggctccgacatcgccaacttctcggagctccgcctcaccgcgcactccggcacccacgtcgacgcgccggggcacgtcttcgagcactactacgacaccggcttcgacgtcgacacgctcgacctcgccgtcctcaacgggccagcgctgttggttgacgttccccgagataagaacataacaggtgttcgacgtgtactcttccgaaccttaaatactgacagaaagcttatgtggaagaaagagtttgatactagttatgttggcttcatgaaggatggtgcacaatggctggtcgacaatactgacatcaaactagttggagttgattacttgtctgtgggtgcatttgacgaatgcattccagctcatctagtatttcttgaaaaaagggaggtaatccttgtggaagccttaaatctggagcatgctacccctggaatatatgccttgcattgcttgccactaagattgcgtggtgctgaaggttctcctgcaaaatgcatccttatcaagtgacacatggttacaaccatctagaaaacctttgtactatcttatggcacgtatgataatgaaataagaaaaggtcaacgcatatgacttcttctcttgcatcaaaaaaaaaaaaaaaaaaaa

SEQ ID NO: 5087 - protein, 264 aa, Panicum virgatum
  misc_feature (1)..(264): useful for making plants with increased salt and oxidative stress tolerance as described in USSN 12/282,342
  misc_feature (1)..(264): Ceres CLONE ID no. 1759790
  misc_feature (60)..(250): Pfam Name: Cyclase Pfam Description: Putative cyclase
  misc_feature (1)..(264): Functional Homolog of Ceres CLONE ID no. 8686 with e-value of 8.09E-74 and BLAST sequence identity of 68.2
MELAPLLLLPPLLLLPAAAVASGGEPPLAHPAYARGAEEACGVAALPAPERREEFDGGRIVDISHYYRADMPAWESAEGSGEFLRLARSMRNGSDIANFSELRLTAHSGTHVDAPGHVFEHYYDTGFDVDTLDLAVLNGPALLVDVPRDKNITGVRRVLFRTLNTDRKLMWKKEFDTSYVGFMKDGAQWLVDNTDIKLVGVDYLSVGAFDECIPAHLVFLEKREVILVEALNLEHATPGIYALHCLPLRLRGAEGSPAKCILIK

SEQ ID NO: 5088 - DNA, 1029 bp, Triticum aestivum
  misc_feature (1)..(1029): useful for making plants with increased salt and oxidative stress tolerance as described in USSN 12/282,342
  misc_feature (1)..(1029): Ceres CLONE ID no.741003
agcaccacctactagcccacacatatccgcgacgccgatgccccaaatggcgtctcctctcctcctcctccctctcgccgccgccaccgcaccgtgcgcccatccggcctacccgagccagccggcgtcgtgcgccgcggagcccgcgctggcgccggagcgccgggagacgcacggcgggggccgcatcctggacatcacccactactaccgggaggacatgccctcgtgggagtccagcgccggggtgggccagttcctgtggctgcccgcctccatgcgcaacggctccctcgccaacaactccgagatgcggatgcccacccacaccggcacccacgtcgacgcccccggccacgtcttccagcactacttcgacgctggcttcgacgtcgacaccctcgacctcgacgtcctcaacggtcctgcactgctggttgatgttccaagggatcaaaatattactgctaaaacgatggaatctttgcatattcctaaaggagttcaacgggtacttttcagaacattaaacactgacaggaacctaatgtggaagaaagagtttgacacaagctatgtaggttttatgaaagatggtgcccaatggttggtagacaacacggatattaagcttgtcggaatagactatttgtccgttgcagctttcgatgacctgatcccttcacatttagtttttctcgaaaaccgggatgtcattcttgtggagggcctcaaactggagaatgtcaaacctgggatatactcgttgcattgcctgccacttcggttgcgtggagcggaaggttcgccgatcagatgcatccttataaagtgaagacacttgtatcccgctgcgatttagttttataccgcaagcactcttataaactagactagagatgtgtacaaaaccccatctttgatagcggacgagtattgtaaatgtctccacaaacatggtggcactttgacgcttagtaaggagcgacaaacgactaggggtgcaaatgtgtaaaaaaaaaaaaaaaa

SEQ ID NO: 5089 - protein, 265 aa, Triticum aestivum
  misc_feature (1)..(265): useful for making plants with increased salt and oxidative stress tolerance as described in USSN 12/282,342
  misc_feature (1)..(265): Ceres CLONE ID no. 741003
  misc_feature (51)..(251): Pfam Name: Cyclase Pfam Description: Putative cyclase
  misc_feature (1)..(265): Functional Homolog of Ceres CLONE ID no. 8686 with e-value of 9.39E-80 and BLAST sequence identity of 67.2
MPQMASPLLLLPLAAATAPCAHPAYPSQPASCAAEPALAPERRETHGGGRILDITHYYREDMPSWESSAGVGQFLWLPASMRNGSLANNSEMRMPTHTGTHVDAPGHVFQHYFDAGFDVDTLDLDVLNGPALLVDVPRDQNITAKTMESLHIPKGVQRVLFRTLNTDRNLMWKKEFDTSYVGFMKDGAQWLVDNTDIKLVGIDYLSVAAFDDLIPSHLVFLENRDVILVEGLKLENVKPGIYSLHCLPLRLRGAEGSPIRCILIK

SEQ ID NO: 5090 - protein, 269 aa, Oryza sativa subsp. japonica; identical to SEQ ID NO: 4992
  misc_feature (1)..(269): useful for making plants with increased salt and oxidative stress tolerance as described in USSN 12/282,342
  misc_feature (1)..(269): Public GI ID no.. 35215089
  misc_feature (55)..(255): Pfam Name: Cyclase Pfam Description: Putative cyclase
  misc_feature (1)..(269): Functional Homolog of Ceres CLONE ID no. 8686 with e-value of 1.90E-79 and BLAST sequence identity of 66.2

SEQ ID NO: 5091 - protein, 270 aa, Oryza sativa subsp. japonica
  misc_feature (1)..(270): useful for making plants with increased salt and oxidative stress tolerance as described in USSN 12/282,342
  misc_feature (1)..(270): Public GI ID no.. 115475854
  misc_feature (56)..(256): Pfam Name: Cyclase Pfam Description: Putative cyclase
  misc_feature (1)..(270): Functional Homolog of Ceres CLONE ID no. 8686 with e-value of 1.90E-79 and BLAST sequence identity of 66.2
MMAHLAPLFLLLLLLLLPLHAAATPSAHPAYPNEPPSCAAAVPVPERREAHGGGRILDITHYYREDMPSWESDGGVGQFLWLPASMRNGSRANNSEMRLPTHTGTHVDAPGHVFQHYFDAGFDVDSLDLEVLNGLALLVDVPRDDNITAKMMESLHIPKGIQRVLFRTLNTDRQLMWKKEFDTSYVGFMEDGAQWLVDNTDIKLVGIDYLSVAAFDDLIPSHLVLLKNRDIILVEGLKLENIMPGIYSLHCLPLRLRGAEGSPIRCILIK

SEQ ID NO: 5092 - DNA, 909 bp, Populus balsamifera subsp. trichocarpa
  misc_feature (1)..(909): useful for making plants with increased salt and oxidative stress tolerance as described in USSN 12/282,342
  misc_feature (1)..(909): Ceres ANNOT ID no.1450986
atggagggaaattttgcacaaagaatgcaaatttcgacaacatggattgatacaggcaatcttgcaagaaaaccaactggttttctacggttttcggggagattaaaggaacagaagagactccaagtgtttgtttctgctcagtttcgacctgtaagagatgaaaatcgacatagattggcttcttttgaggtttctcgctcttataacaattctcgagtttcgacgttggaatctgagagtctccaggatttgcttgacgatgaagctttgattttgaagaataagtcgcaggagattgagccctatttaaacggacgctgtatatatcttgttggaatgatgggctctggaaaaacaacagtgggaaagattctctcgcaagcaattcattattcattctgtgacagtgacacattggtggagaaggatgttggtgtgacttctgtagctgaaatatttcaaatatatggagaggatttcttcagagataaagagactgaggcattagaaaagctatcactagagcaccgatatgtcgtttctactggtggaggtgctgtgatacaggatgaaaactggacgtacatgaggaaggggattagtgtctggttagatgtgcctttggaagaattggcacagaggattgcggctgtaggaaccaagactcgcccccttttggatagagaaccaggagatgcatacaccaaggcgttcaggcgtctgtctgctctgtttgaacagagatataaagcttatgaaaatgctaatgcaagggtttctctggaaaatattgcagccaaattaggatataaagatgtatccaatatcacaccacctatgattgcgattgagaacatggcttgggtgatgcattacgcagcaggtttccgtctattaccagtgtaa

SEQ ID NO: 5093 - protein, 302 aa, Populus balsamifera subsp. trichocarpa
  misc_feature (1)..(302): useful for making plants with increased salt and oxidative stress tolerance as described in USSN 12/282,342
  misc_feature (1)..(302): Ceres ANNOT ID no. 1450986
  misc_feature (115)..(291): Pfam Name: SKI Pfam Description: Shikimate kinase
  misc_feature (1)..(302): Functional Homolog of Ceres CDNA ID no. 23363195 at SEQ ID NO: 5005 with e-value of 2.09E-73 and BLAST sequence identity of 55.9
MEGNFAQRMQISTTWIDTGNLARKPTGFLRFSGRLKEQKRLQVFVSAQFRPVRDENRHRLASFEVSRSYNNSRVSTLESESLQDLLDDEALILKNKSQEIEPYLNGRCIYLVGMMGSGKTTVGKILSQAIHYSFCDSDTLVEKDVGVTSVAEIFQIYGEDFFRDKETEALEKLSLEHRYVVSTGGGAVIQDENWTYMRKGISVWLDVPLEELAQRIAAVGTKTRPLLDREPGDAYTKAFRRLSALFEQRYKAYENANARVSLENIAAKLGYKDVSNITPPMIAIENMAWVMHYAAGFRLLPV

SEQ ID NO: 5094 - DNA, 1392 bp, Gossypium hirsutum
  misc_feature (1)..(1392): useful for making plants with increased salt and oxidative stress tolerance as described in USSN 12/282,342
  misc_feature (1)..(1392): Ceres CLONE ID no.1973421
ctctccgttatttggatctgatgttgattttatgttttaaagtgctttgttttcagtttttttttttggtgaagtagagcacataatttcagcattgcatgcaacttcaatctgaatttagggtttttattatgaaccgaacccgttttgcaaagatttaaaactatgggatctgcaagttatctgaaatagtcttcatttctcttggagtcagagagcaaagcccttcacaaaattcattttctctttattaattatccaaggggctgagaatggaggctggagttgcatgcaagttgaattatccgacatggattgagtcagaaaggtttgggaggaactcgactggtactttgcggttcagtcggatagcaaagcaagaacacaaggcccggctggttgtttcggcgcactttccggttctgacatcttctaatcggtttagatcggtctctttcgaggtttcctgctcttcctctaagaacttttcagcttcaacaattgaaactggtagcgttcatgcaccttatgatgaagctttagtgttaaagaataagtcactagaggttgagccatatttaaatgggcacagtatatatcttgttggattgatgggttctggaaaaactacagtgggaaaaattctgtctaacgtactcagttattcattttgtgacagtgacgtgttaatagagcaggaggtgaatggaatgtctgtagccgaagtatttaagcttcatggtgagagattcttcagaaagaaggagactgaggtattgcagaggctctcttcaaagaaacagcttgttgtttctactggcggaggtgcagttgtatgggatgtgaactgggattatatgcaaaagaagggggttgttgtctggttagatgtacctttggaagccttggcacagaggattgctgcagtaggtactcattctcgtccccttttgcattatgaacatggcgatccctatacaaaggctttaaaacggctgtcttaccttttggaactgaggggtaaaaattatgctaaagcaaatgcccgggtttcattgaaagaaattgcaggcaaactaggttatagagatgtatcagatcttactccaacagagattgcaatcgaggcattgcaacaaattgaagggtatctaaaggaggaaggtggcatggtcattgctggattatagttttgaaaaagctatagatatggtgattgaatttcgttttatttgtggcatagcatgtcaaaattgaccagtttttttttccatctctgcaccggtgtagtttgtttccacaactaagttgtgtaactcacaatgtattgtcactaaatatcatgaacatgatgcacttgtatatgtttgcctaattcatttttgttttagt

SEQ ID NO: 5095 - protein, 305 aa, Gossypium hirsutum
  misc_feature (1)..(305): useful for making plants with increased salt and oxidative stress tolerance as described in USSN 12/282,342
  misc_feature (1)..(305): Ceres CLONE ID no. 1973421
  misc_feature (114)..(291): Pfam Name: SKI Pfam Description: Shikimate kinase
  misc_feature (1)..(305): Functional Homolog of Ceres CDNA ID no. 23363195 at SEQ ID NO: 5005 with e-value of 2.90E-78 and BLAST sequence identity of 55.8
MEAGVACKLNYPTWIESERFGRNSTGTLRFSRIAKQEHKARLVVSAHFPVLTSSNRFRSVSFEVSCSSSKNFSASTIETGSVHAPYDEALVLKNKSLEVEPYLNGHSIYLVGLMGSGKTTVGKILSNVLSYSFCDSDVLIEQEVNGMSVAEVFKLHGERFFRKKETEVLQRLSSKKQLVVSTGGGAVVWDVNWDYMQKKGVVVWLDVPLEALAQRIAAVGTHSRPLLHYEHGDPYTKALKRLSYLLELRGKNYAKANARVSLKEIAGKLGYRDVSDLTPTEIAIEALQQIEGYLKEEGGMVIAGL

SEQ ID NO: 5096 - protein, 287 aa, Oryza sativa subsp. japonica
  misc_feature (1)..(287): useful for making plants with increased salt and oxidative stress tolerance as described in USSN 12/282,342
  misc_feature (1)..(287): Public GI ID no.38344899
  misc_feature (100)..(276): Pfam Name: SKI Pfam Description: Shikimate kinase
  misc_feature (1)..(287): Functional Homolog of Ceres CDNA ID no. 23363195 at SEQ ID NO: 5005 with e-value of 3.39E-66 and BLAST sequence identity of 55.5
MDAGVGLRAKPGAWAGLGNPRRSSTARVPVRFAVEKFAQPLVLGSDRRSCGAKLKVSCSRKPAGIDKTYYSADEALVLKQKAEDVVPYLNDRCIYLVGMMGSGKTTVGKILAEVLGYSFFDSDKLVEKAVGISSVAEIFQLHSEAFFRDNESEVLRDLSSMHRLVVATGGGAVIRPINWSYMKKGSTIWLDVPLDALARRIAAVGTASRPLLHQESGDPYAKAYAKLTALFEQRMDSYANADARVSLEHIAVKQGHSNVTTLTPSAIAIEALLKMESFLTEKAMIRN

SEQ ID NO: 5097 - protein, 300 aa, Lycopersicon esculentum
  misc_feature (1)..(300): useful for making plants with increased salt and oxidative stress tolerance as described in USSN 12/282,342
  misc_feature (1)..(300): Public GI ID no. 114200
  misc_feature (113)..(288): Pfam Name: SKI Pfam Description: Shikimate kinase
  misc_feature (1)..(300): Functional Homolog of Ceres CDNA ID no. 23363195 at SEQ ID NO: 5005 with e-value of 6.80E-77 and BLAST sequence identity of 54.7
MEARVSQSLQLSSWINSDKVVRKPSGLLRFSEKWNEKPRHRVVVSCHLQPRKAAHSDRRVQLKVSCSPQNVQASVLESGCFSASIDEIETLKNKAEEVEEYLDGRCVYLVGMMGCGKTTVGRILAETLGYSFFDCDRLIEQAVGGITVAEIFELRGESFFRDNETEVLHKLSLMHRLVVSTGGGAVVRPINWRHMHKGISVWLDVPLEALAKRITTEGTKSRPLLHEESGDVYDTTLKRLTTLMETRGENYANASARVSLENIALKREKDVCHITPAEITLEVLIQIENFLKTQKSVVVL

SEQ ID NO: 5098 - DNA, 1248 bp, Panicum virgatum
  misc_feature (1)..(1248): useful for making plants with increased salt and oxidative stress tolerance as described in USSN 12/282,342
  misc_feature (1)..(1248): Ceres CLONE ID no.1769327
ctccttcaattccctctcatctcgcgtctccgcacggagagccgccctcctcgtccgccgccgcctgccgccggcgagctcttcattaccccggcgatggccggcctatccaaaaccaccatcaccaatcacgtctagcacatctcgcccgagcggctgagccacacgtcacagcaacacatcaagccgcgcggatcgacaggaagatggaggcgagcgtgggcatccgggcgcggcccggtgcgtgggccgggctcgagaagccgcgcggcgcttgctctgcaagagtcccggcggcggggctcacggcggagaagctgccggcgaggctggctctgggaaccgatccgcggaggagcacggatcctgtgctccgtgccgcaaagatgaaagcttcgtgttgcaagaaatcgacaggtactgaaaaggtccactactctgccgatgaagctctcatactacagcaaaaagcccaggatgttctcccttacttggatggccgatgcatttatctagtcggaatgatgggttcaggcaaaactacagttgagaagatattagctgaagtactaggttattctttcttcgacagtgataagttggtagagaaggctgtcggtatatcatctgttgctgagatttttcagctccacagtgaagcattcttcagagataatgagagtgaggtcctaagggatttgtcatcaatgcatcggttagttgttgcaactggaggtggtgccgtgatccgaccaatcaattggagttacatgaagaaagggctgactgtgtggttagatgttccactggatgcacttgcaagaaggattgctgccgtgggaactgcatctcggcccctcttgcatcaggaatctggtgacccatatgcaaaggcttatgcaaaacttacatcactttttgagaaaagaatggactcgtatgctaatgcggatgccagagtttcacttgaacatattgcattaaaacaagggcataatgatgtcactatacttacacctagtaccattgccattgaggcattattaaagatggaaagttttcttactgagaaggccatggtcagaaactgaccgcttgttgctggggaaaagggcaccaacagcatatggcccctgtttgtttaattgtgcttgtacatatgcctttgcatgagctctttacagtactgttagattgttgttcatgcaacatgaaagatgattattcgaaaaaaaaaaaaaaaaaaaa

SEQ ID NO: 5099 - protein, 294 aa, Panicum virgatum
  misc_feature (1)..(294): useful for making plants with increased salt and oxidative stress tolerance as described in USSN 12/282,342
  misc_feature (1)..(294): Ceres CLONE ID no. 1769327
  misc_feature (107)..(282): Pfam Name: SKI Pfam Description: Shikimate kinase
  misc_feature (1)..(294): Functional Homolog of Ceres CDNA ID no. 23363195 at SEQ ID NO: 5005 with e-value of 2.79E-64 and BLAST sequence identity of 53.0
MEASVGIRARPGAWAGLEKPRGACSARVPAAGLTAEKLPARLALGTDPRRSTDPVLRAAKMKASCCKKSTGTEKVHYSADEALILQQKAQDVLPYLDGRCIYLVGMMGSGKTTVEKILAEVLGYSFFDSDKLVEKAVGISSVAEIFQLHSEAFFRDNESEVLRDLSSMHRLVVATGGGAVIRPINWSYMKKGLTVWLDVPLDALARRIAAVGTASRPLLHQESGDPYAKAYAKLTSLFEKRMDSYANADARVSLEHIALKQGHNDVTILTPSTIAIEALLKMESFLTEKAMVRN

SEQ ID NO: 5100 - DNA, 745 bp, Musa acuminata
  misc_feature (1)..(745): useful for making plants with increased salt and oxidative stress tolerance as described in USSN 12/282,342
  misc_feature (1)..(745): Ceres CLONE ID no.1728680
gctctcgtcgctaccgcaatggcagcatcacatggttggctcacttctctgcccaaccaattggctgtcgcaagctctgtcgtcaaccatcgatccgctgcggctgcttcgttcgtcgtcagggcgagctcgacggatgcatcacttacggagaaggattgtttaaggagaaggcaggttttagttggactcagttccttgaccgctgctttgtcccgggcaaattttgcaagtgctgaagatataccggagaattttcgagctttcgtggattttacagatggatatgcatactattatccttccgattggagagattttgattacatgggccatgattcagcatttaaagatcgatttgcagcattgcaacatgtcagagtcagtttcattcctaccgaaaagaaagatattcgtgatttgggatccatggaggaggtcattttcaacttggtaaaaaatatttatgctgcaccaaatcagattccgagcatatatgagatgcaggagcgaactgtcgatggaaagaactattggacattcgaatacgaacttgaatccccaagcttttcccgtactgcctttgcgacaatagctattggcaatgggcggtactacacattagttgttggtgcaaatgagaggcggtggactagacttcggaacaagctcaaggtggtagcagactctttcaagattcttgacatatgaaactagaagtgcttgcctgccgaaccatgagtcc

SEQ ID NO: 5101 - protein, 230 aa, Musa acuminata
  misc_feature (1)..(230): useful for making plants with increased salt and oxidative stress tolerance as described in USSN 12/282,342
  misc_feature (1)..(230): Ceres CLONE ID no. 1728680
  misc_feature (48)..(228): Pfam Name: PsbP Pfam Description: PsbP
  misc_feature (1)..(230): Functional Homolog of Ceres CLONE ID no. 16403 at SEQ ID NO: 5045 with e-value of 1.10E-58 and BLAST sequence identity of 60.2
MAASHGWLTSLPNQLAVASSVVNHRSAAAASFVVRASSTDASLTEKDCLRRRQVLVGLSSLTAALSRANFASAEDIPENFRAFVDFTDGYAYYYPSDWRDFDYMGHDSAFKDRFAALQHVRVSFIPTEKKDIRDLGSMEEVIFNLVKNIYAAPNQIPSIYEMQERTVDGKNYWTFEYELESPSFSRTAFATIAIGNGRYYTLVVGANERRWTRLRNKLKVVADSFKILDI

SEQ ID NO: 5102 - DNA, 842 bp, Gossypium hirsutum
  misc_feature (1)..(842): useful for making plants with increased salt and oxidative stress tolerance as described in USSN 12/282,342
  misc_feature (1)..(842): Ceres CLONE ID no.1807796
atggcagtggcaatggcgatgaattcagtttcattgaactgggttccaccttcctttacaaagaaggcaaattatgtgacaaactccactgagctagccccaccttctgctttttcttcgcaaaactcactcacgtacaccaaagaaaccatttccaatgaagaaaacaattgcaagagaagactgttgctcttgggtgttggagttattacagctaatttactccctgcaaattcccttctagcagaagagataccacaaaactatcgagcttttgttgacattccagatgggtattcttattactacccatcagattggagggaatttgattttaggggacatgattcagcattcaaagacaggtttcttcaactgcaaaatgtaagggtgagattcataccaactgataagcaagacatccatgagttggggccaatagaagaggttgtttacaatttggtgaatcatgtttatgctgcaccaaatcaaatggtcaatatacttgatatgcaagagagaacaagtgatgggaaaaactattatacctttgaatatgaactcacctctccaaactatgctagtgcttcctttgcaacaatagctattggaaatgggagatattacacactggttgttggagcacttgaaagacggtggagaaggcttcgaaacaagctgaaagtggtggccgactccttcaaggtgcttgacatctgatgaccccccaacttatcttttcattgtatataaaccccgaaacataccattggttttgtttagttgagcgtcatcgtcaactttaactatttctccttcttcaaaaaaaaaaaaaaaaaaaa

SEQ ID NO: 5103 - protein, 235 aa, Gossypium hirsutum
  misc_feature (1)..(235): useful for making plants with increased salt and oxidative stress tolerance as described in USSN 12/282,342
  misc_feature (1)..(235): Ceres CLONE ID no. 1807796
  misc_feature (51)..(233): Pfam Name: PsbP Pfam Description: PsbP
  misc_feature (1)..(235): Functional Homolog of Ceres CLONE ID no. 16403 at SEQ ID NO: 5045 with e-value of 5.30E-70 and BLAST sequence identity of 59.1
MAMNSVSLNWVPPSFTKKANYVTNSTELAPPSAFSSQNSLTYTKETISNEENNCKRRLLLLGVGVITANLLPANSLLAEEIPQNYRAFVDIPDGYSYYYPSDWREFDFRGHDSAFKDRFLQLQNVRVRFIPTDKQDIHELGPIEEVVYNLVNHVYAAPNQMVNILDMQERTSDGKNYYTFEYELTSPNYASASFATIAIGNGRYYTLVVGALERRWRRLRNKLKVVADSFKVLDI

SEQ ID NO: 5104 - DNA, 883 bp, Panicum virgatum
  misc_feature (1)..(883): useful for making plants with increased salt and oxidative stress tolerance as described in USSN 12/282,342
  misc_feature (1)..(883): Ceres CLONE ID no.1771837
ataactgatgctgggatacaagcgtcagagaacacttcctcgagctcagtgctatcctaaactactgaagaaatggcaagcctgcagaatctgatttgctccgtatctaaacaactggttgcgccaaattttgcggtgactgccaaactgaatggggcttctcactctgttgtcccagcaagctcaagcggagcatcttcgcatgaaaagaatgtcacgaaaaggcagttagctttgcttggtgctggagcattagccaccggcctactgaagacaagctccgcatttgctgaagaagtacctaagaattacaagtcttacgtggatgcaaaagatggatattcgtatctttatccagccgagtggagggatttcgacttcttgggtcatgattcagcattcaaagatcgtaatctggctcttcagtgtgtccgtgtggggtttattcctactgataaaacagatattcgcgacctaggaccaatggatgaggccatcttcaatttggtaaacaacgtttacgctgccccaaatcaaaaaccgtcgatctatgacatgcaagagcgcacggtggacggcaagaactactggacgttcgagtacgatctggaggctccgggctacggcgtatccgcgttcgcgacagtcgccattggaaacggtcggtactacacgctgatcgtgaccgcgaacgaacgccggtggagcaggctccggaacaggctcaaagtcgtcgcggactctttcaagatctccgacctgaccgcgtgaccgccagcgttctcgttaactgtaatggacggtctcattcagtcatggtatatatacttacgcgcgccataatcgtgcgtgtttcatttgctaaaaaaaaaaaaaaaaaaaa

SEQ ID NO: 5105 - protein, 232 aa, Panicum virgatum
  misc_feature (1)..(232): useful for making plants with increased salt and oxidative stress tolerance as described in USSN 12/282,342
  misc_feature (1)..(232): Ceres CLONE ID no. 1771837
  misc_feature (73)..(228): Pfam Name: PsbP Pfam Description: PsbP
  misc_feature (1)..(232): Functional Homolog of Ceres CLONE ID no. 16403 at SEQ ID NO: 5045 with e-value of 6.49E-56 and BLAST sequence identity of 52.3
MASLQNLICSVSKQLVAPNFAVTAKLNGASHSVVPASSSGASSHEKNVTKRQLALLGAGALATGLLKTSSAFAEEVPKNYKSYVDAKDGYSYLYPAEWRDFDFLGHDSAFKDRNLALQCVRVGFIPTDKTDIRDLGPMDEAIFNLVNNVYAAPNQKPSIYDMQERTVDGKNYWTFEYDLEAPGYGVSAFATVAIGNGRYYTLIVTANERRWSRLRNRLKVVADSFKISDLTA

SEQ ID NO: 5106 - DNA, 841 bp, Gossypium hirsutum
  misc_feature (1)..(841): useful for making plants with increased salt and oxidative stress tolerance as described in USSN 12/282,342
  misc_feature (1)..(841): Ceres CLONE ID no.1853106
aagcacggattcaaagtgataaaaaaaaaatccttcattttgcaggaaaaaaaatggctgatttggattcttcaagctcttcctctgaagatattgaaacaaactctgatcctaattcgtcaaaagctataatccccaatcctctcaattccaattctaattcacctgccgtatgcctcctccaattcgcaggagactccaccgctggtgccttcatgggctccatcttcggctacggttcgggattgattaaaaagaagggttttaaaggatcctttgtggaggctggatcttatgccaagacatttgcagttttgtcgggtgtacacagtttggtcgtttgcttcttgaagaggttgcggggaaaagatgatgttattaatgctggggtagctggatgttgcactgggcttgctctaagtttcccaggtgcaccccaggcacttatacagagctgtctcacatttggggcattctcatttatcgttgaagggcttaacaagcagcagccagcattggcacattcattttctgtgagaaacaagagcgggcactatgaggggcctcatcctatagcgctccctctttcactccctattccagatgagctgaaaggagctttttcttctttctgcaggtccttaagtaaaccaaatgaaggcaagttttctactggtaactgatgggaaggggccattcatcagtgttaatcgtctgttatatgtagattgttgattgttgcgagtgttgggagttacaatgtaagaatgtagaatcaaaattatctgagagctaggaaatgggaaattgttttttgtcctaaaaaaaaaaaaaaaaaaaa

SEQ ID NO: 5107 - protein, 209 aa, Gossypium hirsutum
  misc_feature (1)..(209): useful for making plants with increased salt and oxidative stress tolerance as described in USSN 12/282,342
  misc_feature (1)..(209): Ceres CLONE ID no. 1853106
  misc_feature (34)..(152): Pfam Name: Tim17 Pfam Description: Tim17/Tim22/Tim23 family
  misc_feature (1)..(209): Functional Homolog of Ceres CLONE ID no. 965405 at SEQ ID NO: 5071 with e-value of 5.20E-63 and BLAST sequence identity of 71.4
MADLDSSSSSSEDIETNSDPNSSKAIIPNPLNSNSNSPAVCLLQFAGDSTAGAFMGSIFGYGSGLIKKKGFKGSFVEAGSYAKTFAVLSGVHSLVVCFLKRLRGKDDVINAGVAGCCTGLALSFPGAPQALIQSCLTFGAFSFIVEGLNKQQPALAHSFSVRNKSGHYEGPHPIALPLSLPIPDELKGAFSSFCRSLSKPNEGKFSTGN

SEQ ID NO: 5108 - DNA, 867 bp, Gossypium hirsutum
  misc_feature (1)..(867): useful for making plants with increased salt and oxidative stress tolerance as described in USSN 12/282,342
  misc_feature (1)..(867): Ceres CLONE ID no.1899181
aggcacgtcgagaaagggggaaaaggaactcatagtagtttttggacaaaaatggctacttcggattctccaaacacttcagctggatctgatattgaaacaaaccctaatcctaattcttcaaaagccataatcctaacaccatccaattccaattcccctgccgtatgcctcttccaattcgcaggagactccgccgccggtgccttcatgggctccatctttggctacgggtcaggattgattaaaaagaaaggctttaaaggatcctttgtggaggcaggatcttacgccaagacatttgcagttttgtccggcgttcacagtttggttgtttgctttttgaagaggcttcggggaaaagatgatgttattaatgccggtgtagccggatgctgcactggacttgctctaagtttcccaggtgcacctcaggcacttctacagagctgtctcacctttggggcattctcatttatcatcgaagggcttaacaagcagcagccagcattggcacattcattttctgcgagaaacaagagtgcacaccacaagggacctcgtcctttagcactacccctttctatccctattccggatgagctgaaaggagctttttcttcgttctgcaagtccttggtaaaaccaaataaaggtaggtttcctacaggtaactaagtagtaggtggaccatttttcatttttcctgttgtttgtagaattttgcaagtgttgagaatgtagactgaaagttttgtctgagatttgaagctttttacaagcagaaagatgaaattgcttcttttcttgtgttgattcaattatattatctgtctggttcagtagtaaaaaaaaaaaaaaaaaaaa

SEQ ID NO: 5109 - protein, 208 aa, Gossypium hirsutum
  misc_feature (1)..(208): useful for making plants with increased salt and oxidative stress tolerance as described in USSN 12/282,342
  misc_feature (1)..(208): Ceres CLONE ID no. 1899181
  misc_feature (33)..(151): Pfam Name: Tim17 Pfam Description: Tim17/Tim22/Tim23 family
  misc_feature (1)..(208): Functional Homolog of Ceres CLONE ID no. 965405 at SEQ ID NO: 5071 with e-value of 4.09E-63 and BLAST sequence identity of 71.2
MATSDSPNTSAGSDIETNPNPNSSKAIILTPSNSNSPAVCLFQFAGDSAAGAFMGSIFGYGSGLIKKKGFKGSFVEAGSYAKTFAVLSGVHSLVVCFLKRLRGKDDVINAGVAGCCTGLALSFPGAPQALLQSCLTFGAFSFIIEGLNKQQPALAHSFSARNKSAHHKGPRPLALPLSIPIPDELKGAFSSFCKSLVKPNKGRFPTGN

SEQ ID NO: 5110 - DNA, 919 bp, Panicum virgatum
  misc_feature (1)..(919): useful for making plants with increased salt and oxidative stress tolerance as described in USSN 12/282,342
  misc_feature (1)..(919): Ceres CLONE ID no.1758700
ggaacacgataacgagacggcaggtgggggaggagccgaggagggcttcaggggtttcagggcggagaggagaagatggcggcgaagcgcgagaccgagtcggacggcgaagagctcggcggcgaggcctccaaccctgcgagcggtggcgcgactccgccgcccctagccgcagctcccgtcgtctgcctcctccgctccgctggggacttcgccggcggcgccttcgtcggatccatcgtcggatatggacaaggcctgatcactaagaaaggtttcaagggttcattcagcaatgctgggtcctctgctaagacttttgcagttctatctggggtccagagtttggttgtgtgcttgctgagaaggctgcgtgggaaagatgacattgtcaatgctggtatagctggttgttgcactggcattgctttgagcttcccaggagcaccacaagcgttgcttcagagctgtgccacctttgcagcgttttcttgcatcatggaggggctcaacaagcagcaggctgcaatggctcacactcttggcacaactgcattgacggttgcgcatgataaaggaggtgtactgcccccattcacgcttccaccaattctggatgcatcagatgctttagcttcatgctgccaagccttagtaaagcctaagcactagactacaggataggggagagagacatgctgaagaaagatagcttcagttttcatttctttattatgttgacctagcatatctgcatatgtaaattttgcttctggacaagctgtggaacgtgcctaaaacctagttttgctttgagcaactggacaggttttcttgatgtgttcgtgttgcgaattccgctggttctggcattattaaaatcataaatacttgcctcgaaaaaaaaaaaaaaaaaaaa

SEQ ID NO: 5111 - protein, 198 aa, Panicum virgatum
  misc_feature (1)..(198): useful for making plants with increased salt and oxidative stress tolerance as described in USSN 12/282,342
  misc_feature (1)..(198): Ceres CLONE ID no. 1758700
  misc_feature (31)..(149): Pfam Name: Tim17 Pfam Description: Tim17/Tim22/Tim23 family
  misc_feature (1)..(198): Functional Homolog of Ceres CLONE ID no. 965405 at SEQ ID NO: 5071 with e-value of 3.10E-49 and BLAST sequence identity of 62.4
MAAKRETESDGEELGGEASNPASGGATPPPLAAAPVVCLLRSAGDFAGGAFVGSIVGYGQGLITKKGFKGSFSNAGSSAKTFAVLSGVQSLVVCLLRRLRGKDDIVNAGIAGCCTGIALSFPGAPQALLQSCATFAAFSCIMEGLNKQQAAMAHTLGTTALTVAHDKGGVLPPFTLPPILDASDALASCCQALVKPKH

SEQ ID NO: 5112 - protein, 203 aa, Oryza sativa subsp. japonica
  misc_feature (1)..(203): useful for making plants with increased salt and oxidative stress tolerance as described in USSN 12/282,342
  misc_feature (1)..(203): Public GI ID no. 108706643
  misc_feature (35)..(153): Pfam Name: Tim17 Pfam Description: Tim17/Tim22/Tim23 family
  misc_feature (1)..(203): Functional Homolog of Ceres CLONE ID no. 965405 at SEQ ID NO: 5071 with e-value of 7.40E-48 and BLAST sequence identity of 59.0
MAAKRGSESDGDELGGGGAAEGTSPNDGGASPPPLAAAPAVCFIRSAGDFAGGAFIGSIVGYGQGLFTKKGFKGSFSTAGSSAKTFAVLSGVQSLVVCLLRRLRGKDDIVNAGIAGCCTGLALSFPGTPQALLQSCATFAAFSCIMEGLNKQQAAMAQTLGGSALTVSHQNGGVLPPFTLPPLLDASDALSSCCQPLVLKPKH

SEQ ID NO: 5113 - DNA, 1066 bp, Brassica napus
  misc_feature (1)..(1066): useful for making plants with increased salt and oxidative stress tolerance as described in USSN 12/282,342
  misc_feature (1)..(1066): Ceres CLONE ID no. 1096546
  misc_feature (34)..(34): m is a or c
  misc_feature (205)..(205): y is t/u or c
  misc_feature (214)..(214): k is g or t/u
  misc_feature (514)..(514): m is a or c
  misc_feature (547)..(547): y is t/u or c
  misc_feature (650)..(650): m is a or c
  misc_feature (706)..(706): m is a or c
  misc_feature (761)..(761): y is t/u or c
  misc_feature (830)..(830): r is g or a
  misc_feature (838)..(838): m is a or c
  misc_feature (848)..(848): k is g or t/u
  misc_feature (880)..(880): y is t/u or c
  misc_feature (942)..(942): m is a or c
  misc_feature (1036)..(1036): y is t/u or c
atactctaaatagctcgatgccaaaaaatcagamtgattgaatagtttagttcgataccatcaataaacccgttgacccgatccaatgacccgctccgtgaacttccctctcctcggcctcgccgccgcactcctcctctcacctctcctcgccgtctctggtaaactcgccgacgacctcaagccaaaccgccaggaggtttayggcggaggkaagatattcgacatcagccaccgttacacgccggagatgccggcgtgggagtctaaggagggactttcgaaccacctgagactgatcgcgagtatgaagaacggatcgttcgctaacgtgtcggagatgaaactgtctgttcactccggaacacacgtggatgctccaggccacttcattgatgagtattacgacgctggtttcgattgcgattcgcttgacctccaaactctaaacggtcctgctttgttggttgatgttccgagagacaagaacataactgctgaggtaatggaatcmcttcatattccaaggggagttcgtcgtgtgctyttcagaacatccaacactgacaagcggcttatgtttaagaaagagttcgattcaagcttttctggattcatgactgatggggccaagtggttggttgagaacmcggacatcaaacttgttgggcttgattatctttcctttgctgcttttgacgagtcmccggcaactcacaaggttatacttagaggaagggatataatccctgtcgaagctytgaagctggatggtgttgaggcaggaatgtactcgcttcattgcttaccgctgagattggttggagcaraaggggcmccaaccaggkgcattctcatcaagtgattcagttcttccgtyttctttttaagttggtcagccaactgatcataaataatatgtttattacttccaagatcccmcaatcataaagcaggtatcatagatgagatgattccagttgtaaaagtaaacaatacctttatagacgtatgtgtatgtttgtatgtgtaattytgaaagatattgataataaagttaagactg

SEQ ID NO: 5114 - DNA, 490 bp, Brassica napus
  misc_feature (1)..(490): useful for making plants with increased salt and oxidative stress tolerance as described in USSN 12/282,342
  misc_feature (1)..(490): Ceres CLONE ID no. 1311812
  misc_feature (263)..(263): n is a, c, t, g, unknown, or other
  misc_feature (332)..(332): n is a, c, t, g, unknown, or other
  misc_feature (362)..(362): n is a, c, t, g, unknown, or other
  misc_feature (405)..(405): n is a, c, t, g, unknown, or other
  misc_feature (429)..(429): n is a, c, t, g, unknown, or other
  misc_feature (448)..(448): n is a, c, t, g, unknown, or other
  misc_feature (454)..(454): n is a, c, t, g, unknown, or other
aatatcagtttgattgatcatcataaaattgacagaccaataaaacattacgaacagaatactatatgaataccaaccaaggttcatgaatccacgttgacctacgaaccgagataatgattcctttcctcaccatcgccaggacactcttcctctcctctgtcatcgccgctgatgaagcttttccgtcgattcccactaccttccacgtagccatgacctcctctgacgatctgaaaccgatccgtcaggagggttatggngaaaggaagatattcgacataaacccaccggtacacgcaggatatgccggtctggggaatcgacagaangaggtaaaccggttcctgcgtctaaccacngagtatgaagaaaccaatcccctctctaataccctcgggagangaaaactatcttgttcacaccggntacacacccttggatggcnccaggnccacttttcatggacaaggtattaacgaacgctggg

SEQ ID NO: 5115 - DNA, 1066 bp, Brassica napus
  misc_feature (1)..(1066): useful for making plants with increased salt and oxidative stress tolerance as described in USSN 12/282,342
  misc_feature (1)..(1066): Ceres CLONE ID no. 952461
  misc_feature (514)..(514): m is a or c
  misc_feature (547)..(547): y is t/u or c
  misc_feature (650)..(650): m is a or c
  misc_feature (706)..(706): m is a or c
  misc_feature (761)..(761): y is t/u or c
  misc_feature (830)..(830): r is g or a
  misc_feature (838)..(838): m is a or c
  misc_feature (848)..(848): k is g or t/u
  misc_feature (880)..(880): y is t/u or c
  misc_feature (942)..(942): m is a or c
  misc_feature (1036)..(1036): y is t/u or c
atactctaaatagctcgatgccaaaaaatcagactgattgaatagtttagttcgataccatcaataaacccgttgacccgatccaatgacccgctccgtgaacttccctctcctcggcctcgccgccgcactcctcctctcacctctcctcgccgtctctggtaaactcgccgacgacctcaagccaaaccgccaggaggtttacggcggagggaagatattcgacatcagccaccgttacacgccggagatgccggcgtgggagtctaaggagggactttcgaaccacctgagactgatcgcgagtatgaagaacggatcgttcgctaacgtgtcggagatgaaactgtctgttcactccggaacacacgtggatgctccaggccacttcattgatgagtattacgacgctggtttcgattgcgattcgcttgacctccaaactctaaacggtcctgctttgttggttgatgttccgagagacaagaacataactgctgaggtaatggaatcmcttcatattccaaggggagttcgtcgtgtgctyttcagaacatccaacactgacaagcggcttatgtttaagaaagagttcgattcaagcttttctggattcatgactgatggggccaagtggttggttgagaacmcggacatcaaacttgttgggcttgattatctttcctttgctgcttttgacgagtcmccggcaactcacaaggttatacttagaggaagggatataatccctgtcgaagctytgaagctggatggtgttgaggcaggaatgtactcgcttcattgcttaccgctgagattggttggagcaraaggggcmccaaccaggkgcattctcatcaagtgattcagttcttccgtyttctttttaagttggtcagccaactgatcataaataatatgtttattacttccaagatcccmcaatcataaagcaggtatcatagatgagatgattccagttgtaaaagtaaacaatacctttatagacgtatgtgtatgtttgtatgtgtaattytgaaagatattgataataaagttaagactg

SEQ ID NO: 5116 - DNA, 1071 bp, Brassica napus
  misc_feature (1)..(1071): useful for making plants with increased salt and oxidative stress tolerance as described in USSN 12/282,342
  misc_feature (1)..(1071): Ceres CLONE ID no. 954851
  misc_feature (550)..(550): r is g or a
  misc_feature (612)..(612): m is a or c
  misc_feature (988)..(988): y is t/u or c
  misc_feature (1002)..(1002): y is t/u or c
atcagtttgattgatcatcataaaattgacagaccaataaaacattacgaacagaatactatatgaataccaaccaaggttcatgaatccacgttgacctacgaaccgagataatgattcctttcctcaccatcgccagtacactcttcctctcctctgtcatcgccgctgatgaagcttttccgtcgattcccactaccttccacgtagccatgacctcctctgacgatctgaaaccgatccgtcaggaggtttatggcgaaaggaagatattcgacataacccaccggtacacgcaggatatgccggtctgggaatcgacagaaggagttaaaccgttcctgcgtctaaccacgagtatgaagaaccaatccctctctaatacctcggagatgaaactatctgttcacaccggtacacaccttgatgcaccaggccactttcatgacaagtattacgacgctggtttcgattcggattcgcttgacctccaagtcctacatggccctgccctgttggttgatgttccaagggataagaatatcactgrggttatgaaatcacttcatattccaaagggagttcgtcgtgtgctcttcagaacattgaacmctgataggcggcttatgtttaagaaagagttcgattcgagctttgctggattcatgatggatggggcgaaatggttggttgagaatacagatatcaaacttattgggcttgattatctttcttttgctgcttatgaggaagcgcctgaaacgcacaagtttatactaggagaacgggatataatccctgtggaagcgctgaagctggatggtgtggaggtaggagtgtactcgcttcattgcttaccgttgagattgcctggagcggaaggtgcaccaacgagatgtattctcatcaagtgattcagttcatctccttctctataagctagttgttcagtatacgaaagtgattataagaacaaaataaaggcttyttacttccaagatytggaacaatagagcatatgttacatatgtcaagaattttaaagttcaagattcacttggatacctttat

SEQ ID NO: 5117 - DNA, 933 bp, Zea mays
  misc_feature (1)..(933): useful for making plants with increased salt and oxidative stress tolerance as described in USSN 12/282,342
  misc_feature (1)..(933): Ceres CLONE ID no. 1064137
aacaatggcagttcctccacttctcctcctcacactcctctccctcccttctcttctcatccacgccgccatctccgatgcttaccccaccattcccggaaccgctccgatcgacggaggtttctccgatgaactcaaacccatccgccgtgaggtctacggcgaaggcaaaatcttcgacatcagccaccgctacacgccggagatgccggcgtgggagtcaaaagaaggaatcggacggtttctatggctagccgcgagcatgaagaacgggtcgctcgctaacaactccgagatgaagatcccgactcacactgggacccacgtcgattcgcctggacacgtgtacgatgagtattacgacgctgggttcgatgtagactcgcttgatctccaagtcttaaacggtcctgcgttgttggttgatgttccaaggaacaagaacataactgccgaagtgatgaagtctcttaacataccaagaggagtccgtcgtgtgcttttcagaacattgaatactgacaggcgtctgatgttcaagaaggagtttgatacaagctatgtcggattcatgaaggacggcgcacaatggttggtagacaacactgacatcaaacttgttggggttgattatctatcagtagctgcatatgatgatctgattccgtcccacctagtattcctaaaaggccgagagactatactggtggagggattgaagctggatgatgtgaaggcaggagtctactctgttcattgcttacctctaagacttgttggagcagaagggtctccaattcgctgcatcctcatcagttgatttcttcctccaaaacttggagttgtctgtatgcaagttaacctttcgtatctttacttcaagatcttatgcttgacaaaaaaaaaaagtaaaataaataaggaaacttggcg

SEQ ID NO: 5118 - DNA, 1179 bp, Zea mays
  misc_feature (1)..(1179): useful for making plants with increased salt and oxidative stress tolerance as described in USSN 12/282,342
  misc_feature (1)..(1179): Ceres CLONE ID no. 368629
aaaaactccccagtcaaggcgcatatccattccatggatctcgcgcccctgctccttctctcccagctgctgctgcttccggtggtggcggttgtctccggcgagaccgccgcgcacccgggctacacacacgctgaggaggcatgcagcggtgtgctagaggcagaggcggagaaagcaacggtgctggtgcctgcgccagagcggcgcgaagagttcgacggggggcggatcgtggacatcagccactactaccgcgaggacatgccggagtgggagtcatcagagggctccggcgagttcctgcagctggcgcgttccatgcgcaacggctccgacatcgctaacttctcggagctccggctcactgcgcactccggcacccacgtcgacgcgccgggacacgtcttcgagcactactacgacaccggcttcgacgtcgacaccctcgacctcgctgtcctcaacggaccagcgctgttggttgacgttcccagagataagaacatcacagctgatgttatggcatccctaaacatgcctaaaggtgttcgacgtgtactctttcggaccctaaatacagacaggatggtgcacaatggttggttgataatacagacatcaaactagttggagttgactacttgtcagtgggcgcatttgatgaatgcattccagctcatctagtatttcttgaaaaaagggaggtcatacttgtcgaagccttgaatctggagcatgttagccctggaatatacatcttgcattgcttgccactaagattgcggggtgctgaaggttctcctgcaagatgcatcctcatcaagtgacatggttataaccatcccaaaaagcattgtacaatcaatcttgaaacctacctattcagtcttttcgaagtgcttatagaagtatggttttcatgcgtgtgtttatagggatggtgtgaggacccaataatatggagctgggctagtactgatccaatcgacactaatatgagctgaagatactacataaaacatgaacaatatggagttttatatactggaccccagtccaggttttaaatccacccctgcaaggggtgaatttatgtttgtgtttgggagtgtatatttctatattgcagtttgaaaaaaactatgtatgtaataaaataagaatacatcaattcat

SEQ ID NO: 5119 - DNA, 1195 bp, Glycine max
  misc_feature (1)..(1195): useful for making plants with increased salt and oxidative stress tolerance as described in USSN 12/282,342
  misc_feature (1)..(1195): Ceres CLONE ID no. 473732
aaagtaaaccatgaattctctatcactcttcaccttcctctgcgcaatttgtgcgcactccgtcgccgtcacctccgcggcatatccttccatccccggcacggaaaccggagagtgctccctccgcggcgtcggcgtcggcgacggtgttctggtccctccgcggcgagaagtgtacgaggaggggcgaatcttcgacatcacccacaggtatgtccccgagatgccggtgtgggactcgacggaggggctcgggcagcacttcctgtggctcgaaaagagcatgaagaatggctcgcgcgctaacaactccaacatgaagctcggtgttcacaccggcacccatgtcgacgcgcccggtcacttttacgacaattactacgacgccggcttcgatgttgactcactcgacctaacactcctcaatggccttgcacttttggttgatgttccacgggataaaaacattactgctgaggttatgaagtccttgaatatccctagaggtgtaagccgcgtgcttttcagaactttaaacactgacaggcaactcatgtttaagaaagaatttgacacaagctatgtgggattcaaggaggatggtgcaaaatggctggcagagaacaccgacatcaaacttgtaggagtcgattacttatctgttgctgcttatgatcactccattccatctcatcttgttttcctggaaagcaaggaaatcattcttgtggaaggcctaaagcttgatgatgtcccagcaggaatatattcactgaattgcttgcctcttaggttggttcactctgaggcatcaccaattcgatgcattctgatcaaatgatcaaatgatggggtcaaacctggttttcaattgcacggatgaacctgccacaagaagcaacgtagccacgaatacaattagtggtgtccataagaagcagtttgatgcaaattgcaagctaagctgatagtagtatgttgaattactcttagtttacgtccttgggttggaaagtactgaattattgtgattaaacttcagttgcggactagggggtccacctgtattaacttatgcttttaatattttcctaggcaagtacttgtgcaattctgaagacgcatgcttgtacgtctcaataattatatctatttctctttgaaaaataatgaaatactactaataatctcgggc

SEQ ID NO: 5120 - DNA, 1200 bp, Glycine max
  misc_feature (1)..(1200): useful for making plants with increased salt and oxidative stress tolerance as described in USSN 12/282,342
  misc_feature (1)..(1200): Ceres CLONE ID no.554272
atgaatgagctaagtggaaagtgaaaacgtgcctctttactaacgaaaccaaagcatgaagatgaattgctactggtggcatgccctgataatgagtggttgtgtgttgggcttgtgcgtgggcataggaggttgtgtatgtgtggtggagaacgagaatggaagaatcatcattgatattagtcacaggtaccatcctgatatgcctgcctgggaatccaaggatagccttgggcagtttttgtggcttacaagaagcatggccaatggttctctggctaacttctcccaattcaagctccccgctcacagcggcacccatgtcgatgctcccggacatgttttcgatcactatttccattctggctttgatgtcgactctctcgatttactactccttaatggccctgcactattagttgatgttccaagagatacaaacatcagtgctggtgttatgaagtcattgaatattccgaggggcgtacgtcgtgtgctcttccgaacattaaatacttacaggcggcttatgtatcagaaggaatttgacacaagctatgtgggattcacagaagatggagcaaattggctagtggagaacactgacattaagcttgtgggaatagattatctatctgttgctgcttacgaccacttgattccagctcaccttgtttttctgaaaggcagggaaatcattctcgtggaaggcctgaagcttgatgatgtggcagcaggaatatatacggtccattgcttacctcttaggttggctggtgctgagggatcacccataagatgcattctcatcaaataataagtcaacagctagcagtccaaatgccgacacgacatgcagcagtggtttatgcttggaaatgggtcttaattacgagcataaggttgagtttcaatgtagttttcttaaatacgaataagttggaaaaataaatataaagtggtgtcccgtgtccatttggagcaaggtatcataaatgcttagcaaagtgcataaacgctcctacaaatcatttcagaaataaagcagtatggatattggatgatatataaagtactatgtaatatgcagtgaaggtataacaaatgtcaaatagcaattattcttgcgtacttttaaatacactatatggatggatgtttggaattattattttttaagaaggatgtttggaattgttt

SEQ ID NO: 5121 - DNA, 1251 bp, Glycine max
  misc_feature (1)..(1251): useful for making plants with increased salt and oxidative stress tolerance as described in USSN 12/282,342
  misc_feature (1)..(1251): Ceres CLONE ID no.511015
gatgcgaaaatatctcgttcatgttaatgttatgataacgaggaatggactatgatgctgttctgttggtgacggtgtgattgattgtgacgaaatctgacaatgaagcgtggagcattgttgtcagtgcttgcctgcgccttcgcggcggtgatctgggcagcgaacggcgacgacaacctcgtcccgcctcgccgggaagtgtacggcaatgggcgaatattcgacatcagtcatcggtaccaacccgagatgccggaatgggaatcgaatgacggcatagggcagttcctgtggcttcccaagagcatgaagaacggttccctcgccaacaactccgaaatgaagtttcccacccacaccggcacgcacgtcgatgcccccggtcacgtgttcgaccactacttccacgccggcttcgatgtcgacacgctcgacttggacatcctcaacggacctgctatgttggttgatgttccaagagatagtaatattaccgctcaagttatgaagtcgttgaatattccaaggggtgtaatacgtgttctcttccgaactttaaataccgaccggcggctgatgtttcagaaggaatgggactcaagctatgtgggattcacagccgatggagccaaatggctagtggagaacacagatatcaaacttgtaggaattgattacctatctgttgcttcttatgattacttgattccatctcaccttgtttttctaaaagacagggagatcattctcgtggaaggcttgaagcttgatgatgttccagcagggttatattcagtccattgcttacctcttaggttggctggtgctgagggatcaccaatacggtgcattctgattaaaaattagggtgtccacatgtctgtgttcggtgtccgcgtcggtgtcggtgcttcataggctggaactgataaattggcatgggggtgtggtgtccttatggagcaagatagtttcaatgttgtgcaacaacttttgtagcttatgtttacacttactaaaaacatgcataagcacttcaaaaaatcattttgaaaaggaaaataatgtatatatagataatttgcacatttcattagcacttcaagagagatgcaacgatattggcattgcgctgaatttggttttcttttgtctgctaggttggaaaggaataagttggcacaatggtgtctttatggagcaagatagtatcaataatgtttgttaaagaaaaaaaaaaaaaaaaaa

SEQ ID NO: 5122 - DNA, 1173 bp, Triticum aestivum
  misc_feature (1)..(1173): useful for making plants with increased salt and oxidative stress tolerance as described in USSN 12/282,342
  misc_feature (1)..(1173): Ceres CLONE ID no.881632
gaataacccgcacctatccacgacaccgagggagaggagcaactgatccccgacgccccaaatggcgcctcccctcctcctcctcctcctcgtccctctcgtcgccgccaccgcaccgtgcgcccacccggcccacccgagccagccggcgtcgtgcgccgcggagcccgtgctggcgccggagcgccgggaggcgcacggcgggggccgcatcctggacatcacccactactaccgggaggacatgccctcgtgggagtccggcgccggggtgggccagttcctctggctgcccgcctccatgcgcaacggctccctcgccaacaactccgagatgcggatgcccacccacaccggcacccacatcgacgcctccggccacgtcttccagcactacttcgacgctggcttcgacgtcgacaccctcgacctcgacgtcctcaacggtcctgcactgctggttgatgttccaagggatgaaaatattactgctaaaacgatggaatctttgcatattcctaaaggagttcaacgggtactttttagaacattaaacactgacaggaacctaatgtggaagaaagagtttgacacaagctatgtgggttttatgaaagatggtgcccaatggttggtagacaacacggatattaagcttgtcggaatagactatttgtccgttgcagctttcgatgacttgatcccttcacatttagttttacttgaaaaccgggatatcattcttgtggagggcctcaaactggagaatgtcatacctgggatatactcgttgcattgcctgccacttcggttgcgtggagctgaaggttcgccgatcagatgcatccttataaagtgaaagacatttgcatcccgctgcggcggtttagtttgataccgcaagcacttatatataaaaatagaatgtgtatagcagcaaaactcgtgtctttgataccagaggagtactgtcatgtgtccagaaacatggtggcacttcgatgcttagtaaggagcgacaaacggctagggatgcaaatgtgtagcctctagggtaccctccgaacctttagttgggctatagaagggatggattacaatacaaaccgcaatgttcggtggtaccaaaatcccaaaaaaaaaaaaaaaaaaaaaagaaaaaaaaaaaaaaaa

SEQ ID NO: 5123 - DNA, 1347 bp, Glycine max
  misc_feature (1)..(1347): useful for making plants with increased salt and oxidative stress tolerance as described in USSN 12/282,342
  misc_feature (1)..(1347): Ceres CLONE ID no.474985
aggaacagagcaaacatgctgcttctttggcttttgccactgctgttgctgcagaggctgctgttgccgctgctcaggctgctgccgaggttgttcgtctcacaagtatgccacattacactggaaggactaaggaagaaattgcagccatcaaggttcagactgcattccgtggatatatggcaagaagggcattgcgtgcgttgagaggattggtgaggttgaaaacattagtacaagggcaatctgttaaacggcaagctgctagcaccctacgaagcatgcaaactctagcaagattacagtctcagattcgtgaaaggagaattagaatgtccgaagagaaccaagctcttcagcgccaactacatcagaaacatgaaaaagaacttgagaagttgcgtgctgctgttggagaagaatgggatgatagctcgcagtcaaaggagcaaattgaagcaaaattgttgcacaggcaagaagctgctttgagaagagagagagctttggcctattcattctcacatcagcaaacatggaagggctcttcaaagtcattaaatccaacatttatggatccaaacaatccccaatgggggtggagttggctagagagatggatggctactaggccatgggatggccatagcactgtggtggatcacaatgaccatgcatctgtgaagagtgcagcgagccgtgccgtgtctgtagggcaaatcaccaaattgtactctctccaagataaaaaaccttccccttttggctcaaaagcaagaagacctgcccctcaaagttcccattcaaaggcaccatctactaatggaaaagcaaggccatcaagctcaacaaagggtagtagtgtttggggtggagatgaggactcaagaagcatgtttagtgttcagtcggagcgctaccgccgacacagcattgcaggatcctcagtgagagatgatgatagccgtgcaagcacacctgccattccaagttacatggcagccacaagctcagcaaaggccaggtccaaaatcataaggcattcacctgaaaaaaaaggtggtggtggttctgtttctgcaaggaagcgactttctttctcaccctcttctgctgctaattcaagaaggcattctgatcctcctaaggtggaaatggtttacaataaggatgctgctgcggctacagtaagcaatggaaggggaaggtagtgtgctggggatgtcattgccacttcagcaattcttgtaggagcacaatatctatggatctatttggataaacttctccataatcacttataaatgaagaaaaacaaaagtaatatagaaaaaaaaaaaaaaaaaa

SEQ ID NO: 5124 - DNA, 1716 bp, Triticum aestivum
  misc_feature (1)..(1716): useful for making plants with increased salt and oxidative stress tolerance as described in USSN 12/282,342
  misc_feature (1)..(1716): Ceres CLONE ID no.826796
ataggacttcacagacagactgactcaatcctaacccaatccctcccatgcttccatctactctagcagaaattgcagaggaggttggccgccgccggctccagcgcaggcgcagcctacccgcgggatctgacgccctccgcctcctacctcgaggcacgcgcctcaggctcagctcccccgcccgccctcccccgctaccccgacgacttccaagaggaggagcatgaaattgagcatgtcgccgccgcgccagcgccagcgccagccacggatgcgccgctacctgcccctcctgccgccgcaccaccacaggttcaggctgccattgcgccggcttcttcctcttgtgtcatgtccagggagctcgccgccaccaagatccagaccgccttccgaggtcacctggcaagaagggcgctgcgggcattgaaaggcctggtcagactcaagtcgctggtccaaggccactccgtcaagcgccaggccaccagcacgcttcgctgcatgcagactctgtcccgggtccagtccaagatacggacgaggaggatcaagatggccgaggagaaccaggcccttcagcgccagctcttgttgaaccaggaactagagactctcaggatgggagatcagtggaataccagcctgcagtccaaggagcaaatcgaggcgagcctcgtgagcaggcaagaggccgcggctagaagagaacgggctctcgcatacgcattctcccaccagtggaagagcacctcaaggtctgccaacccgatgttcgtggacccgagtaacccgcactggggctggagctggctggagcggtggatggcgtcgaggccgttcgacggccgcaacggggcgtccgagaaggagggcagcagcgtcgaccgcacgtcggtgcacagcaccagcctgagcatgaacctcggagaaggtgagacggtcacaaaggcggacaaccaggtggtggactctttgaagccgaatgatgataagccgccgccgctttcgactccgaagccgtccggccctgcccccaggcagtccccgtcgacgccctcgccggcgctggcgaggaagaagagcgcgacgcccaagagtggagactgcgacggcgacgacgcgaggagcgtggtcagcactgtccggtccgagcggccccggaggcacagcatcggcgcgtccagcgtgcgtgacgacgcgggctcttccccgtcggtgccgagctacatggcggccaccaagtcggcgtcggccagggccaagtcgcgtgtgcagagcccgacgctgaccgagggtgctgctcaagctgagacgctggagaaaggatggtcttctgtgggttcagcgaagaagcggctgtcctttccggctgggacgccaccgccggtgccggcggcggcggcgaggcggcactccgggcctcccaaggtgcggcaggcgggcgtggaaggtggtacggaggaacgggactcgtcccttgcgtgacatcatgggaagcagattatggtgtggagcagagcagagcggaatttgttgcatttgttgagtgaaaggaacgcagaatgtgtgttgtgtggatccattggatttgatttgatttgtatgatggcagtattcctatttgattattcattgaataatataagtatctgtaatgaagataaaaggaggggacacgaacattatttcaaaagaaaaaaaaaaaaaaaa

SEQ ID NO: 5125 - DNA, 1381 bp, Glycine max
  misc_feature (1)..(1381): useful for making plants with increased salt and oxidative stress tolerance as described in USSN 12/282,342
  misc_feature (1)..(1381): Ceres CLONE ID no.463638
attagattctgcttccatttttttttttctctctacacctcttcttcttcacttcctctttactgtttgttacttcaattttgtgattcgttctttctggattcaattgagtaaaaatctgcgtggtttgagcaatggatgttaaagctgcgccgaggttacaactttcagcggtggttcaacccgaaagtattggaagaagaccacccagcacatgtcgtttgggtgtgtctcgggaaccgcagagccttcgggtttttgtttcgtcaacgatgatgcgccgcagaacaaccgctttggaggtttcctgttcttacggcaacatttcagcttcaatattggaatctggaagtgttcgtgctcctcttgatgaagagctgattctaaagaatagatcgcaagagatccagccatatttaaatggacgctgtatttatcttgttggaatgatgggctctgggaaaacaacggtggggaagataatgtcacaagtgcttggttattcattttgtgatagtgatgcattggtggaggaggaggttggtggaaactctgtagctgatatattcaagcaacatggtgaaactttctttcgtaataaggagactgaggtgttgcataagctatccctgatgcatcaacttgttatttctactggtggaggtgctgttacaaggcccatcaattggaaatatatgcacaagggagttagtgtttggttggatgtaccagtggaagccctggcacagagaattgcagctgtaggaactaattctcgcccccttctacactatgaagcaggagatccttacacacgggcttttatgcgtttgtctgctctttttgaagagagaggtgaagcatacgccaacgccaatgccagggtctcattaaaaaatatagcaataaaactgggcaaaagagatgtgtccgaattgtctccaacagatattgcaattgaggcgctagaacaaattgacaactttttgaagggggaagggggccgctatgcagaatgctagtacaagctttggttacaagcttctttttgattgttcatatttttttttatgcaattgcgattaaggtcatgctgtcgacctcgcttttggtaaaaaaaaaaaaaaggtggtaatgcaacatggcacttgtttatgcataatttgtgttggcaaatgggcaaaatccaacagccaattgcaacaacatttaatttatgttctgtttattgttgaatgttgatgtgtgtgtgtatatatactggagaacgaagtgttgtaatcggagttgggttgatcaatttatgtatgccctcctctaaagaggtttgtatgttgtaaagtgacacgcatattttaaattcttctttatcttatatttg

SEQ ID NO: 5126 - DNA, 1542 bp, Zea mays
  misc_feature (1)..(1542): useful for making plants with increased salt and oxidative stress tolerance as described in USSN 12/282,342
  misc_feature (1)..(1542): Ceres CLONE ID no.1565097
aagtcgtagccgactggtcgccgcgtccccctttccccgcgcagcagcagagcaccatccggtgaccgagcaatggaggcggggggcgtgggcctggcgctgcagacgcgggcggcggccttcggctccggccagcgccggggcggcctacagtcgcccatcgggaggctgagagtcgctgaaccggcgggagctgcggttgccgtgcgggctcgcgggtccaagcccgtcgtaccgctccgtgcgaagaaatcatccggaggtcatgaaaacttgcataactccgttgacgaagctctcctgttgaagagaaaatcagaagaagttctgttctacttaaacgggaggtgtatttacttagtgggaatgatgggttctggaaaaagtactgtggggaagatcatgtctgaagtcttgggttattcgttctttgatagtgacaaattagtggagcaagctgttggaatgccttcagttgctcaaatattcaaagttcacagtgaagccttctttcgggataatgagagtagcgtcttgagggatctgtcctccatgcgacgattagttgttgccaccggaggtggtgctgtcatccgaccagttaactggtatctagagttcactccatttctttcttttaaatgggtcgctttgttttctttgaatcaacagtattgtgacctgtcgttccattatcaggaaatatatgaagaagggcctatccgtttggttagatgtgcccttggatgctcttgctaggcgtattgctaaagtgggaaccgcttctcgtcctcttctggaccaaccgtccggtgatccatacacaatggtagctacttattctttcaatattctttcatgctcgtgaaacggaattgtttcttcattctatttggacaaagaactgctcatagatccacttgagccttgaagccctatcctggattccagtcctttacttgtggacttgtggtagcaaatgctcagacttcttatgctagttctaatatggatcactcactgggttccttatttgttataggccttttctaagctcagcatgcttgcagagcaaaggggtgatgcttatgcaaatgcggatgtaagggtttctctggaagagattgcatctaaacaaggtcatggcgatgtctctaagctgatgccgactgatatcgcaattgaggtaagcttaccgcgaatatcatgtctctttccagataccatcagacagcttttcaaaagataacacgcttaccgtcttcgcagtcacttcataagatcgagagtttcgtcatcgagcacgctgctgataatccagctagcgactcgcaagctgagtcacagatccaaaggatacagaccttgtaatatcttaatccttctgttttgtaccgaagcgtaccccctagagcatcgttgggttatttgttcgttgaagtgtcacgagggagagaaaaaaaaaaccctgaagtatttcttgttgtaagttgtaaaggaatggaataaaggagctaataatccgaaaaaaaaaaaaaaaaa

SEQ ID NO: 5127 - DNA, 1283 bp, Zea mays
  misc_feature (1)..(1283): useful for making plants with increased salt and oxidative stress tolerance as described in USSN 12/282,342
  misc_feature (1)..(1283): Ceres CLONE ID no.486613
gtcactgctttacgtcccaacaggcggcacatttccgccaccagctaccaccgcctgcgcgcagcgcggtcctctctctcctcttctttacacctcacctccggatcgctcagagattgagccgtagcccgactggtcgccgcgtcccctccccccgcgcagcagcagagcaccacccggcgagcgagcaatggaggcggggggcatcggcctggcgctgcaggcgcgggcggcgggcttcggctccggctccggccggcgccggggcggcctacaggcgcccaccgggagcttgagagtcgctgatccggcgggacctgcggtcgctgtgcgggctcgcgggtccaagcccgttgcaccgctccgactccgtgcgaagaaatcgtccggaggtcatgaaaactcgcacaactccgttgacgaagctctcctgttgaagagaaaatcagaagaagttctgttctacttgaacgggaggtgtatttacctagtaggaatgatgggttctggaaaaagtactgtggggaagattatgtctgaagtcttgggttattcgttctttgatagtgacaagttagtggagcaagctgttggaatgccatcagttgcccaaatattcaaggtccatagtgaagccttctttcgggataatgagagtagtgtcttgagagatttgtcctccatgcgacgattagttgttgccaccggaggtggtgctgttatccgaccaattaactggagatatatgaagaagggcctatctgtttggttagatgtgcccttggatgctcttgctaggcgtattgctaaagtgggaactgcctctcgtcctcttctggaccaaccatctggtgatccgtacgcaatggccttttctaagctcagcatgcttgcacagcaaaggggtgatgcttatgcaaatgcagatgtaagggtttctctggaagagattgcatgtaaacaaggtcatgatgatgtctctaagctgacacctactgatattgcaattgagtcacttcataagatcgagagcttcgtcatcgagcacactgctgatagttcagctagcgacgcgcaaactgagtcgcagatccagaggatacagaccttgtagaaccttaatccctttgtttgccacatagagcatcgttgagttatttgttcgttgcagcgtcacgagggagagaaaaaagagtgaaacgtttcttgatgtgagttgtaaaggaatggaagaagggagctaataatccaaagtgtgccgttggctaaaaaaaaaaaaaaaa

SEQ ID NO: 5128 - DNA, 1403 bp, Triticum aestivum
  misc_feature (1)..(1403): useful for making plants with increased salt and oxidative stress tolerance as described in USSN 12/282,342
  misc_feature (1)..(1403): Ceres CLONE ID no.749796
gcgatctcccaaccccccctttacctcttctgtctcttcttccctccgccgcggcgccgctcgccacgccacccgcgtatccatccaccaccgttcccgcgatggccgccggcgtactcaacacccagccccgcctcaactaaccacggatgatacacatagctcctgttaacttcctgccactcgtcccgtcccccctgagggagaggagatggacgccggcgtgggtctccggccaaggccccgtgcagcatgggccggacgacggaagccgcagggattccccccggcgacggtgccggcggtgaggctcgaccagaatccggcgcggcggccgctggttctgcgctccgacgcggggagccggagcaccgatcccatccgtggcgccagcctcaagggcctgtgctgccacaaatcggcaggtaccgagaaagtccactattctgctgatgaggccctcgtactgaagcaaaaagcagaggatgtgctcccttacctgaatgaccgctgtgtttatctagttggaatgatgggttctggcaaaactacagttgggaagataatagctgaagtactaggctattcattctttgacagtgataagctggttgagcagtctgttggcataccgtcggtggctgagatttttcaggtccacagtgaagcattcttcagagataacgagagtgaggtactaagggatttgtcgtcaatgcaccgattaattgttgcaacgggaggtggtgcggtgatacgaccaatcaattggagttatatgaagaaaggactcactatttggttagatgttccattggatgccctcgcaagaaggattgctgcggtgggtactgcgtcacgacccctcctgcatcaggaatctggtgatccttatgcaaaggcctatgccaaacttacagcactttttgaacaaagaatggattcatatgctaatgctgatgcccgagtttcccttgaaaatattgcactcaaacaaggacataatgatgtgaatgtacttacaccaagtaccatcgctattgaggcattgctaaagatggagagctttcttactgagaaggccatggtcagaaactgaccagatctcggtggttaaaaagaaagatgacaaccaatggttcttggttgccgtgatgtacatacctttgcataagacattcttcttgatatagccagagctatgacagaggataacttgggtttttacttgagtgaactatatgtgaatagctctaaattaagacaatgtttgtcttgtctttatcttgctgcaatttgatatatgggatttgggagtaaatattaagtgatatcccttgtacattttgaagcaaccagaatttacatcaatatattattttgagacaaaaaaaaaaaaaaaa

SEQ ID NO: 5129 - DNA, 1347 bp, Zea mays
  misc_feature (1)..(1347): useful for making plants with increased salt and oxidative stress tolerance as described in USSN 12/282,342
  misc_feature (1)..(1347): Ceres CLONE ID no.294723
ctgattcctgaacacaccctcgtctccgcacggaggccgtcctctcctctcctctcctctgcgtccgccactgccgcccaccgctcgcccacgcgcgctccattacctcggcgggcgatggccgacctatccaacaccggctccacctaacacgagcagcgcccccgcctaggcggctggctggtcggtcgtcgagcagctagcggcggcagcgcccggaggccgtctcactctcctcgtcggggcggcaggagatggaggccatcgtgggcgtccgcgcgccgccgcgtggccgtgcctgggccggcctcgagaagccgccgcgcgccgcttgctgcgccagagtcccgacggcgaggctcgcggtcgcggcggacaggccgcggaggctggtgctgctgggcgccgatacgcggagggccgcggattatcctgccctccgttgcgccgcgcaatctgcaggaacaggaaaggtccactactctgctgatgacgctctcatactacagcaaaaagcccaggatgttctgccttacttggatggccgttgcgtttatcttgttggaatgatgggttcaggcaaaactacagttgggaagatactatccgaagtgttaggttattcgttcttcgacagtgataagttggtagagaaggctgttggtatttcatctgttgctgagatctttcagctccatagcgaaacattcttcagagataatgagagtgaggtcctgacggatctgtcatcaatgcatcggttggttgttgcaaccggaggtggtgcagtgatccgaccaatcaattggagttacatgaagaaagggctgaccgtatggttagatgtcccactggatgcacttgcaagaagaatcgctgctgtaggaaccgcgtctcgaccactcttgcatcaggaatccggtgatccttatgcaaaggcttatgcaaaacttacgtcactttttgagcaaagaatggactcgtatgctaatgctgatgccagagtttcacttgaacatattgcattaaaacaaggccataatgatgtcactatacttacacctagtaccatcgccattgaggcattgctaaagatggaaagttttcttaccgagaagaccatggtcagaaactgacctcttgaatgagagggaaaggatgctgacaacatgtggcccttgtttgtttaattgtacatatacctttgcattattgcctaaactctttctacagtgttgttggattattgtttgtgcagcatgaaagaggaccgtttgagtttgtatttatgcaaatgaataagtaaataactttcagttaaaacaatgacaattcgttatttatcgc

SEQ ID NO: 5130 - DNA, 1318 bp, Zea mays
  misc_feature (1)..(1318): useful for making plants with increased salt and oxidative stress tolerance as described in USSN 12/282,342
  misc_feature (1)..(1318): Ceres CLONE ID no.1374869
ctcctgaacacaccacccctcgtcgcacgacgatggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggccatcgtgggcgtccgcgcgccgccgcgtggccgtgcctgggccggcctcgagaagccgccgcgcgccgcttgccgcgccagagtcccgacggcgaggctcgcggtcgcggcggacaggccgcggaggctggtgctgctgggcgccgatacgcggagggccgcggatcctgccctccgttgcgccgcgcaatctgcaggaacaggaaaggtccactactctgctgatgacgctctcatactacagcaaaaagcccaggatgttctgccttacttggatggccgttgcgtttatcttgttggaatgatgggttcaggcagaactacagttgggaagatactatccgaagtgttaggttattccttcttcgacagtgataagttggtagagaaggctgttggtatttcatctgttgctgagatctttcagctccatagcgaaacattcttcagagataatgagagtgaggtcctgagggatctgtcatcaatgcatcggttggttgttgcaaccggaggtggtgcagtgatccgaccaatcaattggagttacatgaagaaagggctgaccgtatggttagatgtcccactggatgcacttgcaagaagaatcgctgctgtaggaaccgcgtctcgaccactcttgcatcaggaatctggtgatccttatgcaaaggcttatgcaaaacttacatcactttttgagcaaagaatggactcgtatgctaatgctgatgccagagtttcacttgaacatattgcattaaaacaaggccataatgatgtcactatacttacacctagtaccatcgccattgaggcattgctaaagatggaaagttttcttaccgagaagaccatggtcagaaactgacctcttgaatgagagggaaaggatgctgacaacatgtggcccttgtttgtttaattgtacatatacctttgcattattgcctaaactctttctacagtgttgttggattattgtttgtgcagcatgaaagaggaccgtttgagtttgtatttatgcaaatgaataagtaaataattttcagtt

SEQ ID NO: 5131 - DNA, 1234 bp, Zea mays
  misc_feature (1)..(1234): useful for making plants with increased salt and oxidative stress tolerance as described in USSN 12/282,342
  misc_feature (1)..(1234): Ceres CLONE ID no.276706
caccggctaccacctgccgcctgcgccctgccctccctctgtttttctagacccccggatcgctcagagattgagtcgtagtcgcacccgactagtcgccgcgtcctcctttccccgcgcagcagcagagcaccacccggtgaccgagcaatggaggcggggggcgtgggcctggcgctgcagacgcgggcggcggccttcggctccggccagcgccggggcggcctacagtcgcccatcgggaggctgagagtcgctgaaccggcgggagctgcggttgccgtgcgggttcgcgggtccaagcccgtcgtaccgctccgtgcgaagaaatcatccggaggtcatgaaaacttgcataactccgttgacgaagctctcctgttgaagagaaaatcagaagaagttctgttctacttaaacgggaggtgtatttacttagtgggaatgatgggttctggaaaaagtactgtggggaagatcatgtctgaagtcttgggttattcgttctttgatagtgacaaattagtggagcaagctgttggaatgccttcagttgctcaaatattcaaagttcacagtgaagccttctttcgggataatgagagtagcgtcttgagggatctgtcctccatgcgacgattagttgttgccaccggaggtggtgctgtcatccgaccagttaactggaaatatatgaagaagggcctatccgtttggttagatgtgcccttggatgctcttgctaggcgcattgctaaagtgggaaccgcttctcgtcctcttctggaccaaccgtccggtgatccatacacaatggccttttctaagctcagcatgcttgcagagcaaaggggtgatgcttatgcaaatgcggatgtaagggtttctctggaagagattgcatctaaacaaggtcatggcgatgtctctaagctgatgccgactgatatcgcaattgagtcacttcataagatcgagagtttcgtcatcgagcacgctgctgataatccagctagcgactcgcaagctgagtcacagatccaaaggatacagaccttgtaatatcttaatccttctgttttgtaccgaagcgtaccccctagagcatcgttggtttatttgttcgttgaagtgtcacgagggagagaaaaaaaaaaaccctgaagtatttcttcttgtaagttgtaaaggaatggaataaaggagctaataatccgaagtgtaccgttggccg

SEQ ID NO: 5132 - DNA, 1254 bp, Triticum aestivum
  misc_feature (1)..(1254): useful for making plants with increased salt and oxidative stress tolerance as described in USSN 12/282,342
  misc_feature (1)..(1254): Ceres CLONE ID no.840744
accactcgccgccccccagcagccaccggacacctgccgaaagcgcgagagagccgtagccgatcgcatcgccgcgtagtggccgccgcagagcaaccggcgagcaatggaggcgggcgtggggctggcgctgcagtcgagggccgcggggttcggctccggccgccgccggagctcgatgtacggcggcgagagcggggctcgggtcgtgagcttgcgggtcagtgatctggtggggtcgccggccgccgtgcgggcgcgcggggccaagcccgtcgtcccgctccgcgccaagaaatcgtccggaggaggtcatgagaacttgcataactccgttgacgatgccctcttgttgaagagaaaatcagaagaggttcttttccagttgaatggtcggtgcatttacctagttggtatgatgggttcgggcaaaagtacggtggggaagatcttggctgaagttttgggttattcattcttcgacagtgataaattggtcgaacaagctgttggcatgccttcagttgctcaaattttcaaggttcacagtgaagccttcttcagggataatgagagtagcgtcttgagggatttgtcctcaatgcggcgattagttgttgcaactggaggtggtgctgttatccgaccagttaactggaaaaatatgaagaagggcctatctgtttggttggatgtgccgttggaagctcttgcaaggcgtattgctaaagtggggactgcctcgcgtcctcttctagatcaaccatccggcgatccatacacaatggccttttcgaaactcagcaccctcgcggagcaaaggggcgatgcttatgcaaatgctgatgtcagagtttccctcgaagagatcgcatctaagctgggccatgacgacgtctctaagctgacaccgattgatattgctctcgagtcgctccacaagatcgagagctttgtcgtagaagacaccgccgtcgccgactcacaaacggaatcgcaagctcaaaggatacataccttgtaggatatgaatcctttttgcaccatgtagggcgcggcgcggcccagcgcagctgagttattcgttcgttgtgtcgacaaggaggaagctggagtatctcttttctttgtaagctgtaaaatggcggaataatggagctagctaatacaaagatccttgttggttgaaagaaccctggcttcccccctggcttgatgaaaacaatatgtcaccttccaaaaaaaaaaaaaaaa

SEQ ID NO: 5133 - DNA, 746 bp, Glycine max
  misc_feature (1)..(746): useful for making plants with increased salt and oxidative stress tolerance as described in USSN 12/282,342
  misc_feature (1)..(746): Ceres CLONE ID no.651548
ataaccgaacaaaattaaagaaaaaaaaaacccactattcaaaaccaaatccaaaaaccaagacacccccattaggtagctaggccttaattgatctccttttctttcaccaccaccaacaacgatgtccatgctcgaaaccgaccaaatcaagcaactgaacgacatattcaagcgcttcgacatggaccaggacggcagcctgacccacctggagctggcggcgctcctccggtccctgggcatcaaacccaccggcgacgaaatctacgccctcctctctaacatggacgaaaacggcaacggctacatcgagttcgacgagctcgtgcatgccatcatgcctgacctcaccgagagcgtcctcatcaaccaggagcagctcctcgaggtcttccggtctttcgaccgtgatggcaacggctacatcacagccagcgagctcgcgggttccatggcgaagatgggccagccactcacctaccgcgagctcgcctccatgatggctgaggccgatagcaacggcgacggcgtcattagcttcaacgagttcgccgccctcatggccaaatccgccgctgaatttctcggcgtcaaggtcgcctagatggctagatcaatacggggctaataatttcgtatgtttgtgtaaccctttttatttttttgtgttttctttagggtacgtgtacgttggtgtaaaggcaaggagatcgaacaaagataaataattaagggatattttg

SEQ ID NO: 5134 - DNA, 851 bp, Zea mays
  misc_feature (1)..(851): useful for making plants with increased salt and oxidative stress tolerance as described in USSN 12/282,342
  misc_feature (1)..(851): Ceres CLONE ID no.287120
atcatccctgcagttgtggatcagttcgtcctccgtctctctccacaagtctcctctaggcgccaagcaatgacaaggtcagcaccgccggcctctcctccggcgccgaagcccgtgctgcgcgggagccagctggagcagctccgcgagatcttccggcgcttcgacatggacggcgacggcagcctgacgcagctggagctgggggcgctgctgcggtcgctgggcctgcgccccacgggggaggaggcccgcgcgctgctggcggccatggactccaacggcaacggcgcggtggagttcggcgagctggcggccgccatcgcgccgctgctcaccacgcagacgcacctcgtcgaccaggcccagctcctggaggtgttccgcgccttcgaccgcgacggcaacggctacatctccgccgccgagctggcgcgatccatggcgcgcatcggccagccgctcaccttcgaggagctcacgcgcatgatgcgcgacgccgacgccgacggcgacggcgtcatcagcttcaacgagttcgccgccgtcatggccaagtccgcgctcgacttcctcggcgtcgcctgatgccctctgatggaccgatcgatcgatcggtctcgctcaccgcccgccgccgtaaccccgtgtccctgtgaccctgtccctcgcccgccattgattacctgttctctctctctctctctctctcttttgttaggaagatgctcatccggttaatgtaggataactgacacaagataatgtaactcaaaaactcatcgctggtttgtaacatggatgaactcggaaaatgtgtacatattttggatggatttgttcaatcttcc

SEQ ID NO: 5135 - DNA, 848 bp, Triticum aestivum
  misc_feature (1)..(848): useful for making plants with increased salt and oxidative stress tolerance as described in USSN 12/282,342
  misc_feature (1)..(848): Ceres CLONE ID no.759217
cggtctcaccccaaacccattgtgcatctccatccccacctcctccgatcccatccacccccaccctcaccgccaccaagtcaaagatccaaccttcactccaccaccatgacgaagccatcgccatccccatcgccggcgccggccaagggcgcggggtcgctgcggggcagccagctgaagcagctgcgctccctcttcgaccgcttcgacatggacggcgacggcagcctcacccagctcgagctggcggccctgctccgctccctcggcctgcgccccacgggcgacgagtcgcgggccctcctcctcgccatcgacgccgacggcagcggcaccgtggagttcgacgagctggcgcgggccatcgcgccggtgctcaccgcccacgcgccgcggctcgtcgaccaggcgcagctgctcgaggtcttccgcgccttcgaccgcgacggcaacggctacatctccgccgccgagctcgcgcgttccatggccaagctgggccagccgctcacgttcgaggagctgcggaccatgatgcgggacgcggacgcggatggggacggcgtgattagctttggggagttcgccgccgtcatggccaggtccgcgctcgacttcctcggcgtccccgccgcctgagatgtgagatgatgaccggccgggctccggctggctctgatcggatggactggtagtatgattcttcttctttggtagaactagtcgtagtagggtggttcaaggcccggactggatcaactgtgacgaactcacacggagttgcaacgttgacctggaatgtgtataaattttggtaatttggtcaatcgatgcgtccgctgctg

SEQ ID NO: 5136 - DNA, 766 bp, Triticum aestivum
  misc_feature (1)..(766): useful for making plants with increased salt and oxidative stress tolerance as described in USSN 12/282,342
  misc_feature (1)..(766): Ceres CLONE ID no.684584
cgaaaagtggaccttttgtactagtacttcagacagacagaagcagaagcaaccagccgaagctcgttcctcgtagacagttggacagtcgtctcgatccatcgtccatcccgtctcgccagcagccgaccatggccgcgcaggcgccgccgccgccgccgccggagcagaagatgatggtggccatcgacgagagcgagtgcagccactacgcgctcgagtgggccctgcgcaacctcgcgccccgccgcctcatcctcttcaccgtccagcccttctcccctctcagctacctccccgtcggctccccgcttggcccgtcggtggcgtcgccggagctcatcaggtcggtgaccgagcaccagcggcagctcgcccaggcgctcgtcgacaaggccaaggccatctgcgccgagcacggggttgatgcagagaccgtcatcgaggtgggtgatcccaaggaaaccatatgcgaagctgcggagaagttgaatgttgatctgctcatcctgggaagccacagccgtgggcctgtacaaaggtttttccttggcagtgtgagcaactactgtagccaccacgcgaagtgcccggttcttgttgtgaagaagaaagaatgaaactccgctatctactgtattcatggacatcgtgtgaagaacccttgagatgtgtatctacatgttgtttgtcacagcatctagttgcatacttgcatatgaataaacatactttgccaatttgaaaacaactatatattcagtct

SEQ ID NO: 5137 - DNA, 693 bp, Glycine max
  misc_feature (1)..(693): useful for making plants with increased salt and oxidative stress tolerance as described in USSN 12/282,342
  misc_feature (1)..(693): Ceres CLONE ID no.1059727
gatcaaactgtagtcaaactcatctgacgatcgatcgatcgatcatttggaagaaaccatggtggaagagaaaagtgggaagaagcaagtgatggtggcgatcgacgacagcgattgcagcaaacacgctctccgatggacgctctcgtatctcaaagacagcctcgccgattccgatatcatcctcttcaccgcgcagcctcagctcgatctcagctccgtctacgcttcctcttatggcgccgctccgatagagctgataaactcaatgcagcagaactacaaaaacgcagcgttgaatcggattgaggaagggaccaagatttgcgctgagagcggggttaccccaaagaaggtgatggagtttggaaaccctaaagaagcgatatgtgatgctgttgagaagcttggtgttgatttgctaatcgttggtagccatggcaaaggggctctagagaggactttccttggaagtgttagcaattactgtgttaacaaggctaagtgcccagttcttgtggtcaggacaaaggcttgaagagtttgagaaccgcctcgcttgctgtatgtgtgttgtgtaaacatattgataataatgctttgtttgtatactactactgtttggaaaaaaactttgtgaatggaaataaatatattattggtttgataaataacgagctttgctgtgctctt

SEQ ID NO: 5138 - DNA, 853 bp, Zea mays
  misc_feature (1)..(853): useful for making plants with increased salt and oxidative stress tolerance as described in USSN 12/282,342
  misc_feature (1)..(853): Ceres CLONE ID no.1272732
aaagcggactgctctcctcaattgtcaggcagtagcatccatttgattgttctatcctcttctctgttctcacccccttgcaagcaacaatcgttcaccgatcgatccagtgcgtcctgcatggaaactgccgccgtcgccgcctccagtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgttgagaggcacgccaacgcggtctcggcggcggcggtcgacaaggccaagcgcgtctgcgccgaccacccgcacgtcaaggtggagacgacggtggagagcggggacccgcgggacgtcatctgcgacgcagccaacaagatggccgcggacctgctcgtcatgggcagccatggttacggcttcatccagagggcgttcttgggcagcgtcagcaaccactgcgcgcagaactgcaaatgcccggtcctcattgtcaagaggcccaaggagtagaaggttcctcgcatgtaacgctgcagcttagccaataatgtttcatggcgaccatataggcatatatgtacacacttcacatcccattgcatggcagtgtcttccctagttcaacaactagctttctgctggaataaggtgttcagagttcagacagagtatgtactgtacatactatcttcttgcatttggtactcttgtttagtgaaaagcgttccgtaaaaaaaaaaaaaaa

SEQ ID NO: 5139 - DNA, 812 bp, Zea mays
  misc_feature (1)..(812): useful for making plants with increased salt and oxidative stress tolerance as described in USSN 12/282,342
  misc_feature (1)..(812): Ceres CLONE ID no.283925
agtagcatccaattgattgttctatcctcttctctgttctcacccccttgcaagcgccaagcaacaatcgttcaccgatcgatccagtgcgtcctgcatggaaactgccgccgtcgccgcctccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacttcggacgtgctggcgagcgtcgagaggcacgccaacgcggtctcggcggcggcggtcgacaaggccaagcgcgtctgcgccgaccatccgcacgtcaaggtggagacgatggtggagagcggggacccgcgggacgtcatctgcgacgcagccaacaagatggccgtgggcagccatggttacggcttcatccaaagggcgttcttgggcagcgtcagcaaccactgcgcgcagaactgcaaatgcccggtcctcattgtcaagaggcccaaggagtagaaggttcctcgcatgtaacgctgcagcttagccaataatgtttcatgggcgaccatataggcatatatgtacacacctcacatcccattgcatggcagtcttcccttccctagttcaacaactagctttctgctggaataaggtgttcagacagagtatgtactgtacatactatcttcttgcatttggtactcttgtttggagagaagcgttccgtaaccttcggttgcct

SEQ ID NO: 5140 - DNA, 1002 bp, Glycine max
  misc_feature (1)..(1002): useful for making plants with increased salt and oxidative stress tolerance as described in USSN 12/282,342
  misc_feature (1)..(1002): Ceres CLONE ID no. 611156
attatccagcaaacactatctcaatagtgaagctctaaaccactgccaagtatggtagtttcttcgtgctctttgagctggatttcaccttgcttatcccataagctaaacttgccacatacaaattgtttgcctcgcaacattgcaacttcatcttccaacactgtcttttgtgaattggacacaacccccagcggagaaagtcattgccggagaagaccgctactgttaggcattggagcattaactgcaaatttacaaccaacaaatttggtctttgctcaagaaaaaccagacagataccgagcttttgtggactatgaagatgggtattcttacgtatatcccattgattggaaggaatttgacttcagggctcatgattctgcattcaaagacagatatctacagttacagaatgtacgggtgagatttataccaaccgagaagaaagacatccgagatttgggtcctatggaagaggttatatacgatttggtgaaacatagatacgcagcaccaaaccaaagaccaacaataaatgacatgcaggagaaaaccatagatggaaaacattactatacctttgaatatatacttacatcaccaaattattctagtgcctcctttgcaacaattgctataggaaatggaaggtactacacgttaattgttggagccaatgaaaggcgatggaaaagatttcgagatcagcttaaagtggtagcagactcctttaggcttcttgacatctgaaatgtcacgggacaatgcaaaacatgttttaatttgcctacagatcaagtttgaaatattcgtatatcagagcaaaataagtttttacaagtgaatgatatcttctactataccaatagaactctcttttgtacatcgcatgcaaagtgactttgtctgtcatttgtggtgcaaactcaattcgttgttcctcgtctactcttacattgttccactgctactcctttatggagtatttcggttggg

SEQ ID NO: 5141 - DNA, 944 bp, Zea mays
  misc_feature (1)..(944): useful for making plants with increased salt and oxidative stress tolerance as described in USSN 12/282,342
  misc_feature (1)..(944): Ceres CLONE ID no.1551032
agtcgcctcgattcgcttccgccccatcctccttcccgacgcctcacatggcaacggccgtgcccgccgcctgcctccgcgcgccgtgctcctctccagcggccgtcgcacgccgacttggggccggtggcccgtcgctgcgcaagcggcattgcgccgtcgcgcccgtcgctgccgcctgcggccccgcgccgccgcggctgcttgacaacgaggaggcggtctgctccgtacggcggcgtgtgctggttgccggtgccgccgcgttcctctcccggcctaatccggcggcattcgcagcagaggctaagaaagggttcctgcccgtcgtcgacaagaaggctggctactctttcctctacccgttcggatgggaggaagtggctgtgcaagggcaagacaaggtgtacaaagatgtgatagagcctctcgagagtgtgagcgtcaactctattccaactagcaaggaggatatccgtgatcttggtcctccggataaggttgccgaggctctgattaaaaaggttttggcaccatcaacacagaagacaaagttaattgaggcgaaagagaatgatgttgatgggagggcttactacacttttgagttcacagctcaggctccaaactacaccagacatgcacttggtgctattgtaattgcaaatggcaaattttacacattgaccactggagcaaacgagaggaggtgggaaaagatgaaggataggctgcatactgttgtggattccttcaaaatcgaaaatagaatatgagtgcctgaattgctgtgttgtttttccttcgttgattcgctttttcttacataactgcagtgctgagatttttcagtagtaaataccgggattgtggattatgctgatcagtttcatttcgaaatgtttgttaccagacttgagcaaaaataaaaaaaaaaaaaaaaa

SEQ ID NO: 5142 - DNA, 1395 bp, Triticum aestivum
  misc_feature (1)..(1395): useful for making plants with increased salt and oxidative stress tolerance as described in USSN 12/282,342
  misc_feature (1)..(1395): Ceres CLONE ID no.703785
atctgaatgctagaaggaggtggttggacgatgaggcatcccaacacggtagaaggagttccgcctatcgaagttgagagggccaatttgaaaaaaagaaaaagttgagagggacagagagggaaacatctgggcattctcgttgcagaaagtagagcgctgtacaaacgggccttcacgaaccaagagacatccatcaaatttcatggcgtcctctccacaatcctcctcctctgcacccaaagccgacgacaaggcagcgtcccacaaagaaatctacgaccagctactagaggtcgtgtccacctacccgacggcgcctagcggcatcggccgcccgtacacccaccacccagacggctggtacgcgttcacgccggccgtcgtgaacgccatggtcatcaagcggcacctcaaggcgtgcgacaccgacgtcttcctctccacctttcccaagtccggcaccacctggctcaaggcgctcctgtttgcgaccctccgccgcaccgcggacgggccagcgatcgcggcgctcgcagcccacagcccccaccagctcatccctttcctcgaggtccaggttttcagcaacggccggatcccagacctgagctccctccctgcgccgcggctcctgatgacgcacatcccgtcccggtcgctgccggagtccgtggccgcctccggctgcaaggtggtgtacctgtgccgggaccccaaggactgcttcgtgtcgctctggcacttctggaaccggttcgcgccgtcgccgtgggacctcggtgaggcgctccagcagttctgcgacggcgtctccctgttcgggcctttctgggagcacgtgctgggctactggcgctggcatgtggagaggccggagcaggttctattcctgacctacgaggagctcgccgccgacaccctcggccagctgaagcggctcgctgcgtttctcgggcgcccgttcacgtcagaggagcgggaagccagggtagacagggagatcgtggaggcatgcgccatggagagcctggcgggactggaggtgaaccgctccgggaagacggacatgaccgagtcttcagtggcgaacaacatattcttccggcgcggcgtcgttggcgactggaagaaccacctgacgccggagatggctagaaggatcgatgagatcaccgatagcaagttcagaggatcggggttggcgttgacgccggcaaccgcagatcagaactagtgggttcatgatggcagatgctatataaataaggacgacttgcgcaacatttttataaaatattgtactattaatgtcaggcatgataacttgatcagcaaacatgcgaagggaaataacagaagtgttaccatacagtaatatacatgaatatcgtt

SEQ ID NO: 5143 - DNA, 1320 bp, Zea mays
  misc_feature (1)..(1320): useful for making plants with increased salt and oxidative stress tolerance as described in USSN 12/282,342
  misc_feature (1)..(1320): Ceres CLONE ID no. 1064128
atttacgattagcctagcgactcggcatggctactgtcttcccccgtgacgccggcgtctccacgccggaagccgacgaggctaagaaaatctacgatgaagcacggcgagtggtgtccacctacgagactgttcccagtcccagcggaaccctgcaggattactgccgccaccccagcggctggtgcataaccctgccgatcatggtgagctccatggtcgcagagcagcactttgaggcgcgtggcaccgacgtgctccttgttacgatgcccaagtccgggactacctggatcaaggccctcctctatgctgcggcccaccgcactgacgacacatcatcgtccatactccggcagctcgcctcccacaactcccaccagctcgttcctttcctcgaggcccaggtctacaccaaggaccagattccagacctgagctcgcttcccgcgccacggctcttcgccacgcacatcccggctgagtcgctgccaccctccgttgtggcgtccggctgcaaggtggtgtacttgtgccgggaccccaaggactgcttcgtgtctctctggcactttatgaacaagttcaccccatgggacatcgacgaggcacacggccggttctgcgagggtgtctcgttgtatgggccattttgggagcacgtgctgagctactggcgttggcacgtcgaccgaccgggtcaggtgctcttcctgacttacgaggagctcagcgccgacccgctcggccaactgaggcgcctagccgagttcattgggcgccccttcacgccgggggagcaggaggcgggagtggacagggagattgcggaggcatgtgccatgaaaagcatggtcaaccaggaggtgaaccagtccaggacgaccgaaatcgttgagatgccgattcccaacgggatcttcttccggcgaggcgtggtcggagactggaccaactacctcacgccggagatggcaggaaggatcgatgagattaccaagagcaagtttgaaggatccggcctcatgctgccgaaaacaatctcggaaatctcaaagatctagcatccctccgtcgtgtttgatgtttgaaatcgttcaccttttttttctcttgttgtaaactgcaccctgctggcactggcttggctgaataaaaaaagcttgcattgttcttgttgatcaaacgaaataccagctggcgagttgttgatgttacggaaaaggcctgcttagtcttaggtatttttcttatcggtttaattgtgatcaaatgtgtttgtactctgcttaattattaataaaaatgattgtatgcacc

SEQ ID NO: 5144 - DNA, 864 bp, Arabidopsis thaliana
  misc_feature (1)..(864): useful for making plants with increased salt and oxidative stress tolerance as described in USSN 12/282,342
  misc_feature (1)..(864): Ceres CLONE ID no. 5367
actatcaattcgactggaaaaaggatatttccagattaggtagagagagagcaaaagtactttcattcagacttcagtttaagctatggcggcgaacgattcttcaaatgctattgacatcgacgggaatctcgactccgattcgaatcttaacactgacggtgacgaagcgaccgataatgattcctcgaaggcattggttactatccctgctccagccgtttgtcttttccggttcgccggagatgctgctggtggcgccgttatgggctctatcttcggatatggttcaggattgttcaagaagaaaggcttcaaaggatcatttgcagatgcagggcagtctgctaagacttttgctgttttatctggagtccacagtttggttgtttgccttctgaagcaaatccgaggcaaagatgacgccattaatgttggagtagcagggtgttgcactggtcttgctcttagtttccctggtgctccacaggctcttctacagagttgtctcacgtttggggcattctcttttattcttgagggactcaacaaaagacaaacagctttggcacactcggtctcgttgagacaccaaaccggactgttccaagatcatcatcgtgctttaccactctctcttgctctcccgatccctgaagaaatcaaaggagccttttcttctttctgcaagtccttagctaaaccaaggaagttctaatctcgtcttattattctccctttcttgtgtcttaggctctctctatgtagatgtaaaattttcccgcttttgttgtactttgtgagacatgttttgtgaaaggctttttgcaagagccaatttgaagagaaaaagagttgtgtacg

SEQ ID NO: 5145 - DNA, 766 bp, Zea mays
  misc_feature (1)..(766): useful for making plants with increased salt and oxidative stress tolerance as described in USSN 12/282,342
  misc_feature (1)..(766): Ceres CLONE ID no. 1060894
aggtagaaagcgaaactctctctccagcttcagaggcttcagctatggcggccgagaatccttcaaacggtgtagacgtcgacacgagtctcgcttccgattcaaacgataaccgcaaagccagtgatttgaccaatcatgactcttccatggcattgacagtcccttccaccgccgtttgtctcggccgtttcgccggagatgcagcaggcggcgccgtcatggggtctatattcggctatggttctggattgtttaagaaaaaagggtttaagggatcatttgcggatgcgggtcagtctgcaaagaattttgcgattttatctggagtgcacagtttggttgtttgccttctgaagaaactgcgagggaaagatgatgccattaacgttggaattgctggatgctgcactggccttgctcttagttacccaggtgcaccacaagcaatgctacaaagctgtgtcacttttggtgccttttctttcatcctcgaaggactcaacaagaggcaaacagctttggctcactctgtctcctcgagacatgatcaaaccagaagtctgaaagatgatttaccactctccttggctctcccaatccatgaagagatcaaaggagctttctcatccttctgcaaatctttaacaaaacccaagaagctcgcgttccctagctcacgttgatcgaagttttttttgtatcctactacttccttttgtagatgttaaaagaacagatgaaaacaagaatcatgtttcaaaac

SEQ ID NO: 5146 - DNA, 864 bp, Triticum aestivum
  misc_feature (1)..(864): useful for making plants with increased salt and oxidative stress tolerance as described in USSN 12/282,342
  misc_feature (1)..(864): Ceres CLONE ID no. 639280
gaaacaggaaacgataacgaaactcgcagagagggcggacatggcggcgaggagcgagaacgagtcggacggcgacgtgggcaccaaccccgccgaggggggctcgtccctgtccctgccgcctctagctgccggtccagccgtgtgcgtcctccggtccgccggggacttcgccggcggcgccttcgtcggatctatctttggatatggacaaggtttgctatctaagaagggtttgaagggctcactcggcaatgcagggtcttctgccaaaagttttgcagttctttctggcgtccagagtttggttttgtgcttgttgaggaagctgcgtgggaaagatgatatcatcaattccggcattgctggttgttgcacaggtcttgctttgagttttccaggtacaccacaagcgctgcttcagaactgcgccaccttcgcagcattctcatgcatcatggaggggctcaacaagcagcagaccgcgatggcgcacaccctcactgggaacgccttgacctttgcacacgacaatggcgcgggcgtcctccccccttcactctccccccaatcctcgatgcttccgatgctttcgcctcatgctgccaggccttggtcgccaagcctaagaagcactagacagcagcattaggagggagagagtgagatatgctcaggaaacctagctagctcctagcgttatgtaaattttgcttttggataatgtcgaaaatctagattgtttgctttttcagccgggtgttttttgtcgccgcgtttcgtggcgtgggcttgctttgttgatgatatgtcaaggatagattttgtttaccgggaagataagatgtcgtggaaaattttgcc

SEQ ID NO: 5147 - DNA, 827 bp, Artificial Sequence
  misc_feature (1)..(827): useful for making plants with increased salt and oxidative stress tolerance as described in USSN 12/282,342
  misc_feature (1)..(827): Ceres CLONE ID no. 29658
  misc_feature (1)..(827): Ceres Seed Line ID no. ME02907
gtaagggatgacgcacaatcccactatccttcgcaagacccttcctctatataaggaagttcatttcatttggagagaacacgggggactctggcctgcagggccatcaccactgcagtggtacctagaacatcctaatcgaaaaattcatctccaaactttcaaaaaaaaacctaaaacaaaaaaaatctctttccttcttctttctccatcaatggcgtcaacaaaacccaccgatcaaatcaaacaactcaaagatatcttcgctcgcttcgacatggacaaggacggaagcttaacgcagctagaactcgccgctcttctgcgttctctcggaatcaaacctcgcggcgatcaaatctctcttctgtaaaaccaaatcgaccgtaacggtaacggatccgtagagttcgacgagctcgtcgtggcgatattgccggatataaacgaagaggtgttgataaatcaagaacagttgatggaggttttccgttcgtttgatcgtgacggtaacggttcaataacggcggcggaacttgctgggtcaatggctaaaatgggacatccgttgacttaccgtgaattaacggaaatgatgacggaagctgattcaaacggtgacggtgttattagttttaatgagttttctcatattatggctaaatcggctgctgattttcttggattaaccgcttcttgatctgttttgttttaattactctctttttttcttctcctgtcaatgcaacttgtgcaattaacaatgtgctaatctttcgtttggtgtgacgtaaaaatttataaaaaaaaaaaaaaaaaaaaaaaaa

SEQ ID NO: 5148 - protein, 73 aa, Artificial Sequence
  misc_feature (1)..(73): useful for making plants with increased salt and oxidative stress tolerance as described in USSN 12/282,342
  misc_feature (1)..(73): Ceres CLONE ID no. 29658
  misc_feature (1)..(73): Ceres Seed Line ID no. ME02907
  misc_feature (1)..(73): Peptide encoded by SEQ ID NO. 248
  misc_feature (1)..(73): Phenotype: ROSETTE LEAVES Useful for making ornamental plants with modified leaves
MEVFRSFDRDGNGSITAAELAGSMAKMGHPLTYRELTEMMTEADSNGDGVISFNEFSHIMAKSAADFLGLTAS

SEQ ID NO: 5149 - protein, 121 aa, Artificial Sequence
  misc_feature (1)..(121): useful for making plants with increased salt and oxidative stress tolerance as described in USSN 12/282,342
  misc_feature (1)..(121): Ceres CLONE ID no. 29658
  misc_feature (1)..(121): Ceres Seed Line ID no. ME02907
  misc_feature (1)..(121): Peptide encoded by SEQ ID NO. 248
  misc_feature (1)..(121): Phenotype: ROSETTE LEAVES Useful for making ornamental plants with modified leaves
MTHNPTILRKTLPLYKEVHFIWREHGGLWPAGPSPLQWYLEHPNRKIHLQTFKKKPKTKKISFLLLSPSMASTKPTDQIKQLKDIFARFDMDKDGSLTQLELAALLRSLGIKPRGDQISLL

SEQ ID NO: 5150 - protein, 52 aa, Artificial Sequence
  misc_feature (1)..(52): useful for making plants with increased salt and oxidative stress tolerance as described in USSN 12/282,342
  misc_feature (1)..(52): Ceres CLONE ID no. 29658
  misc_feature (1)..(52): Ceres Seed Line ID no. ME02907
  misc_feature (1)..(52): Peptide encoded by SEQ ID NO. 248
  misc_feature (1)..(52): Phenotype: ROSETTE LEAVES Useful for making ornamental plants with modified leaves
MASTKPTDQIKQLKDIFARFDMDKDGSLTQLELAALLRSLGIKPRGDQISLL

SEQ ID NO: 5151 - protein, 498 aa, Zea mays; identical to SEQ ID NO: 3386
  misc_feature (1)..(498): useful for making plants with increased salt and oxidative stress tolerance as described in USSN 12/282,342
  misc_feature (1)..(498): Ceres Clone ID no. 375578
  misc_feature (1)..(498): Full Length Peptide Sequence for Ceres CLONE ID no. 375578

SEQ ID NO: 5152 - DNA, 873 bp, Glycine max
  misc_feature (1)..(873): useful for making plants with increased salt and oxidative stress tolerance as described in USSN 12/282,342
  misc_feature (1)..(873): Ceres CLONE ID no.565421
tcaacataactgttgttcccttctttgcactgcaaattccctgtgcatgtattagtttttgattgatttttttttctctgaggggggcacattaattgtgctcaatactcatacattgcggttcctttattattttgtaattcattacattgatattgattaacatgtcatttgtcaaaaagagtctaatttagttggttgatcagagtgtgtgatagtcttcgattccacggattaaagaaaaattaacatgtcatcaaagcttcaagttcagcagcttaatcagttaagggagattttcggtcgatttgacatggactcagatggaagcctaacaatgctagagctagcagcacttcttaggtctctggggctgaagccctcgggtgaccaagtccaagcactgttagccaacatggactcaaacgccaatggcaaagtggagtttgatgaattgataagagccatattacctgacataaatgcacaggttttgctgaaccaagaacagctcctaggggtgttcaagtgcttcgatcgcgacggcaacggttacatatcggccgcagagttggccggggcaatggccaaaatgggccagccactcacgtaccgagagctcacggagatgatcaaagaggctgacacggatggggatggtgttattagcttcactgagtttgccactatcatggctcgctctgcttctgattttctaggcctctcgttctgctgaccgtataacatatattcatttcatctaagttgtacaatattcttgattttttttccttttgaatgaatgaatcaatcaaataatgatatttggtttgtactgggtattactaatactaattacccacaattcctgcc

SEQ ID NO: 5153 - protein, 161 aa, Glycine max
  misc_feature (1)..(161): useful for making plants with increased salt and oxidative stress tolerance as described in USSN 12/282,342
  misc_feature (1)..(161): Ceres CLONE ID no. 565421
  misc_feature (1)..(161): Functional Homolog of Ceres Clone ID no. 29658 at SEQ ID NO: 5006
  misc_feature (87)..(115): Pfam Name: efhand Pfam Description: EF hand
  misc_feature (100)..(100): Xaa is any aa, unknown or other
  misc_feature (151)..(151): Xaa is any aa, unknown or other
MSSKLQVQQLNQLREIFGRFDMDSDGSLTMLELAALLRSLGLKPSGDQVQALLANMDSNANGKVEFDELIRAILPDINAQVLLNQEQLLGVFKCFDRDGXGYISAAELAGAMAKMGQPLTYRELTEMIKEADTDGDGVISFTEFATIMARXASDFLGLSFC

SEQ ID NO: 5154 - DNA, 842 bp, Arabidopsis thaliana
  misc_feature (1)..(842): useful for making plants with increased salt and oxidative stress tolerance as described in USSN 12/282,342
  misc_feature (1)..(842): Ceres CLONE ID no.3747
actttttctccaatggcttctctgaagctttcaccttcttctccaatctccatttctaaggttggtgtgattccttcctctaagaaaggactttcatttcttgtaaaagcagagcaccattcctcgtcttcttcttctcatcttcaagataaatgtcagagacgtctgattgtaacatttggtgttgttgctccttggatctcattgcttagtagagctccattatcatttgctgcagaaagcaaaaaaggattccttgctgtctctgacaataaagatgcttatgcgtttctctatccatttggttggcaggaagttgtgattgaaggtcaagataaggtatacaaagatgtgattgagcctttagaaagtgttagtgtgaatttggtcccaactagcaaacagactattaaagaatttggccctcccaagcagatagctgaaacactgataaagaaagttttggcacctccaaatcagaaaacaacccttattgatgcatcagagcatgatgtcgatgggaagacttattatcagtttgagttcactgttcaagctagaaactacactcgccatgctctgggtaccatcacggttttcaacggaaacttctacacactgacgacgggagcgaatgaaaggaggtgggagaagatgaaagataggcttcacactgtggtagattccttcaagatcactgtttgaaaatactgtaatcaagtttgctttggttgtctcttgttttgcccatttcttgtatttttgtccattcttcttctctctttcccttaacaatattcttttcctgtaagagagattcaataactcttgacttgcctccc

SEQ ID NO: 5155 - protein, 230 aa, Arabidopsis thaliana
  misc_feature (1)..(230): useful for making plants with increased salt and oxidative stress tolerance as described in USSN 12/282,342
  misc_feature (1)..(230): Ceres CLONE ID no. 3747
  misc_feature (1)..(230): Functional Homolog of Ceres Clone ID no. 16403 at SEQ ID NO: 5029
  misc_feature (43)..(229): Pfam Name: PsbP Pfam Description: PsbP
MASLKLSPSSPISISKVGVIPSSKKGLSFLVKAEHHSSSSSSHLQDKCQRRLIVTFGVVAPWISLLSRAPLSFAAESKKGFLAVSDNKDAYAFLYPFGWQEVVIEGQDKVYKDVIEPLESVSVNLVPTSKQTIKEFGPPKQIAETLIKKVLAPPNQKTTLIDASEHDVDGKTYYQFEFTVQARNYTRHALGTITVFNGNFYTLTTGANERRWEKMKDRLHTVVDSFKITV

SEQ ID NO: 5156 - DNA, 1205 bp, Arabidopsis thaliana
  misc_feature (1)..(1205): useful for making plants with increased salt and oxidative stress tolerance as described in USSN 12/282,342
  misc_feature (1)..(1205): Ceres CLONE ID no.34878
acaacactcgacacagaagcaaaaacaaaaatgggtgagaaagatattccaaggaacttgaaggaagaagaagaaaaccaaagtgaagattccaaaagtttgatctcttcacttccttcagacatagattgctctgggaccaagttgtacaagtatcaaggatgttggtacgataaagacattctccaagcaatcctcaaattcaacaaaatctttcagccacaagaaaccgatataattgttgcttctttccccaaatcaggtacgacttggctcaaggcactcacattcgcactcgctcaaagatcaaaacatacttcagaaaatcatcctctgctaactcataatcctcatgagctagtgccgtacctcgagctcgatctttatctcaaaagctcgaaaccggatatgtccaagttaccatcatcatctccgagattgttctcaacccacatgtctttcgatgcgcttaaagtaccaatgaaggagactccttgcaagatagtgtatgtgtgcaggaacgtaaaagacgtgttggtatcactttggtgtttcgaaaactccattagtggagaaaacaatttaagtctcgaggctttgttcgagtctttatgtagcggagttaacttatgcggtcccttgtgggaaaatgtgttaggctattggagaggaagcttggaagatcctaagcatgtgcttttcttgaggtacgaggagttgaagacggagcctcgtgtgcaaatcaagagacttgcagagttcttagattttccattcacaaaggaagaagaagatagtggaggtgtagacaagatcttggaactttgttctctaagaaaccttagcggtttggagatcaacaaaacaggaagcttgtcggaaggagtaagtttcaagagttttttccgtaaaggggaagttggtgattggaagagttatatgactcctgaaatggaaaacaaaatcgacatgattgttgaggagaaacttcaaggctctggtttgatattgtagagttcatatctctatgtatatgtgaacaggtttaatctcaaacctaataatgctggtttgttcttttcttgtatgcaatgtaataaaagttactttgatgtaaggttaagagtttaagattctgagcgatgtgtcgtttttgtttcctttgataatcaataaagctagcggcttttcttcttcgccaaggc

SEQ ID NO: 5157 - protein, 327 aa, Arabidopsis thaliana
  misc_feature (1)..(327): useful for making plants with increased salt and oxidative stress tolerance as described in USSN 12/282,342
  misc_feature (1)..(327): Ceres CLONE ID no. 34878
  misc_feature (1)..(327): Functional Homolog of Ceres Clone ID no. 3964 at SEQ ID NO: 5037
  misc_feature (66)..(324): Pfam Name: Sulfotransfer_1 Pfam Description: Sulfotransferase domain
MGEKDIPRNLKEEEENQSEDSKSLISSLPSDIDCSGTKLYKYQGCWYDKDILQAILKFNKIFQPQETDIIVASFPKSGTTWLKALTFALAQRSKHTSENHPLLTHNPHELVPYLELDLYLKSSKPDMSKLPSSSPRLFSTHMSFDALKVPMKETPCKIVYVCRNVKDVLVSLWCFENSISGENNLSLEALFESLCSGVNLCGPLWENVLGYWRGSLEDPKHVLFLRYEELKTEPRVQIKRLAEFLDFPFTKEEEDSGGVDKILELCSLRNLSGLEINKTGSLSEGVSFKSFFRKGEVGDWKSYMTPEMENKIDMIVEEKLQGSGLIL

SEQ ID NO: 5158 - DNA, 1459 bp, Zea mays
  misc_feature (1)..(1459): useful for making plants with increased salt and oxidative stress tolerance as described in USSN 12/282,342
  misc_feature (1)..(1459): Ceres CLONE ID no.295570
  misc_feature (286)..(286): k is g or t/u
  misc_feature (378)..(378): s is g or c
  misc_feature (431)..(431): m is a or c
  misc_feature (492)..(492): s is g or c
  misc_feature (592)..(592): s is g or c
  misc_feature (820)..(820): s is g or c
  misc_feature (873)..(873): w is a or t/u
  misc_feature (952)..(952): s is g or c
  misc_feature (1113)..(1113): y is t/u or c
  misc_feature (1256)..(1256): w is a or t/u
  misc_feature (1263)..(1263): s is g or c
  misc_feature (1265)..(1265): w is a or t/u
  misc_feature (1266)..(1266): k is g or t/u
  misc_feature (1267)..(1267): k is g or t/u
  misc_feature (1273)..(1273): r is g or a
  misc_feature (1275)..(1275): m is a or c
  misc_feature (1283)..(1283): s is g or c
  misc_feature (1292)..(1292): s is g or c
  misc_feature (1297)..(1297): m is a or c
  misc_feature (1302)..(1302): w is a or t/u
  misc_feature (1323)..(1323): s is g or c
  misc_feature (1324)..(1324): m is a or c
  misc_feature (1325)..(1325): w is a or t/u
  misc_feature (1335)..(1335): m is a or c
  misc_feature (1337)..(1337): r is g or a
  misc_feature (1339)..(1339): m is a or c
  misc_feature (1364)..(1364): w is a or t/u
  misc_feature (1374)..(1374): s is g or c
  misc_feature (1389)..(1389): y is t/u or c
  misc_feature (1391)..(1391): m is a or c
  misc_feature (1409)..(1409): r is g or a
  misc_feature (1412)..(1412): r is g or a
acgcagggtggctaggagttgagtcgtgcagaagagacaaaggtcctcacttggctaagctagacacgtacgagtgcaggaaacaagataagtcgcggtttgcgacggcgagaagcgccggatgagtgtccactgtccacaagtccagattccaattccagtccgatcgtgagctcagctcagctccgctagtcctctccccgcacgcaccaccaccagcagcagtccagcaccatgggcggcgccctgctcctcacgctgctcctcgcggccgtgcccctctccktgggcggcggcggcggcgcgcacccgggctactccgacgacgacgagagcgcctgcacggtggacgcgggcgcggagctgctgcggcggatsgaggagcgcgggcccgacaggcgcatcatcgacatcacgcacgcggtcgtgcmggacctgccggcgttcgccacgggggcggtcgcggggcccatgctgcgcctcagggagtcsatggcggacgggtcgcgagtacaacctgtcggagctgcggatggagtgccacaccggcacgcacgtcgacgcgcctggccacatcaaccaggcccacttsgccgcctgcctcgacgtcgacacgctcgacctccacgtcctcaacggacctgcattgctagttgatgtgccaagaaacacaaatataacagctgaagcgatggaattcctaaacatcccgagaggggttcgccgagttctgttcagaacactgaacactgacaggaagttgatgtggaggaagggaggtgacatgagctacgttgggtttacagaggatggcgcgcastggttagtcgacaacaccgacataaagctagttggagttgacggtctgtcagwggcatcatttgatcacctgatctctgcccacgtggtcttttttcaaaaaaccccggatataatccctgttgagagcctsaatctggacgacatcgaggcggggatatacatgctgcactgtctacctctcaggctggtcggagccgagggtgcaccgaccagatgcatcctcatcaagtgatcgttcctcggccggcctgctcttgctgccttgctggaggtggcgacactggaccatgyccagctgagctggtgctccgtcgtgggtcgcgtggccaatatttggctcgcatgcagtcgtcgatctatatggaacagaacactgcatgcctatgtagatacgcttgtatggacaataaaggaaccgcagtacttctgtcgawgaaatastwkkgggtgrgmcggtaatstaaaacacsaggcmtactwggttaagctgggaggccctgsmwaggctgaggmtrgmggctggggatggatccagagttttwattcgaatgstatttttttttgggycmtattttctttgattgtaracraataacatatatgattttctatatctctactaaaaaaaaaaaaaaaa

SEQ ID NO: 5159 - protein, 271 aa, Zea mays
  misc_feature (1)..(271): useful for making plants with increased salt and oxidative stress tolerance as described in USSN 12/282,342
  misc_feature (1)..(271): Ceres CLONE ID no. 295570
  misc_feature (1)..(271): Functional Homolog of Ceres CLONE ID no. 8686
  misc_feature (57)..(257): Pfam Name: Cyclase Pfam Description: Putative cyclase
MGGALLLTLLLAAVPLSLGGGGGAHPGYSDDDESACTVDAGAELLRRMEERGPDRRIIDITHAVVPDLPAFATGAVAGPMLRLRESMADGSEYNLSELRMECHTGTHVDAPGHINQAHFAACLDVDTLDLHVLNGPALLVDVPRNTNITAEAMEFLNIPRGVRRVLFRTLNTDRKLMWRKGGDMSYVGFTEDGAQWLVDNTDIKLVGVDGLSVASFDHLISAHVVFFKTPDIIPVESLNLDDIEAGIYMLHCLPLRLVGAEGAPTRCILIK

SEQ ID NO: 5160 - DNA, 1212 bp, Arabidopsis thaliana
  misc_feature (1)..(1212): useful for making plants with increased salt and oxidative stress tolerance as described in USSN 12/282,342
  misc_feature (1)..(1212): Ceres CLONE ID no.150484
acaacactcgacacaaaagcaaaaacaaaaatgggtgagaaagatattccaaggaacttgaaggaagaagaagaagaagaagaagaaaaccaaagtgaagaaaccaaaagtttgatctcttcacttccttcagacatagattgctcagggaccaagttgtacaagtaccaaggatgttggtacgacaaagatattctccaagcaatcctcaatttcaacaaaaactttcagccacaagaaacggatataattgttgcttctttccccaaatcgggtacgacttggctcaaggcactcacattcgcactcgcgcaaagatcaaaacacacttcagacaatcatcctctgctaactcataatcctcatgagctagtgccgtacctcgagctcgatctttatctcaaaagctcgaaaccggatttgaccaagttgccatcatcatctccgagattgttctcaacccacatgtcctttgatgcgcttaaagtaccgttgaaagagtctccttgcaagatcgtgtacgtgtgcaggaacgtgaatgacgtattgatatcactttggtgtttcgaaaactccatgagtggagaaaacaatttaagtctcgaggctttgttcgagtctttatgtagcggagttaacttatgcggtcccttatgggaaaatgtgttaggctattggagaggaagcttggaagatcctaagcatgtgcttttcttgaggtacgaggagttgaagacggagcctcgtgtgcaaatcaagagacttgcagagttcttagattgtccattcacaaaggaagaagaagatagtggaggtgtagacaagatcttggaactttgttctctaagaaaccttagcggtttggagatcaacaaaacaggaagcttgtcggaaggagtaagtttcaagagttttttccgtaaaggggaagttggtgattggaagagttatatgactcctgaaatggaaaacaaaatcgacatgattgttgaggagaaacttcaaggctctggtttgaaattgtagagttcatatctctatgtatatgtgtgggaacaggtttaatctcaaacctaataatgctggtttgttcttttcttgtatgcaatgtaataaaagttactttgatgtaaggttaagagtttaagattcttagtgatgtgttgttgtttttgtttcgtttgataacgaataaagctagcggcttttctc

SEQ ID NO: 5161 - protein, 331 aa, Arabidopsis thaliana
  misc_feature (1)..(331): useful for making plants with increased salt and oxidative stress tolerance as described in USSN 12/282,342
  misc_feature (1)..(331): Ceres CLONE ID no. 150484
  misc_feature (1)..(331): Functional Homolog of Ceres Clone ID no. 3964 at SEQ ID NO: 5037
  misc_feature (70)..(328): Pfam Name: Sulfotransfer_1 Pfam Description: Sulfotransferase domain
MGEKDIPRNLKEEEEEEEENQSEETKSLISSLPSDIDCSGTKLYKYQGCWYDKDILQAILNFNKNFQPQETDIIVASFPKSGTTWLKALTFALAQRSKHTSDNHPLLTHNPHELVPYLELDLYLKSSKPDLTKLPSSSPRLFSTHMSFDALKVPLKESPCKIVYVCRNVNDVLISLWCFENSMSGENNLSLEALFESLCSGVNLCGPLWENVLGYWRGSLEDPKHVLFLRYEELKTEPRVQIKRLAEFLDCPFTKEEEDSGGVDKILELCSLRNLSGLEINKTGSLSEGVSFKSFFRKGEVGDWKSYMTPEMENKIDMIVEEKLQGSGLKL

SEQ ID NO: 5162 - DNA, 1155 bp, Arabidopsis thaliana
  misc_feature (1)..(1155): useful for making plants with increased salt and oxidative stress tolerance as described in USSN 12/282,342
  misc_feature (1)..(1155): Ceres CLONE ID no.1368
  misc_feature (733)..(733): r is g or a
aaatcaccaaccagtgacctaacaatggccgttcctccattattcttcctcctcacactcctctctctcccttctcttcttatctccgccggtgcttccaatgcctatccttctattcccggaaccgctcctatcgacggaggtttcaccgatgaacttaaacccattcgccgtgaagtctacgggaatggcaaaatctatgacatcagtcaccgttacactccggagatgccgtcgtgggactcatcggaaggaatcggacggttcctatggttagctgcgagtatgaagaacggatctcttgctaataactctgaaatgaagattcccacgcacactggtactcatgttgattcacctggtcacgtctatgacaagtattacgatgctggctttgatgttgactcgcttgatcttcaagtcctcaatggtcttgcgttgttggttgatgttccaaaggataagaacattactgctgaagtgatgaaatctcttcacattccaaaaggagttagtcgtgtgcttttcagaacattgaacactgacaggcgtcttatgttcaagaaagaatttgatacaagctatgtcggattcatgaaggatggtgcgcaatggttggtagacaacacagacatcaaacttgttgggattgattatctatcagtagctgcatatgatgatcttattccatcccacctagtattcctaaaagaccgggagactatactcgtgraggggttgaagctggatggtgtgaaggcaggactctactctgtccattgcttacctctaagactggttggagcagaagggtctccaattcgttgcatcctcatcgattgattctctcccatcacaaacctgccaaatccgaaattgtccgtaatcaaaagcttgcttagcttatgaactgaatatcagtttgtgctagatttatgcaaccaatatggagattgaagtaggaagaaataagagagatgcagagaagaccaagttgatgataatgaagcaccgaagaaaaaagatttttcatttctatgtatatgtcaataaataaattaaaaattctcttaatctgtcaaggttgtactaattatcaaatagggaaaagttcataacatataaatccttgttgaaataggtttttgttttccc

SEQ ID NO: 5163 - protein, 272 aa, Arabidopsis thaliana
  misc_feature (1)..(272): useful for making plants with increased salt and oxidative stress tolerance as described in USSN 12/282,342
  misc_feature (1)..(272): Ceres CLONE ID no. 1368
  misc_feature (1)..(272): Functional Homolog of Ceres CLONE ID no. 8686
  misc_feature (58)..(258): Pfam Name: Cyclase Pfam Description: Putative cyclase
MAVPPLFFLLTLLSLPSLLISAGASNAYPSIPGTAPIDGGFTDELKPIRREVYGNGKIYDISHRYTPEMPSWDSSEGIGRFLWLAASMKNGSLANNSEMKIPTHTGTHVDSPGHVYDKYYDAGFDVDSLDLQVLNGLALLVDVPKDKNITAEVMKSLHIPKGVSRVLFRTLNTDRRLMFKKEFDTSYVGFMKDGAQWLVDNTDIKLVGIDYLSVAAYDDLIPSHLVFLKDRETILVEGLKLDGVKAGLYSVHCLPLRLVGAEGSPIRCILID

SEQ ID NO: 5164 - DNA, 1273 bp, Arabidopsis thaliana
  misc_feature (1)..(1273): useful for making plants with increased salt and oxidative stress tolerance as described in USSN 12/282,342
  misc_feature (1)..(1273): Ceres CLONE ID no.124067
accaacacacaaagattccattacaaataaacaattttcatatatatctataacaaaaaaaaacaatggcgacctcaagcatgaagagcattccaatggcgatcccaagtttctccatgtgtcacaagctcgagctccttaaagaaggcaaaactcgcgacgtcccgaaagccgaagaagatgaagggctaagctgcgagttccaagagatgttggattctcttcctaaggagagaggatggagaactcgttacctttacctattccaagggttttggtgccaagccaaagagattcaagccatcatgtctttccaaaaacatttccaatccctcgaaaacgacgtcgttctcgccaccatacctaaatccggtacaacctggctaaaagctttaactttcaccatccttaaccgtcaccggtttgatccggttgcctcgagtaccaaccaccctcttttcacttccaaccctcatgaccttgtacctttcttcgagtacaagctttacgccaacggagatgttcccgatctctcgggtctagccagtccaagaacgttcgcaacccacttaccgttcggttccttaaaggaaacgatcgagaaacccggtgtgaaggtcgtgtacttgtgccggaacccgtttgacacattcatctcttcgtggcattacaccaacaacatcaaatccgagtcagtgagcccagtcttgctagaccaagcttttgatctgtattgccggggagtgatcgggtttggcccgttttgggaacacatgttgggatactggagagagagcttgaagagaccagagaaagtcttctttttaaggtacgaggatctcaaagacgacatcgagaccaacttgaagaggcttgcaactttcttagagcttcctttcaccgaagaagaggaacgaaagggagttgtgaaggctatcgccgagctgtgtagcttcgagaatctgaagaagttggaggtgaacaagtcaaacaagtcgatcaagaactttgagaatcgattcttgtttcggaaaggagaagtgagtgattgggttaactatttgtcaccttcacaagtggaaagattgtcagccttagtggatgacaagttaggtggatctggtctcactttcaggttgagctaaatataaggccacgtgcccccatttctactcttgttctgagggcctactatatacgttaagctaagttaaggcagttgtattgttgttacagatagacatcgaagcaacgtaacgtccataattaagtc

SEQ ID NO: 5165 - protein, 359 aa, Arabidopsis thaliana
  misc_feature (1)..(359): useful for making plants with increased salt and oxidative stress tolerance as described in USSN 12/282,342
  misc_feature (1)..(359): Ceres CLONE ID no. 124067
  misc_feature (1)..(359): Functional Homolog of Ceres Clone ID no. 3964 at SEQ ID NO: 5037
  misc_feature (91)..(353): Pfam Name: Sulfotransfer_1 Pfam Description: Sulfotransferase domain
MATSSMKSIPMAIPSFSMCHKLELLKEGKTRDVPKAEEDEGLSCEFQEMLDSLPKERGWRTRYLYLFQGFWCQAKEIQAIMSFQKHFQSLENDVVLATIPKSGTTWLKALTFTILNRHRFDPVASSTNHPLFTSNPHDLVPFFEYKLYANGDVPDLSGLASPRTFATHLPFGSLKETIEKPGVKVVYLCRNPFDTFISSWHYTNNIKSESVSPVLLDQAFDLYCRGVIGFGPFWEHMLGYWRESLKRPEKVFFLRYEDLKDDIETNLKRLATFLELPFTEEEERKGVVKAIAELCSFENLKKLEVNKSNKSIKNFENRFLFRKGEVSDWVNYLSPSQVERLSALVDDKLGGSGLTFRLS

SEQ ID NO: 5166 - DNA, 845 bp, Arabidopsis thaliana
  misc_feature (1)..(845): useful for making plants with increased salt and oxidative stress tolerance as described in USSN 12/282,342
  misc_feature (1)..(845): Ceres ANNOT ID no.870567
aataagaaaatcaaaatctttactcgtttgaaatttgtaatccattacctgtcatcgttgacttgtcaagaagaaacaaatcaactctaaaaagaaaaatgttgttcatcgaaatcgaagcttgacagtattcaaaatcagattcgagatgagctgcgacggaggcaaaccggcgccggcgaaactaggcgacgaacaactagcggagctccgggagatattccgatcatttgaccagaacaaggatggaagtttgacggagctcgagttaggctcacttctaagatctctcggtctaaagccgagtcaagaccaactcgacacattgatccagaaagcagatcggaataacaacggactggtcgagttctccgagttcgtcgccctcgtcgagccagatctggtcaagtgtccttacacggatgatcagcttaaagccatctttagaatgtttgaccgcgatggaaacggttacataacggcggcggagttagcccattcgatggcgaagctaggtcacgcgttgacggcggaggagttaacgggaatgatcaaagaagctgatcgagacggcgatggttgtattgatttccaagagtttgttcaagcgattacttcagctgcgtttgataatgcttggggttgaagaaagaaaggtatatatatacatagtttgaaatacttgtgttttgtttttttggcttcatcctcaaatcaaagacatttggaagtatatgtgtgtaggtgcgattccatggaaaatgtgtgttatttattgtttcatattattctttgatgaaattttgatagcttgaagagaaagctatcattgttggttttagggc

SEQ ID NO: 5167 - protein, 165 aa, Arabidopsis thaliana
  misc_feature (1)..(165): useful for making plants with increased salt and oxidative stress tolerance as described in USSN 12/282,342
  misc_feature (1)..(165): Ceres ANNOT ID no. 870567
  misc_feature (1)..(165): Functional Homolog of Ceres Clone ID no. 29658 at SEQ ID NO: 5006
  misc_feature (56)..(84): Pfam Name: efhand Pfam Description: EF hand
MSCDGGKPAPAKLGDEQLAELREIFRSFDQNKDGSLTELELGSLLRSLGLKPSQDQLDTLIQKADRNNNGLVEFSEFVALVEPDLVKCPYTDDQLKAIFRMFDRDGNGYITAAELAHSMAKLGHALTAEELTGMIKEADRDGDGCIDFQEFVQAITSAAFDNAWG

SEQ ID NO: 5168 - DNA, 1248 bp, Arabidopsis thaliana
  misc_feature (1)..(1248): useful for making plants with increased salt and oxidative stress tolerance as described in USSN 12/282,342
  misc_feature (1)..(1248): Ceres ANNOT ID no.864284
gttcacttaacaaaacaagaaccaaaaaaaatggatgagaaagatattctaaggaacttgagggaagaagaagaagaagaagaagaaaatcaaagcgaagaaaccaaaattttgatctcttcacttccttgggagatagattaccttgggaacaagcttttcaagtaccaaggatattggtactacgaagacgttctccaatcaatccccaatatacactcgagttttcagccacaagaaaccgatatagttgttgcttctttctacaaatcgggcacgacttggctcaaagcactcacatttgcactcgttcaacgatcaaaacactcgttagaagatcatcatcatcctctgctatctcataaccctcatgagatagtaccgtacctcgagctagatctgtatctcaacagctcaaaaccggacttgaccaagttcttatcatcatcatcatcatcatcatctccgagattgttctcaactcatatgtccttggacgcgcttaaactacccttgaagaagtctccttgcaaggtagtgtacgtgtgcaggaacgtgaaagacgtgttggtgtcactttggtgtttcctcaatgccaacaagggagtagaatggggagattttagccaaaatgaaaagatcattcgagcggagaattattctttcaaggctatatttgagtcattctgcaacggagttaccctacacggtcccttttgggaccatgcacagagctattggcgaggcagcttggaagatcctaagcattttcttttcatgaggtacgaggagttgaaagcggagcctcgtactcaggtcaagagacttgcagagttcttggattgtccattcactaaggaagaggaagatagcggaactgtagacaagatcttggaactttgctctctaagtaatttaagcagtttggagatcaacaaaactggatccttgggtggagtagattacaagacttatttccgtaaaggacaagttggtgactggaagagttatatgacctctgaaatggtaaataaaatcgatatgatcgtcgaggagaaactcaaaggttccggtttgaaattctagaattatgcgtgtgctttgtgaagaactgcagaaaaagtgttcttgaatgcgttatttaataataaaagttacattgtcatatatataactttgatgtatcattacaactgatgtgtggtttttgttctctttgatgttgcaataaaaaccttctttacttct

SEQ ID NO: 5169 - protein, 351 aa, Arabidopsis thaliana
  misc_feature (1)..(351): useful for making plants with increased salt and oxidative stress tolerance as described in USSN 12/282,342
  misc_feature (1)..(351): Ceres ANNOT ID no. 864284
  misc_feature (1)..(351): Functional Homolog of Ceres Clone ID no. 3964 at SEQ ID NO: 5037
  misc_feature (70)..(348): Pfam Name: Sulfotransfer_1 Pfam Description: Sulfotransferase domain
MDEKDILRNLREEEEEEEENQSEETKILISSLPWEIDYLGNKLFKYQGYWYYEDVLQSIPNIHSSFQPQETDIVVASFYKSGTTWLKALTFALVQRSKHSLEDHHHPLLSHNPHEIVPYLELDLYLNSSKPDLTKFLSSSSSSSSPRLFSTHMSLDALKLPLKKSPCKVVYVCRNVKDVLVSLWCFLNANKGVEWGDFSQNEKIIRAENYSFKAIFESFCNGVTLHGPFWDHAQSYWRGSLEDPKHFLFMRYEELKAEPRTQVKRLAEFLDCPFTKEEEDSGTVDKILELCSLSNLSSLEINKTGSLGGVDYKTYFRKGQVGDWKSYMTSEMVNKIDMIVEEKLKGSGLKF

SEQ ID NO: 5170 - DNA, 1177 bp, Arabidopsis thaliana
  misc_feature (1)..(1177): useful for making plants with increased salt and oxidative stress tolerance as described in USSN 12/282,342
  misc_feature (1)..(1177): Ceres ANNOT ID no.858178
atagagagcttaagcaaaagatctcatactttcaagattgatcgatctctcaagtctcaacaatgtcatcatcatcatcagttcctgcttacttgggagatgaagatctgacacaagaaacaagagctctgatctcttctcttcctaaagagaaaggttggttagtgagtgaaatatatgaattccaaggactttggcacacacaagctattttacaaggaatcttgatctgccaaaaacgctttgaagctaaagattccgacattatcctcgtcactaatcctaaatcaggtaccacttggttaaaagctcttgtctttgctctccttaaccgacacaagtttccagtttcttcttctggtaaccatcctcttctggtcaccaatccacaccttcttgtgcccttcttggaaggagtttactacgagtccccagatttcgatttctccagtttgccttctccaagactgatgaacacgcacatatcgcatctttcgctccccgagtctgttaagagctcgtcttgtaagattgtgtattgttgtaggaaccctaaggacatgtttgtgtccttatggcattttgggaaaaagctagctcctgaggaaaccgcggattatcctatcgaaaaagcggttgaagcgttttgtgaagggaagtttataggtggacccttttgggatcatatattggagtactggtatgcaagccgcgagaatccgaacaaggtcttgtttgttacttacgaggagctaaagaagcagaccgaagttgagatgaagcggatcgcggagttcttggaatgtggctttattgaagaagaagaagtgagagagattgtgaagttgtgtagctttgagagtttaagtaatttggaagttaacaaagaagggaaattgccaaatggaatagagactaaaactttctttagaaaaggagagattggaggatggagagatactttgagtgagtcattggcagaggaaattgatagaaccattgaagagaagtttaaaggttctggtcttaaattttcttcttgaatcaatctttgaaacttgttctcatgttcttgttttgcttcaattatgttatttcttgttttatatatttttctgctgttatgtttgtgtttgtgtttatgaataaaatgaaataaattatgtttgtgttttct

SEQ ID NO: 5171 - protein, 326 aa, Arabidopsis thaliana
  misc_feature (1)..(326): useful for making plants with increased salt and oxidative stress tolerance as described in USSN 12/282,342
  misc_feature (1)..(326): Ceres ANNOT ID no. 858178
  misc_feature (1)..(325): Functional Homolog of Ceres Clone ID no. 3964 at SEQ ID NO: 5037
  misc_feature (65)..(321): Pfam Name: Sulfotransfer_1 Pfam Description: Sulfotransferase domain
MSSSSSVPAYLGDEDLTQETRALISSLPKEKGWLVSEIYEFQGLWHTQAILQGILICQKRFEAKDSDIILVTNPKSGTTWLKALVFALLNRHKFPVSSSGNHPLLVTNPHLLVPFLEGVYYESPDFDFSSLPSPRLMNTHISHLSLPESVKSSSCKIVYCCRNPKDMFVSLWHFGKKLAPEETADYPIEKAVEAFCEGKFIGGPFWDHILEYWYASRENPNKVLFVTYEELKKQTEVEMKRIAEFLECGFIEEEEVREIVKLCSFESLSNLEVNKEGKLPNGIETKTFFRKGEIGGWRDTLSESLAEEIDRTIEEKFKGSGLKFSS

SEQ ID NO: 5172 - DNA, 486 bp, Arabidopsis thaliana
  misc_feature (1)..(486): useful for making plants with increased salt and oxidative stress tolerance as described in USSN 12/282,342
  misc_feature (1)..(486): Ceres ANNOT ID no.842118
atggcgtcaacaaaaccaaccgatcaaatcaaacaactcaaagatatcttcgctcgtttcgacatggacaaggacggaagcttaacgcagctagaactcgccgctcttctgcgttctctcggaatcaaacctcgcagcgatcaaatctctcttctgttgaaccaaatcgaccgtaacggtaacggatccgtagagttcgacgagctggtcgtggcgatattgccggatataaacgaagaggttttgataaatcaagaacagttgatggaggttttccgttcgtttgatcgtgacggaaacggttcaataacggcggcggaacttgctgggtcaatggctaaaatgggacatccgttgacttaccgtgaattaacggaaatgatgacggaagctgattctaacggtgacggtgttattagttttaatgagttttctcatattatggctaaatcggctgctgattttcttggattaaccgcttcttga

SEQ ID NO: 5173 - DNA, 633 bp, Arabidopsis thaliana
  misc_feature (1)..(633): useful for making plants with increased salt and oxidative stress tolerance as described in USSN 12/282,342
  misc_feature (1)..(633): Ceres ANNOT ID no.566551
atggcggcgaacgattcttcaaatgctattgacatcgacgggaatctcgactccgattcgaatcttaacactgacggtgacgaagcgaccgataatgattcctcgaaggcattggttactatccctgctccagccgtttgtcttttccggttcgccggagatgctgctggtggcgccgttatgggctctatcttcggatatggttcaggattgttcaagaagaaaggcttcaaaggatcatttgcagatgcagggcagtctgctaagacttttgctgttttatctggagtccacagtttggttgtttgccttctgaagcaaatccgaggcaaagatgacgccattaatgttggagtagcagggtgttgcactggtcttgctcttagtttccctggtgctccacaggctcttctacagagttgtctcacgtttggggcattctcttttattcttgagggactcaacaaaagacaaacagctttggcacactcggtctcgttgagacaccaaaccggactgttccaagatcatcatcgtgctttaccactctctcttgctctcccgatccctgaagaaatcaaaggagccttttcttctttctgcaagtccttagctaaaccaaggaagttctaa

SEQ ID NO: 5174 - protein, 210 aa, Arabidopsis thaliana; identical to SEQ ID NO: 5072
  misc_feature (1)..(210): useful for making plants with increased salt and oxidative stress tolerance as described in USSN 12/282,342
  misc_feature (1)..(210): Ceres ANNOT ID no. 566551
  misc_feature (1)..(210): Functional Homolog of Ceres CLONE ID no. 965405 at SEQ ID NO: 5055
  misc_feature (40)..(158): Pfam Name: Tim17 Pfam Description: Tim17/Tim22/Tim23 family

SEQ ID NO: 5175 - DNA, 1323 bp, Arabidopsis thaliana
  misc_feature (1)..(1323): useful for making plants with increased salt and oxidative stress tolerance as described in USSN 12/282,342
  misc_feature (1)..(1323): Genomic Sequence Of Ceres ANNOT ID no. 566551
tggcggcgaacgattcttcaaatgctattgacatcgacgggaatctcgactccgattcgaatcttaacactgacggtgacgaagcgaccgataatgattcctcgaaggcattggttactatccctgctccagccgtttgtcttttccggttcgccggagatgctgctggtggcgccgttatgggctctatcttcggatatggtgctcttcttctttctattttgtttcttctattgcttggttttatctgctattgctttactctctgatagtgaattgagaattactggcaaacaattgagtttgtactcttttcttcatttaagttgatttcaaaacatgtttcgtggataagggtttgagaaatcatagttgttttagcagactagccttttgagttattttcaggagtaatctagatttaggggattcaacattcctcaagtttggttatgttttgctcctggaagctatagaattgaattagcttagttttcattaaagagcgtcaatgtgataagattggctactgatttgattacgatgatggaattgtgaaatattatctcactatataagttgggattcaggttcaggattgttcaagaagaaaggcttcaaaggatcatttgcagatgcagggcagtctgctaaggtacccctcatctttatgctatagcatatatatgcttattgttccaagaaactgagtaatttgctaattttttgttcaagacttttgctgttttatctggagtccacagtttggttgtttgccttctgaagcaaatccgaggcaaagatgacggtgagactcttcagattgcttccttcttgtgtaaatgattagtttttacatgaacttgtaatctctctcctacttatattgcttttgttctttttttacagccattaatgttggagtagcagggtgttgcactggtcttgctcttagtttccctggtaatccaaatccattatgctcattctgatttctactttggcgttatgtatcatatcaaagatgcaatcatcacagagaggagagctaatagattctttcttatatggccttttttacaggtgctccacaggctcttctacagagttgtctcacgtttggggcattctcttttattcttgagggactcaacaaaagacaaacagctttggcacactcggtctcgttgagacaccaaaccggactgttccaagatcatcatcgtgctttaccactctctcttgctctcccgatccctgaagaaatcaaaggagccttttcttctttctgcaagtccttagctaaaccaaggaagttctaat

SEQ ID NO: 5176 - DNA, 486 bp, Arabidopsis thaliana
  misc_feature (1)..(486): useful for making plants with increased salt and oxidative stress tolerance as described in USSN 12/282,342
  misc_feature (1)..(486): Genomic Sequence Of Ceres ANNOT ID no. 842118
tggcgtcaacaaaaccaaccgatcaaatcaaacaactcaaagatatcttcgctcgtttcgacatggacaaggacggaagcttaacgcagctagaactcgccgctcttctgcgttctctcggaatcaaacctcgcagcgatcaaatctctcttctgttgaaccaaatcgaccgtaacggtaacggatccgtagagttcgacgagctggtcgtggcgatattgccggatataaacgaagaggttttgataaatcaagaacagttgatggaggttttccgttcgtttgatcgtgacggaaacggttcaataacggcggcggaacttgctgggtcaatggctaaaatgggacatccgttgacttaccgtgaattaacggaaatgatgacggaagctgattctaacggtgacggtgttattagttttaatgagttttctcatattatggctaaatcggctgctgattttcttggattaaccgcttcttgat

SEQ ID NO: 5177 - DNA, 1177 bp, Arabidopsis thaliana
  misc_feature (1)..(1177): useful for making plants with increased salt and oxidative stress tolerance as described in USSN 12/282,342
  misc_feature (1)..(1177): Genomic Sequence Of Ceres ANNOT ID no. 858178
catagagagcttaagcaaaagatctcatactttcaagattgatcgatctctcaagtctcaacaatgtcatcatcatcatcagttcctgcttacttgggagatgaagatctgacacaagaaacaagagctctgatctcttctcttcctaaagagaaaggttggttagtgagtgaaatatatgaattccaaggactttggcacacacaagctattttacaaggaatcttgatctgccaaaaacgctttgaagctaaagattccgacattatcctcgtcactaatcctaaatcaggtaccacttggttaaaagctcttgtctttgctctccttaaccgacacaagtttccagtttcttcttctggtaaccatcctcttctggtcaccaatccacaccttcttgtgcccttcttggaaggagtttactacgagtccccagatttcgatttctccagtttgccttctccaagactgatgaacacgcacatatcgcatctttcgctccccgagtctgttaagagctcgtcttgtaagattgtgtattgttgtaggaaccctaaggacatgtttgtgtccttatggcattttgggaaaaagctagctcctgaggaaaccgcggattatcctatcgaaaaagcggttgaagcgttttgtgaagggaagtttataggtggacccttttgggatcatatattggagtactggtatgcaagccgcgagaatccgaacaaggtcttgtttgttacttacgaggagctaaagaagcagaccgaagttgagatgaagcggatcgcggagttcttggaatgtggctttattgaagaagaagaagtgagagagattgtgaagttgtgtagctttgagagtttaagtaatttggaagttaacaaagaagggaaattgccaaatggaatagagactaaaactttctttagaaaaggagagattggaggatggagagatactttgagtgagtcattggcagaggaaattgatagaaccattgaagagaagtttaaaggttctggtcttaaattttcttcttgaatcaatctttgaaacttgttctcatgttcttgttttgcttcaattatgttatttcttgttttatatatttttctgctgttatgtttgtgtttgtgtttatgaataaaatgaaataaattatgtttgtgttttc

SEQ ID NO: 5178 - DNA, 1248 bp, Arabidopsis thaliana
  misc_feature (1)..(1248): useful for making plants with increased salt and oxidative stress tolerance as described in USSN 12/282,342
  misc_feature (1)..(1248): Genomic Sequence Of Ceres ANNOT ID no. 864284
ttcacttaacaaaacaagaaccaaaaaaaatggatgagaaagatattctaaggaacttgagggaagaagaagaagaagaagaagaaaatcaaagcgaagaaaccaaaattttgatctcttcacttccttgggagatagattaccttgggaacaagcttttcaagtaccaaggatattggtactacgaagacgttctccaatcaatccccaatatacactcgagttttcagccacaagaaaccgatatagttgttgcttctttctacaaatcgggcacgacttggctcaaagcactcacatttgcactcgttcaacgatcaaaacactcgttagaagatcatcatcatcctctgctatctcataaccctcatgagatagtaccgtacctcgagctagatctgtatctcaacagctcaaaaccggacttgaccaagttcttatcatcatcatcatcatcatcatctccgagattgttctcaactcatatgtccttggacgcgcttaaactacccttgaagaagtctccttgcaaggtagtgtacgtgtgcaggaacgtgaaagacgtgttggtgtcactttggtgtttcctcaatgccaacaagggagtagaatggggagattttagccaaaatgaaaagatcattcgagcggagaattattctttcaaggctatatttgagtcattctgcaacggagttaccctacacggtcccttttgggaccatgcacagagctattggcgaggcagcttggaagatcctaagcattttcttttcatgaggtacgaggagttgaaagcggagcctcgtactcaggtcaagagacttgcagagttcttggattgtccattcactaaggaagaggaagatagcggaactgtagacaagatcttggaactttgctctctaagtaatttaagcagtttggagatcaacaaaactggatccttgggtggagtagattacaagacttatttccgtaaaggacaagttggtgactggaagagttatatgacctctgaaatggtaaataaaatcgatatgatcgtcgaggagaaactcaaaggttccggtttgaaattctagaattatgcgtgtgctttgtgaagaactgcagaaaaagtgttcttgaatgcgttatttaataataaaagttacattgtcatatatataactttgatgtatcattacaactgatgtgtggtttttgttctctttgatgttgcaataaaaaccttctttacttcta

SEQ ID NO: 5179 - DNA, 845 bp, Arabidopsis thaliana
  misc_feature (1)..(845): useful for making plants with increased salt and oxidative stress tolerance as described in USSN 12/282,342
  misc_feature (1)..(845): Genomic Sequence Of Ceres ANNOT ID no. 870567
ataagaaaatcaaaatctttactcgtttgaaatttgtaatccattacctgtcatcgttgacttgtcaagaagaaacaaatcaactctaaaaagaaaaatgttgttcatcgaaatcgaagcttgacagtattcaaaatcagattcgagatgagctgcgacggaggcaaaccggcgccggcgaaactaggcgacgaacaactagcggagctccgggagatattccgatcatttgaccagaacaaggatggaagtttgacggagctcgagttaggctcacttctaagatctctcggtctaaagccgagtcaagaccaactcgacacattgatccagaaagcagatcggaataacaacggactggtcgagttctccgagttcgtcgccctcgtcgagccagatctggtcaagtgtccttacacggatgatcagcttaaagccatctttagaatgtttgaccgcgatggaaacggttacataacggcggcggagttagcccattcgatggcgaagctaggtcacgcgttgacggcggaggagttaacgggaatgatcaaagaagctgatcgagacggcgatggttgtattgatttccaagagtttgttcaagcgattacttcagctgcgtttgataatgcttggggttgaagaaagaaaggtatatatatacatagtttgaaatacttgtgttttgtttttttggcttcatcctcaaatcaaagacatttggaagtatatgtgtgtaggtgcgattccatggaaaatgtgtgttatttattgtttcatattattctttgatgaaattttgatagcttgaagagaaagctatcattgttggttttagggca

SEQ ID NO: 5180 - DNA, 2020 bp, Panicum virgatum
  misc_feature (1)..(2020): useful for making plants with increased salt and oxidative stress tolerance as described in USSN 12/282,342
  misc_feature (1)..(2020): Ceres CLONE ID no.1792902
gtcactctcggcactgctcccagctgttgcgacctccgaacatccaaggctcctgcacccctgtcagtcctagctccagccaaaaatcgttggctcccgctgcctgctcctccgccttgcacctcccatgaccttccacgcgacatgattgcattgcaggcccctgcggagctcagctgtcctcccacgccgctgacgccttcttgttgcctccacgctgctgcgctcaaccgaaagggccttcctctctttgcttccgcggaaggatttggcgatttattcatctactaaagttgcatctctcttgtgcgtggtgattgtttcgaggagcgtggagcggagccatggggaagaagggcaagtggttcggcgcggtcaagaaagtgttcagccctgaatccaaggagaagaaggaggagaggcagaggaggaaatcagcagctagcaaccctactccactagatctgaccccgtcgacctccttggaagtcaatgtttcggtgccaccccctccagctcctccggctcttcaccagattaaggaggtcaggatccctgaagctgagcaggagcagagcaagcacatcaccgtagaggaggcccctgctgcccctgcacaggcgtcggtgcttccacctggtgtgccaagtgaagagcttgctgcaatcaagatccagactgccttccgaggttacctggcaaggagggcactgcgagcgctgcggggccttgttcgattgaagtcattggttgagggtgattcagttaggcgtcaatctgcaagcactctgcgctgtatgcagactctatcgcgggtgcagtcacaaatacgttctaggagagcaaagatgtctgaggagaaccaggccctccagcgccagctcctactgaagcaggaactggagaatttcaggatgggtgagaactgggatgacagcactcaatccaaagagcaaatcgaggcgagcctaataagcaggcaagaggcagcgattagaagagaaagagcgcttgcatatgcattttcacatcagtggaagagcacgtcgaggtctgtcaacccaatgtttgtagacccaaacaacttgcagtggggctggagctggctggagcgctggatggctgcaaaaccttgggagggccgcaatgggactgataaggagagcaatgttgaccgtggatccgttaagagcatgagcttgaaccttggagagggtgagatcactaaagctttcaaccgccgggactcaaagccagaaaagccatccccgccaactccaaaactgacccgtccagcctccaggcaatccccttcaacgccctccgctaaagtagcgccaatacctgtgaggagaaaatccgtcacgccaaagaatgggctttcacatgtggatgacgatgcgagaagtgtgttcagtgtgcagtctgagcgaccaaggaggcacagtatagccacctcgactgtgcgggacgatgagagtctcgcaagctccccatcactcccaagttatatggttcccacagaatctgcaagggcgaagtctcgtctccagggatcagcattgaataatggtgcagagacaccagagaaaggaagctctgctggaccggtcaagaaaaggttgtcctttcaaggtggaacagcggctgcctcaccaatgcgacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgtaaaaaaaaaaaaaaaaaaa

SEQ ID NO: 5181 - protein, 471 aa, Panicum virgatum
  misc_feature (1)..(471): useful for making plants with increased salt and oxidative stress tolerance as described in USSN 12/282,342
  misc_feature (1)..(471): Ceres CLONE ID no. 1792902
  misc_feature (104)..(124): Pfam Name: IQ Pfam Description: IQ calmodulin-binding motif
  misc_feature (1)..(471): Functional Homolog of  Ceres Ceres Clone ID no. 375578 at SEQ ID NO: 5135 with e-value of 1.90e-67 and BLAST sequence identity of 51.7
MGKKGKWFGAVKKVFSPESKEKKEERQRRKSAASNPTPLDLTPSTSLEVNVSVPPPPAPPALHQIKEVRIPEAEQEQSKHITVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGTDKESNVDRGSVKSMSLNLGEGEITKAFNRRDSKPEKPSPPTPKLTRPASRQSPSTPSAKVAPIPVRRKSVTPKNGLSHVDDDARSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 5182 - DNA, 1880 bp, Gossypium hirsutum; identical to SEQ ID NO: 4304
  misc_feature (1)..(1880): useful for making plants with increased salt and oxidative stress tolerance as described in USSN 12/282,342
  misc_feature (1)..(1880): Ceres CLONE ID no.1919901

SEQ ID NO: 5183 - protein, 474 aa, Gossypium hirsutum; identical to SEQ ID NO: 3397
  misc_feature (1)..(474): useful for making plants with increased salt and oxidative stress tolerance as described in USSN 12/282,342
  misc_feature (1)..(474): Ceres CLONE ID no. 1919901
  misc_feature (109)..(129): Pfam Name: IQ Pfam Description: IQ calmodulin-binding motif
  misc_feature (1)..(474): Functional Homolog of Ceres Clone ID no. 375578 at SEQ ID NO: 5135 with e-value of 1.10e-62 and BLAST sequence identity of 54.8

SEQ ID NO: 5184 - protein, 476 aa, Zea mays subsp. mays; identical to SEQ ID NO: 3402
  misc_feature (1)..(476): useful for making plants with increased salt and oxidative stress tolerance as described in USSN 12/282,342
  misc_feature (1)..(476): Ceres CLONE ID no. 228069
  misc_feature (1)..(476): Functional Homolog of Ceres Clone ID no. 375578 at SEQ ID NO: 5135

SEQ ID NO: 5185 - protein, 217 aa, Zea mays subsp. mays; identical to SEQ ID NO: 3387
  misc_feature (1)..(217): useful for making plants with increased salt and oxidative stress tolerance as described in USSN 12/282,342
  misc_feature (1)..(217): Ceres CLONE ID no. 335348
  misc_feature (1)..(217): Ceres Seed Line ID no. ME10681

SEQ ID NO: 5186 - protein, 474 aa, Oryza sativa; identical to SEQ ID NO: 4372
  misc_feature (1)..(474): useful for making plants with increased salt and oxidative stress tolerance as described in USSN 12/282,342
  misc_feature (1)..(474): Public GI ID no. 54306075

SEQ ID NO: 5187 - protein, 193 aa, Artificial Sequence
  misc_feature (1)..(193): useful for making plants with increased salt and oxidative stress tolerance as described in USSN 12/282,342
  misc_feature (1)..(193): Fragment of Ceres CLONE ID no. 335348
ESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 5188 - protein, 200 aa, Artificial Sequence
  misc_feature (1)..(200): useful for making plants with increased salt and oxidative stress tolerance as described in USSN 12/282,342
  misc_feature (1)..(200): Fragment of Ceres CLONE ID no. 228069
ESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 5189 - protein, 189 aa, Artificial Sequence
  misc_feature (1)..(189): useful for making plants with increased salt and oxidative stress tolerance as described in USSN 12/282,342
  misc_feature (1)..(189): Fragment of Ceres CLONE ID no. 375578
DPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 5190 - protein, 193 aa, Artificial Sequence; identical to SEQ ID NO: 5187
  misc_feature (1)..(193): useful for making plants with increased salt and oxidative stress tolerance as described in USSN 12/282,342
  misc_feature (1)..(193): Fragment of Ceres CLONE ID no. 229668

SEQ ID NO: 5191 - protein, 199 aa, Artificial Sequence
  misc_feature (1)..(199): useful for making plants with increased salt and oxidative stress tolerance as described in USSN 12/282,342
  misc_feature (1)..(199): Fragment of Public GI ID no. 54306075
ESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 5192 - protein, 188 aa, Artificial Sequence
  misc_feature (1)..(188): useful for making plants with increased salt and oxidative stress tolerance as described in USSN 12/282,342
  misc_feature (1)..(188): Fragment of Public GI ID no. 56202321
DPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 5193 - protein, 199 aa, Artificial Sequence
  misc_feature (1)..(199): useful for making plants with increased salt and oxidative stress tolerance as described in USSN 12/282,342
  misc_feature (1)..(199): Fragment of Ceres CLONE ID. 1792902
ESNVDRGSVKSMSLNLGEGEITKAFNRRDSKPEKPSPPTPKLTRPASRQSPSTPSAKVAPIPVRRKSVTPKNGLSHVDDDARSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 5194 - protein, 200 aa, Artificial Sequence
  misc_feature (1)..(200): useful for making plants with increased salt and oxidative stress tolerance as described in USSN 12/282,342
  misc_feature (1)..(200): Fragment of Ceres CLONE ID no. 1727738
KESNIDRGSVKSMSLNLGEGEITKAFNRRDSKPEKPSPPTPKLTRPASRQSPSTPSAKVAPIPARRKSATPENGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSAVKDIVAPPQPEALVINGGSK

SEQ ID NO: 5195 - protein, 471 aa, Panicum virgatum; identical to SEQ ID NO: 4552
  misc_feature (1)..(471): useful for making plants with increased salt and oxidative stress tolerance as described in USSN 12/282,342
  misc_feature (1)..(471): Ceres CLONE ID no. 1727738
  misc_feature (1)..(471): Functional Homolog of Ceres Clone ID no. 375578 at SEQ ID NO: 5135

SEQ ID NO: 5196 - DNA, 1806 bp, Zea mays subsp. mays; identical to SEQ ID NO: 3401
  misc_feature (1)..(1806): useful for making plants with increased salt and oxidative stress tolerance as described in USSN 12/282,342
  misc_feature (1)..(1806): Ceres CLONE ID no. 228069

SEQ ID NO: 5197 - DNA, 1083 bp, Zea mays subsp. mays
  misc_feature (1)..(1083): useful for making plants with increased salt and oxidative stress tolerance as described in USSN 12/282,342
  misc_feature (1)..(1083): Ceres CLONE ID no. 335348
aacccccgccgtatcggtcttgttcgttgtcctgccagatacagataggtggctaccactggctcgcgtgacctgttggcttgcttgctcctctccaggttcaggcaggggagagtgcctgtttcgagggggcgtggagcggagccggagccatggggaagaagggcaagtggttcggcgccgtcaagaaggtcttcagccctgaatccaaggagaagaaagaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatctgtcacgcccaagaacgggctttcacaggtggacgatgacgcgaggagcgtgctcagtgtgcagtctgagcggccaaggaggcacagtatagccacctcgactgtgcgggacgacgagagcctcacgagctccccgtcgctcccaagctacatggttcccacagaatctgcaagggccaaatctcgcctccagggttcagcaatggccaatggcgcagagacacctgagaaaggaggctcaactggaccagccaagaagaggttatccttccagggtggaactgcggctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacagatcctctatttatgtgagacatatatttcttttctttcg

SEQ ID NO: 5198 - DNA, 2024 bp, Panicum virgatum; identical to SEQ ID NO: 4551
  misc_feature (1)..(2024): useful for making plants with increased salt and oxidative stress tolerance as described in USSN 12/282,342
  misc_feature (1)..(2024): Ceres CLONE ID no. 1727738

SEQ ID NO: 5199 - DNA, 692 bp, Arabidopsis thaliana
  misc_feature (1)..(692): useful for making plants with increased nitrogen use efficiency as described in USSN 12/776,319
  misc_feature (1)..(692): Ceres CLONE ID no. 18200
  misc_feature (1)..(692): Also Known As Ceres ME LINE ME20023
aacaccttcttctccactctcattctctctttctgacacattaactacttatccttcttgcattcttctctctctctacacccaaacaaacacacttataatatatcaagaaagaagatgtctagcagaagatcatcacgttcaagacagtcaggaagctcaagaatctctgacgatcagatttccgatcttgtttctaagctccaacacctcatccctgaacttcgccgccgccgttctgacaaggtgtcagcatctaaggtactacaagagacttgcaactacatcaggaacttacacagagaggttgatgacctcagtgaccgtttgtcggaactcttggcttcgacggacgacaacagcgccgaaacagccatcattaggagcttgcttaattattaaatccgcattacttaatctgagagctattaatcatccgtttccggccaccaaatttatcttattatgggtatcgtctgtttacttctacatcatatattatgagatatagctagggtttcgggtcattgttaggccaactcatatatttatatttaatatatggttatgtatgtatgtatgcatgttaattgtatctgagggtccagacctggcgtatagtagcctgtgtatcatgagatcctctaatatttatgattaatgacacggtccgtttccttttttactatacc

SEQ ID NO: 5200 - protein, 94 aa, Arabidopsis thaliana
  misc_feature (1)..(94): useful for making plants with increased nitrogen use efficiency as described in USSN 12/776,319
  misc_feature (1)..(94): Ceres CLONE ID no. 18200
  misc_feature (1)..(94): Also Known As Ceres ME LINE ME20023
  misc_feature (20)..(61): Pfam Name: HLH; Pfam Description: Helix-loop-helix DNA-binding domain
MSSRRSSRSRQSGSSRISDDQISDLVSKLQHLIPELRRRRSDKVSASKVLQETCNYIRNLHREVDDLSDRLSELLASTDDNSAETAIIRSLLNY

SEQ ID NO: 5201 - DNA, 1155 bp, Zea mays
  misc_feature (1)..(1155): useful for making plants with increased nitrogen use efficiency as described in USSN 12/776,319
  misc_feature (1)..(1155): Ceres CLONE ID no. 336524
  misc_feature (1)..(1155): Also Known As Ceres ME LINE ME10686
gagtcttgacacgagctcccacacgtacactgcataaataggcgagcagcgggagagagacgaccgacgaggacgaagaggaattaagccagagcgatcgaggtggtgtagtgtagcttccgagcgaagctcctaccgttgccgccggccggagatatgtcgtcgggcggccgacgtggcaggatcagcgacgacgagatcaacgagctgatctccaagctccaggctctcctcccggaatcctcacgccgccggaacgcgagccggtcgtcggcgtcgaagcttctgaaggagacgtgcgcctacgtcaagagcctgcaccgggaggtggacgacctctcggagcggctgtcggggctcatggagaccatggacaacgacagcccccaggccgagatcatccggagcctcctccggtgactccagagtccaggttccagccatgccgcttgccgccccggtcgtccggcgcgcgcggccgccctcttctgctgcctgccatctagctagctgccgcagccagcgcaggtgcacttgagattggagaaggagaagacgacgacgtacggccgagcttgcttgttcgctcgtttatttgttacggcgacgaccttaattgtattcctttgttcttaatttgttctcctccttctcctcctcctcctccttcgggtgcgtgtttgtttccgtgttgaattagttcaagagcaagagcccttgctcagaagaaggcgaccaaaagtgctctactcgatcttctcgtgtaccacgccagggggggttagtagagtagagataatgtatggacttctattaaccaactaaaggtaccacgtactggtaggttgtagttgcagtagactactggtagtagggtgtagttttgcagtagactactgtagcagttctacattgcggatgcgtccaaagagttgttgttgttctgtagattgcatgctgctcttgtctctgtcgtcgtccttagcttacggcgttacgccaatgggcggcggacaaggagctgaacgacgaccactctgtctggtggagacaaatatatacactatcacgtgattttcctctctttagctccatcctgatgtaacttggtaatttactccatccctccgtcattttttttgcaatagttctttt

SEQ ID NO: 5202 - protein, 87 aa, Zea mays
  misc_feature (1)..(87): useful for making plants with increased nitrogen use efficiency as described in USSN 12/776,319
  misc_feature (1)..(87): Ceres CLONE ID no. 336524
  misc_feature (1)..(87): Also Known As Ceres ME LINE ME10686
MSSGGRRGRISDDEINELISKLQALLPESSRRRNASRSSASKLLKETCAYVKSLHREVDDLSERLSGLMETMDNDSPQAEIIRSLLR

SEQ ID NO: 5203 - DNA, 712 bp, Arabidopsis thaliana
  misc_feature (1)..(712): useful for making plants with increased nitrogen use efficiency as described in USSN 12/776,319
  misc_feature (1)..(712): Ceres CLONE ID no. 4734
  misc_feature (1)..(712): Also Known As Ceres ME LINE ME01905
aatatttgaagtgtattcaaaaccccaaaacacttttctcattctcttctctattttcttcttgctctctagtttttctttcttcttggtcgtttcctttcagcataaaaaccttataaaatcataaaagcttacacctacttgccacatagacatagccgatctcattatatctctatttctatttctcaatagaacttgtttgagctagtgtgagagaagtaaagaaagagagaagaatccacaacttagttagggtcttttcttgccacattgttgaacatgtcgaacagaagatcaaggcaatcttcaagtgctccaaggatctccgataatcaaatgattgacctcgtatctaagctccgtcaaattttgccggagattggtcaacgacgtcgttctgataaggcatcagcctcgaaagtattgcaagagacatgcaattacatacgaaatttgaacagagaagttgacaatctgagcgagcgtttgtctcagcttctcgaatctgtcgatgaagatagccctgaagccgccgttattagaagcctactcatgtaatcttttttgttcttttgtttgtttttgacaagcctatccatgtaatcttaaatgatcgctctataataattatatttttaacataatcgtcttattatgtaaaattcaaagagatgggcttgatctttaatgacatacgaatttcataggg

SEQ ID NO: 5204 - protein, 92 aa, Arabidopsis thaliana
  misc_feature (1)..(92): useful for making plants with increased nitrogen use efficiency as described in USSN 12/776,319
  misc_feature (1)..(92): Ceres CLONE ID no. 4734
  misc_feature (1)..(92): Also Known As Ceres ME LINE ME01905
  misc_feature (1)..(92): Phenotype: INFLORESCENCE Useful for making ornamental plants with modified flowers
  misc_feature (1)..(92): Phenotype: Glossy Useful for making plants with enhanced abiotic stress tolerance
MSNRRSRQSSSAPRISDNQMIDLVSKLRQILPEIGQRRRSDKASASKVLQETCNYIRNLNREVDNLSERLSQLLESVDEDSPEAAVIRSLLM

SEQ ID NO: 5205 - DNA, 557 bp, Arabidopsis thaliana
  misc_feature (1)..(557): useful for making plants with increased nitrogen use efficiency as described in USSN 12/776,319
  misc_feature (1)..(557): Ceres CLONE ID no. 519
  misc_feature (1)..(557): Also Known As Ceres ME LINE ME01770
atactatcaacttttctctatctatctctctctcttctttttccggcataacttctgtgttaccctaaactccataacctgtttcatcgataaagtgcctttgcttctatctctgtcactcttactacttgttgaacaatattctacaaaaaaatgtcgggaagaagatcacgttcgaggcaatcatcaggaacttcaaggatctcagaagatcaaatcaatgatctgattatcaagttgcaacagcttcttcctgagctcagggacagtcgtcgttccgacaaggtttcagcagcgagggtgttacaagatacgtgcaactacatacggaatctgcatagagaggttgatgatctaagtgagaggctatctgagttactagcaaactcagacactgcacaagctgctttaatcagaagcttacttacccaataattcctatctatctttttcttcttcttcttttttttgtttactataataataataatagtttgcgggtttttttttctatagatgttgatgaccttataaacgtttaatgatacgagttcgtc

SEQ ID NO: 5206 - protein, 93 aa, Arabidopsis thaliana
  misc_feature (1)..(93): useful for making plants with increased nitrogen use efficiency as described in USSN 12/776,319
  misc_feature (1)..(93): Ceres CLONE ID no. 519
  misc_feature (1)..(93): Also Known As Ceres ME LINE ME01770
  misc_feature (20)..(62): Pfam Name: HLH; Pfam Description: Helix-loop-helix DNA-binding domain
  misc_feature (1)..(93): Phenotype: WHOLE PLANT Useful for making bigger plants
  misc_feature (1)..(93): Phenotype: Long Useful for making taller plants
MSGRRSRSRQSSGTSRISEDQINDLIIKLQQLLPELRDSRRSDKVSAARVLQDTCNYIRNLHREVDDLSERLSELLANSDTAQAALIRSLLTQ

SEQ ID NO: 5207 - DNA, 771 bp, Glycine max
  misc_feature (1)..(771): useful for making plants with increased nitrogen use efficiency as described in USSN 12/776,319
  misc_feature (1)..(771): Ceres CLONE ID no. 560681
  misc_feature (1)..(771): Also Known As Ceres ME LINE ME08328
  misc_feature (633)..(633): y is t/u or c
atatatcttagccttttctctccctcccttctcccatattatatagcttgtcttttatttcttagactccatccattcttctccccaattgaatcttctttattttgtttcttcactgtctcgttatggctatagttttgcatagtaaataaactgaactgaagctatctatatagcagcaagtgttgatttaattacttactttagacaataattatattaattacaccaatttataagctctttatctatctatctagctagggaaaattaaaatgtctagcagaaggtccaggcagcaatctgcatccacaaggatctccgatgaccaaatcatcgacctcgtttcaaagttgcgtcaacttgttcctgagattcgcgataggcgctctgacaaggtatcagcatctaaggtcctacaagagacctgcaactacatcagaagcttacacagagaagtggatgacttaagcgaacgactgtctcagttgttggccacaatcgatgctgatagccctgaagctgccatcattaggagcctaattaactaataatatatattaagcgcaagtaatcatctaattttcctatattcaaggagatatattataagagtgtattaatttcttcttytaaattaggtggcatagagtgcagtttgaggtgcgtacgtacgtccttccaatatattatagtacatggcaggaatggtgcacttgtgtaagttaaaggtttttgcaataagaactaaggactctctgtattatggcg

SEQ ID NO: 5208 - protein, 91 aa, Glycine max
  misc_feature (1)..(91): useful for making plants with increased nitrogen use efficiency as described in USSN 12/776,319
  misc_feature (1)..(91): Ceres CLONE ID no. 560681
  misc_feature (1)..(91): Also Known As Ceres ME LINE ME08328
  misc_feature (25)..(59): Pfam Name: HLH; Pfam Description: Helix-loop-helix DNA-binding domain
MSSRRSRQQSASTRISDDQIIDLVSKLRQLVPEIRDRRSDKVSASKVLQETCNYIRSLHREVDDLSERLSQLLATIDADSPEAAIIRSLIN

SEQ ID NO: 5209 - DNA, 697 bp, Glycine max
  misc_feature (1)..(697): useful for making plants with increased nitrogen use efficiency as described in USSN 12/776,319
  misc_feature (1)..(697): Ceres CLONE ID no. 560948
  misc_feature (1)..(697): Also Known As Ceres ME LINE ME08317
atgtgttttatttcctacttcccaacccataaccattaattcttaattagtttcctcttgctttcttctccttctatattattactagtacaacttatcatacacatatacctctggttatagcagcaaactaggctatagcttgcactttgaagatatttatacacagaccaagtacaacaccaagctctagctagctagggacatgtctagccgaagatccagacaacattcagggtctacaaggatctccgatgaccaaatcatcgaacttgtttccaaattgcgccaacttgttcctgagattcgcaataggcgatctgataaggtttcagcgtcaaaggtcctacaagagacctgcaactacatcagaggcttgcacagagaggtgagtgacttgagcgagcgactgtctcagttgttgaccacaattgatgctgatagtgctgaggctggaatcattaggagcctacttaatcaatgagagagtgttatgattttttatttattcaaagagagtgttaattaaattataattatgattattataagagtattgtacttcattctaggtgtgctgagagcctgggagagttcagtttttgaggctgtacctcccatatggcaggtagggcattttcataactagttgtttttctcttttttccaataaaaattcaagtgcttgtaccagctg

SEQ ID NO: 5210 - protein, 92 aa, Glycine max
  misc_feature (1)..(92): useful for making plants with increased nitrogen use efficiency as described in USSN 12/776,319
  misc_feature (1)..(92): Ceres CLONE ID no. 560948
  misc_feature (1)..(92): Also Known As Ceres ME LINE ME08317
  misc_feature (25)..(59): Pfam Name: HLH; Pfam Description: Helix-loop-helix DNA-binding domain
MSSRRSRQHSGSTRISDDQIIELVSKLRQLVPEIRNRRSDKVSASKVLQETCNYIRGLHREVSDLSERLSQLLTTIDADSAEAGIIRSLLNQ

SEQ ID NO: 5211 - DNA, 728 bp, Glycine max
  misc_feature (1)..(728): useful for making plants with increased nitrogen use efficiency as described in USSN 12/776,319
  misc_feature (1)..(728): Ceres CLONE ID no. 653656
  misc_feature (1)..(728): Also Known As Ceres ME LINE ME21445
acatgcaacttgtcttaatttctttctcgatccccaacatcactagctagctccttttgtacacactctacaaccccacctagctacatcacttaattagttttcccatatctataaccaatttcaaattctcacccttaactagctagctatatttcataactgattattaccaactcactacatattattggctaggattcaccattagacttaaaagtagttgatttattatatatataagatgtctagcaggaggtcacggtcaaggcaaacaagtagttcaaggaatatcaccgatgatcagatcaatgatcttgtctccaagttgcaacagcttcttccagagattcgcgataggcgctctgacaaggtttcagcttccaaggtgttgcaagagacatgcaactatattagaagcttacacagggaagtggatgacctaagcgagcgtttatctgagctcttggctacaactgacacagcacaagctgcaataattagaaatctactaatgcaatagatcggtgcagtagttaatttatcgcataattcatagttagcacttcagtacttgtgaaccgatccagtcagtagtcgcgtatttcttattctctttttgtttcactttttttttctggtttttgtccactaatatgcatgattactgcttttgcaaagcccattttcctaagatattaaataaaagtctgagtttgcgctttgct

SEQ ID NO: 5212 - protein, 92 aa, Glycine max
  misc_feature (1)..(92): useful for making plants with increased nitrogen use efficiency as described in USSN 12/776,319
  misc_feature (1)..(92): Ceres CLONE ID no. 653656
  misc_feature (1)..(92): Also Known As Ceres ME LINE ME21445
  misc_feature (20)..(61): Pfam Name: HLH; Pfam Description: Helix-loop-helix DNA-binding domain
MSSRRSRSRQTSSSRNITDDQINDLVSKLQQLLPEIRDRRSDKVSASKVLQETCNYIRSLHREVDDLSERLSELLATTDTAQAAIIRNLLMQ

SEQ ID NO: 5213 - DNA, 701 bp, Triticum aestivum
  misc_feature (1)..(701): useful for making plants with increased nitrogen use efficiency as described in USSN 12/776,319
  misc_feature (1)..(701): Ceres CLONE ID no. 733804
  misc_feature (1)..(701): Also Known As Ceres ME LINE ME08386
  misc_feature (622)..(622): y is t/u or c
atgcacaacttgtcttccctctcttccaacaccacttcttcttagttcctctccgtccctgtctgccaccacttctgtctctcaaacttgtctcactccaaccataaaccctcactgtcttgggctctctctgccaagcatccaattcctaagtacatccgatcactcacatttgcagtgatgtcgagccgtaggtcaaggtcaaggcagtccggctcgtcgaggatcaccgacgagcaaatcagcgaccttgtctccaagttgcaggacctccttcccgaggcgcgtctccggggcaatgatagagtgccatcttcaagggtgctgcaggagacgtgcacctacatcaggagcttgcaccgggaggtggacgacctgagcgagaggctgtcggagctgctggcgacctcggacatgagcagcgcgcaagcggccatcatccgcagcttgctgatgtagagccggctcccatgcagtgcgcaggcgcctcgtcgctgtcttgctgagcgcacaagcctgaatttgagcgtttgtagcctagggagcgatctttaattagtaccggagttgcaggttacctacttaatccgcgtgtgtgcgctgtcgtcgtgtcatcatcgtyttaatcaggcccatcttttttgtgtgtgtacttaaatcaagtcgttaaatcaaaccccgcccgtggttggtgcaagttg

SEQ ID NO: 5214 - protein, 92 aa, Triticum aestivum
  misc_feature (1)..(92): useful for making plants with increased nitrogen use efficiency as described in USSN 12/776,319
  misc_feature (1)..(92): Ceres CLONE ID no. 733804
  misc_feature (1)..(92): Also Known As Ceres ME LINE ME08386
  misc_feature (1)..(92): Phenotype: INFLORESCENCE Useful for making ornamental plants with modified flowers
  misc_feature (1)..(92): Phenotype: Low Nitrate Useful for making plants tolerant to low nitrogen
MSSRRSRSRQSGSSRITDEQISDLVSKLQDLLPEARLRGNDRVPSSRVLQETCTYIRSLHREVDDLSERLSELLATSDMSSAQAAIIRSLLM

SEQ ID NO: 5215 - DNA, 545 bp, Arabidopsis thaliana
  misc_feature (1)..(545): useful for making plants with increased nitrogen use efficiency as described in USSN 12/776,319
  misc_feature (1)..(545): Ceres CLONE ID no. 8607
  misc_feature (1)..(545): Also Known As Ceres ME LINE ME03973
ctccctttctttcgacaagcacaaacaaagccatcaagagaagaaagccttttcttggattcacatatatataagaatattttttcaaatcaaacatgtcttctagcagaaggtcgagacaagcaagctcatcatcaagaattagcgatgaccagatcactgatctcatctcaaagctccgacagtccattccggagattcgccagaaccgtcgttccaacacggtatcagcgtcgaaagtgttacaagagacttgcaactacataagaaacttgaacaaggaagccgatgacctcagtgatcgattgactcagcttctggaatccattgatcctaatagcccacaagccgcagttattaggagcttgattaatggataattaagatataaattgattagttgtgctttatatatataagcttaaaatctcgttgggaggttgatccatcagggtgttgcataattatatatctattttatgtttcttatatattatttacaatcctatctagttagggttcatattttgacccttttttggttt

SEQ ID NO: 5216 - protein, 94 aa, Arabidopsis thaliana
  misc_feature (1)..(94): useful for making plants with increased nitrogen use efficiency as described in USSN 12/776,319
  misc_feature (1)..(94): Ceres CLONE ID no. 8607
  misc_feature (1)..(94): Also Known As Ceres ME LINE ME03973
  misc_feature (1)..(94): Phenotype: Low Nitrate Useful for making plants tolerant to low nitrogen
MSSSRRSRQASSSSRISDDQITDLISKLRQSIPEIRQNRRSNTVSASKVLQETCNYIRNLNKEADDLSDRLTQLLESIDPNSPQAAVIRSLING

SEQ ID NO: 5217 - protein, 91 aa, Oryza sativa subsp. japonica
  misc_feature (1)..(91): useful for making plants with increased nitrogen use efficiency as described in USSN 12/776,319
  misc_feature (1)..(91): Public GI no. 78708592
  misc_feature (1)..(91): Functional Homolog of  Ceres CLONE ID no. 653656 with e-value of 1.49E-25 and percent identity of 73.8
  misc_feature (1)..(91): Functional Homolog of  Ceres CLONE ID no. 733804 with e-value of 2.50E-32 and percent identity of 82.2
  misc_feature (1)..(91): Functional Homolog of  Ceres CLONE ID no. 8607 with e-value of 7.09E-19 and percent identity of 56.8
MSRRSRSRASSAARITDEQIGDLVSKLQALLPEARLRSNDRVPSARVLQETCSYIRSLHREVDDLSERLAELLAAADVSTAQAAVIRGLLM

SEQ ID NO: 5218 - protein, 92 aa, Glycine max
  misc_feature (1)..(92): useful for making plants with increased nitrogen use efficiency as described in USSN 12/776,319
  misc_feature (1)..(92): Ceres CLONE ID no. 663844
  misc_feature (1)..(92): Functional Homolog of  Ceres CLONE ID no. 519 with e-value of 3.30E-30 and percent identity of 76
  misc_feature (1)..(92): Functional Homolog of  Ceres CLONE ID no. 4734 with e-value of 2.49E-23 and percent identity of 69.6
  misc_feature (1)..(92): Functional Homolog of  Ceres CLONE ID no. 8607 with e-value of 5.29E-23 and percent identity of 67.4
  misc_feature (1)..(92): Functional Homolog of  Ceres CLONE ID no. 336524 with e-value of 1.70E-17 and percent identity of 64.8
  misc_feature (1)..(92): Functional Homolog of  Ceres CLONE ID no. 560681 with e-value of 6.99E-28 and percent identity of 80.6
  misc_feature (1)..(92): Functional Homolog of  Ceres CLONE ID no. 560948 with e-value of 3.90E-27 and percent identity of 77.7
  misc_feature (1)..(92): Functional Homolog of  Ceres CLONE ID no. 653656 with e-value of 8.60E-39 and percent identity of 96.7
  misc_feature (1)..(92): Functional Homolog of  Ceres CLONE ID no. 733804 with e-value of 1.49E-27 and percent identity of 78.8
MSSRRSRSRQTSSSRNITDDQINDLVSKLQQLLPEIRDRRSDKVSASKVLQETCNYIRSLHREVGDLSERLSELLDTTDTAQAAIIRNLLMQ

SEQ ID NO: 5219 - DNA, 276 bp, Populus balsamifera subsp. trichocarpa
  misc_feature (1)..(276): useful for making plants with increased nitrogen use efficiency as described in USSN 12/776,319
  misc_feature (1)..(276): Ceres GDNA ANNOT ID no. 1468218
  misc_feature (1)..(276): Functional Homolog of  Ceres CLONE ID no. 653656 with e-value of 6.40E-34 and percent identity of 87.9
  misc_feature (1)..(276): Functional Homolog of  Ceres CLONE ID no. 733804 with e-value of 3.00E-27 and percent identity of 74.4
  misc_feature (1)..(276): Functional Homolog of  Ceres CLONE ID no. 8607 with e-value of 4.09E-23 and percent identity of 67.8
atgtctagccgaaggtcacgatcaaggcaatcaagtagttcaagaatcagtgatgatcagatccttgatcttgttacaaagttgcaacaacttcttcctgagattcgtaacaggcgttctgacaaggtttcggctgccaagatcttgcaggagacatgcaactatattaaaagcttgcatagagaggttggtgatcttagcgagcggctgtctgagctattggaaacaactgatacagcccaagctgcaataatcaggaacttacttatgcaatag

SEQ ID NO: 5220 - protein, 91 aa, Populus balsamifera subsp. trichocarpa
  misc_feature (1)..(91): useful for making plants with increased nitrogen use efficiency as described in USSN 12/776,319
  misc_feature (1)..(91): Ceres GDNA ANNOT ID no. 1468218
  misc_feature (1)..(91): Functional Homolog of  Ceres CLONE ID no. 653656 with e-value of 6.40E-34 and percent identity of 87.9
  misc_feature (1)..(91): Functional Homolog of  Ceres CLONE ID no. 733804 with e-value of 3.00E-27 and percent identity of 74.4
  misc_feature (1)..(91): Functional Homolog of  Ceres CLONE ID no. 8607 with e-value of 4.09E-23 and percent identity of 67.8
MSSRRSRSRQSSSSRISDDQILDLVTKLQQLLPEIRNRRSDKVSAAKILQETCNYIKSLHREVGDLSERLSELLETTDTAQAAIIRNLLMQ

SEQ ID NO: 5221 - protein, 91 aa, Triticum aestivum; identical to SEQ ID NO: 5208
  misc_feature (1)..(91): useful for making plants with increased nitrogen use efficiency as described in USSN 12/776,319
  misc_feature (1)..(91): Ceres CLONE ID no. 703180
  misc_feature (1)..(91): Functional Homolog of  Ceres CLONE ID no. 519 with e-value of 9.19E-26 and percent identity of 72.7
  misc_feature (1)..(91): Functional Homolog of  Ceres CLONE ID no. 4734 with e-value of 1.09E-29 and percent identity of 76.6
  misc_feature (1)..(91): Functional Homolog of  Ceres CLONE ID no. 8607 with e-value of 4.79E-29 and percent identity of 75.5
  misc_feature (1)..(91): Functional Homolog of  Ceres CLONE ID no. 336524 with e-value of 9.99E-20 and percent identity of 64.9
  misc_feature (1)..(91): Functional Homolog of  Ceres CLONE ID no. 560681 with e-value of 5.79E-40 and percent identity of 100
  misc_feature (1)..(91): Functional Homolog of  Ceres CLONE ID no. 560948 with e-value of 4.39E-35 and percent identity of 89
  misc_feature (1)..(91): Functional Homolog of  Ceres CLONE ID no. 653656 with e-value of 1.29E-28 and percent identity of 81.8
  misc_feature (1)..(91): Functional Homolog of  Ceres CLONE ID no. 733804 with e-value of 4.39E-26 and percent identity of 72.2

SEQ ID NO: 5222 - protein, 86 aa, Brassica napus
  misc_feature (1)..(86): useful for making plants with increased nitrogen use efficiency as described in USSN 12/776,319
  misc_feature (1)..(86): Ceres CLONE ID no. 945972
  misc_feature (1)..(86): Functional Homolog of  Ceres CLONE ID no. 519 with e-value of 4.60E-24 and percent identity of 69.8
  misc_feature (1)..(86): Functional Homolog of  Ceres CLONE ID no. 4734 with e-value of 1.60E-21 and percent identity of 68.6
  misc_feature (1)..(86): Functional Homolog of  Ceres CLONE ID no. 8607 with e-value of 4.69E-22 and percent identity of 68.6
  misc_feature (1)..(86): Functional Homolog of  Ceres CLONE ID no. 336524 with e-value of 3.70E-15 and percent identity of 56.5
  misc_feature (1)..(86): Functional Homolog of  Ceres CLONE ID no. 560681 with e-value of 3.99E-25 and percent identity of 73.8
  misc_feature (1)..(86): Functional Homolog of  Ceres CLONE ID no. 560948 with e-value of 5.90E-24 and percent identity of 71.9
  misc_feature (1)..(86): Functional Homolog of  Ceres CLONE ID no. 653656 with e-value of 8.29E-25 and percent identity of 76.8
  misc_feature (1)..(86): Functional Homolog of  Ceres CLONE ID no. 733804 with e-value of 1.39E-24 and percent identity of 71.7
  misc_feature (43)..(43): Xaa is any aa, unknown or other
  misc_feature (85)..(85): Xaa is any aa, unknown or other
MSSRRSSCSRQSGSSRISDDQISDLVTKLQHLIPELRRRRSDXVSASKVLQETCNYIRNLHREVDDLSDRLSEFLASTDDNSAEXA

SEQ ID NO: 5223 - DNA, 273 bp, Populus balsamifera subsp. trichocarpa
  misc_feature (1)..(273): useful for making plants with increased nitrogen use efficiency as described in USSN 12/776,319
  misc_feature (1)..(273): Ceres GDNA ANNOT ID No. 1530225
  misc_feature (1)..(273): Functional Homolog of  Ceres CLONE ID no. 653656 with e-value of 8.10E-27 and percent identity of 80.6
  misc_feature (1)..(273): Functional Homolog of  Ceres CLONE ID no. 733804 with e-value of 6.50E-25 and percent identity of 71.1
  misc_feature (1)..(273): Functional Homolog of  Ceres CLONE ID no. 8607 with e-value of 2.10E-26 and percent identity of 75.0
atgtctagcagaaggccaaggcaatctagcgttccaaggatcactgatgatcagatcatcgaccttgtctccaaattacgccagcttctccctgagattagtcaaaggcgctccgataaggtatcagcttccaaggtcctacaagagacttgcaattatatcaggaacttgcacagggaggttgatgacttaagtgagcgattgtctcagcttttggcaacaattgatgctgatagtcctgaagcagcgataataaggagtttaattatgtaa

SEQ ID NO: 5224 - protein, 90 aa, Populus balsamifera subsp. trichocarpa
  misc_feature (1)..(90): useful for making plants with increased nitrogen use efficiency as described in USSN 12/776,319
  misc_feature (1)..(90): Ceres GDNA ANNOT ID No. 1530225
  misc_feature (1)..(90): Functional Homolog of  Ceres CLONE ID no. 653656 with e-value of 8.10E-27 and percent identity of 80.6
  misc_feature (1)..(90): Functional Homolog of  Ceres CLONE ID no. 733804 with e-value of 6.50E-25 and percent identity of 71.1
  misc_feature (1)..(90): Functional Homolog of  Ceres CLONE ID no. 8607 with e-value of 2.10E-26 and percent identity of 75.0
MSSRRPRQSSVPRITDDQIIDLVSKLRQLLPEISQRRSDKVSASKVLQETCNYIRNLHREVDDLSERLSQLLATIDADSPEAAIIRSLIM

SEQ ID NO: 5225 - protein, 92 aa, Arabidopsis thaliana
  misc_feature (1)..(92): useful for making plants with increased nitrogen use efficiency as described in USSN 12/776,319
  misc_feature (1)..(92): Public GI no. 22331645
  misc_feature (1)..(92): Functional Homolog of  Ceres CLONE ID no. 519 with e-value of 3.00E-27 and percent identity of 69.5
  misc_feature (1)..(92): Functional Homolog of  Ceres CLONE ID no. 4734 with e-value of 3.70E-22 and percent identity of 64.4
  misc_feature (1)..(92): Functional Homolog of  Ceres CLONE ID no. 8607 with e-value of 9.79E-22 and percent identity of 63.6
  misc_feature (1)..(92): Functional Homolog of  Ceres CLONE ID no. 336524 with e-value of 1.09E-15 and percent identity of 54.6
  misc_feature (1)..(92): Functional Homolog of  Ceres CLONE ID no. 560681 with e-value of 4.30E-21 and percent identity of 64.7
  misc_feature (1)..(92): Functional Homolog of  Ceres CLONE ID no. 560948 with e-value of 3.30E-21 and percent identity of 64.4
  misc_feature (1)..(92): Functional Homolog of  Ceres CLONE ID no. 653656 with e-value of 1.29E-26 and percent identity of 72.5
  misc_feature (1)..(92): Functional Homolog of  Ceres CLONE ID no. 733804 with e-value of 3.60E-24 and percent identity of 71.1
MSSRKSRSRQTGASMITDEQINDLVLQLHRLLPELANNRRSGKVSASRVLQETCSYIRNLSKEVDDLSERLSQLLESTDSAQAALIRSLLMQ

SEQ ID NO: 5226 - DNA, 273 bp, Populus balsamifera subsp. trichocarpa
  misc_feature (1)..(273): useful for making plants with increased nitrogen use efficiency as described in USSN 12/776,319
  misc_feature (1)..(273): Ceres GDNA ANNOT ID no. 1449794
  misc_feature (1)..(273): Functional Homolog of  Ceres CLONE ID no. 653656 with e-value of 1.70E-26 and percent identity of 79.5
  misc_feature (1)..(273): Functional Homolog of  Ceres CLONE ID no. 733804 with e-value of 1.70E-24 and percent identity of 70
  misc_feature (1)..(273): Functional Homolog of  Ceres CLONE ID no. 8607 with e-value of 5.69E-26 and percent identity of 73.8
atgtctagcagaaggtcaaggcagtctagtgttccaaggatcactgatgatcaaatcatccaccttgtctccaaattacgccagcttctccctgagattcgtcaaaggcgctccgataaggtatcagcttctaaggtcctacaagaaacttgcaactatatcaagaacttgcatagggaggttgatgatttaagtgagcgattgtctcagcttttggcaacaattgattctgatagtcctgaagctgagataataaggagtttaattatgtaa

SEQ ID NO: 5227 - protein, 90 aa, Populus balsamifera subsp. trichocarpa
  misc_feature (1)..(90): useful for making plants with increased nitrogen use efficiency as described in USSN 12/776,319
  misc_feature (1)..(90): Ceres GDNA ANNOT ID no. 1449794
  misc_feature (1)..(90): Functional Homolog of  Ceres CLONE ID no. 653656 with e-value of 1.70E-26 and percent identity of 79.5
  misc_feature (1)..(90): Functional Homolog of  Ceres CLONE ID no. 733804 with e-value of 1.70E-24 and percent identity of 70
  misc_feature (1)..(90): Functional Homolog of  Ceres CLONE ID no. 8607 with e-value of 5.69E-26 and percent identity of 73.8
MSSRRSRQSSVPRITDDQIIHLVSKLRQLLPEIRQRRSDKVSASKVLQETCNYIKNLHREVDDLSERLSQLLATIDSDSPEAEIIRSLIM

SEQ ID NO: 5228 - protein, 88 aa, Oryza sativa subsp. japonica
  misc_feature (1)..(88): useful for making plants with increased nitrogen use efficiency as described in USSN 12/776,319
  misc_feature (1)..(88): Public GI no. 31431968
  misc_feature (1)..(88): Functional Homolog of  Ceres CLONE ID no. 519 with e-value of 1.99E-16 and percent identity of 65.8
  misc_feature (1)..(88): Functional Homolog of  Ceres CLONE ID no. 4734 with e-value of 1.49E-16 and percent identity of 51.1
  misc_feature (1)..(88): Functional Homolog of  Ceres CLONE ID no. 8607 with e-value of 2.49E-16 and percent identity of 50.6
  misc_feature (1)..(88): Functional Homolog of  Ceres CLONE ID no. 336524 with e-value of 1.60E-28 and percent identity of 84.3
  misc_feature (1)..(88): Functional Homolog of  Ceres CLONE ID no. 560681 with e-value of 1.29E-19 and percent identity of 62.3
  misc_feature (1)..(88): Functional Homolog of  Ceres CLONE ID no. 560948 with e-value of 6.39E-18 and percent identity of 60
  misc_feature (1)..(88): Functional Homolog of  Ceres CLONE ID no. 653656 with e-value of 8.20E-18 and percent identity of 64.1
  misc_feature (1)..(88): Functional Homolog of  Ceres CLONE ID no. 733804 with e-value of 8.79E-21 and percent identity of 64.2
MSGRRASGRITDDEINELISKLQSLLPESSRRRGATSRSPATKLLKEMCSYIKSLHREVDDLSERLSELMATMDSNSPQADIIRSLLR

SEQ ID NO: 5229 - protein, 88 aa, Oryza sativa subsp. japonica
  misc_feature (1)..(88): useful for making plants with increased nitrogen use efficiency as described in USSN 12/776,319
  misc_feature (1)..(88): Public GI no. 50912765
  misc_feature (1)..(88): Functional Homolog of  Ceres CLONE ID no. 519 with e-value of 2.49E-16 and percent identity of 58.5
  misc_feature (1)..(88): Functional Homolog of  Ceres CLONE ID no. 4734 with e-value of 2.80E-17 and percent identity of 53.4
  misc_feature (1)..(88): Functional Homolog of  Ceres CLONE ID no. 8607 with e-value of 1.49E-16 and percent identity of 52.9
  misc_feature (1)..(88): Functional Homolog of  Ceres CLONE ID no. 336524 with e-value of 3.99E-25 and percent identity of 73.2
  misc_feature (1)..(88): Functional Homolog of  Ceres CLONE ID no. 560681 with e-value of 4.90E-20 and percent identity of 60.4
  misc_feature (1)..(88): Functional Homolog of  Ceres CLONE ID no. 560948 with e-value of 1.90E-18 and percent identity of 59.3
  misc_feature (1)..(88): Functional Homolog of  Ceres CLONE ID no. 653656 with e-value of 5.00E-18 and percent identity of 60.7
  misc_feature (1)..(88): Functional Homolog of  Ceres CLONE ID no. 733804 with e-value of 4.90E-20 and percent identity of 62.7
MSSRRSSRGSISEEEINELISKLQSLLPNSRRRGSSQASTTKLLKETCNYIKSLHREVDDLSDRLSDLMATMDHNSPGAEIIRSILRS

SEQ ID NO: 5230 - protein, 90 aa, Zea mays
  misc_feature (1)..(90): useful for making plants with increased nitrogen use efficiency as described in USSN 12/776,319
  misc_feature (1)..(90): Ceres CLONE ID no. 486120
  misc_feature (1)..(90): Functional Homolog of  Ceres CLONE ID no. 519 with e-value of 1.20E-16 and percent identity of 53.57143
  misc_feature (1)..(90): Functional Homolog of  Ceres CLONE ID no. 4734 with e-value of and 1.50E-18 percent identity of 54.65116
  misc_feature (1)..(90): Functional Homolog of  Ceres CLONE ID no. 8607 with e-value of 5.40E-14 and percent identity of 48.61111
  misc_feature (1)..(90): Functional Homolog of  Ceres CLONE ID no. 336524 with e-value of 1.10E-24 and percent identity of 67.81609
  misc_feature (1)..(90): Functional Homolog of  Ceres CLONE ID no. 560681 with e-value of 1.20E-18 and percent identity of 59.77011
  misc_feature (1)..(90): Functional Homolog of  Ceres CLONE ID no. 560948 with e-value of 6.40E-18 and percent identity of 58.62069
  misc_feature (1)..(90): Functional Homolog of  Ceres CLONE ID no. 653656 with e-value of 8.70E-14 and percent identity of 60.86957
  misc_feature (1)..(90): Functional Homolog of  Ceres CLONE ID no. 733804 with e-value of 9.70E-15 and percent identity of 57.74648
MSSRRSSSHGNISEDEMNELVSKLQALLPSSRRRRGSGQASTAKLLKETCSYIKSLQREVDDLSDRLSDLLSTMDHNSPAAEIIRSILRS

SEQ ID NO: 5231 - protein, 89 aa, Zea mays
  misc_feature (1)..(89): useful for making plants with increased nitrogen use efficiency as described in USSN 12/776,319
  misc_feature (1)..(89): Ceres CLONE ID no. 503296
  misc_feature (1)..(89): Functional Homolog of  Ceres CLONE ID no. 519 with e-value of 2.50E-16 and percent identity of 55.42169
  misc_feature (1)..(89): Functional Homolog of  Ceres CLONE ID no. 4734 with e-value of and 9.40E-17 percent identity of 50.58824
  misc_feature (1)..(89): Functional Homolog of  Ceres CLONE ID no. 8607 with e-value of and 9.40E-17 percent identity of 50.58824
  misc_feature (1)..(89): Functional Homolog of  Ceres CLONE ID no. 336524 with e-value of 4.40E-26 and percent identity of 77.5
  misc_feature (1)..(89): Functional Homolog of  Ceres CLONE ID no. 560681 with e-value of 2.10E-19 and percent identity of 56.47059
  misc_feature (1)..(89): Functional Homolog of  Ceres CLONE ID no. 560948 with e-value of 1.30E-17 and percent identity of 56.32184
  misc_feature (1)..(89): Functional Homolog of  Ceres CLONE ID no. 653656 with e-value of 9.10E-19 and percent identity of 59.03614
  misc_feature (1)..(89): Functional Homolog of  Ceres CLONE ID no. 733804 with e-value of 1.70E-19 and percent identity of 57.47126
MSSRRPSSRGNISEDEINELISKLQALLPSSRRRGSGQASTTKLLKETCSYIKSLHREVDDLSDRLSDLMATMDHNSPGAEIIRSILRS

SEQ ID NO: 5232 - DNA, 884 bp, Arabidopsis thaliana
  misc_feature (1)..(884): useful for making plants with modulated biomass and growth as described in USSN 12/911,698
  misc_feature (1)..(884): Ceres CLONE ID no. 92459
  misc_feature (1)..(884): Also Known As Ceres ME LINE ME04077
  misc_feature (1)..(884): Also Known As Ceres  LEAD Number 15
aggattaaattagggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttc

SEQ ID NO: 5233 - protein, 206 aa, Arabidopsis thaliana
  misc_feature (1)..(206): useful for making plants with modulated biomass and growth as described in USSN 12/911,698
  misc_feature (1)..(206): Ceres CLONE ID no. 92459
  misc_feature (1)..(206): Also Known As Ceres CDNA ID no. 23361912
  misc_feature (1)..(206): Also Known As Ceres ME LINE ME04077
  misc_feature (1)..(206): Also Known As Ceres  LEAD Number 15
  misc_feature (117)..(166): Pfam Name: K-box; Pfam Description: K-box re.g.ion
  misc_feature (9)..(59): Pfam Name: SRF-TF; Pfam Description: SRF-type transcription factor (DNA-binding and dimerisation domain)
  misc_feature (1)..(206): Phenotype: Late Flowering Useful for delaying flowering time
  misc_feature (1)..(206): Phenotype: Dark Green Useful for increasing chlorophyll and photosynthetic capacity
  misc_feature (1)..(206): Phenotype: Large Useful for making larger plants
  misc_feature (1)..(206): Phenotype: INFLORESCENCE Useful for making ornamental plants with modified flowers
  misc_feature (1)..(206): Phenotype: CAULINE LEAVES Useful for making ornamental plants with modified leaves
  misc_feature (1)..(206): Phenotype: ROSETTE LEAVES Useful for making ornamental plants with modified leaves
  misc_feature (1)..(206): Phenotype: Serrate Margins Useful for making plants with increased biomass and foliage
  misc_feature (1)..(206): Phenotype: Serrate Margins Useful for making plants with increased biomass and foliage
  misc_feature (1)..(206): Phenotype: Plant Size Useful for making plants with increased size and biomass
  misc_feature (1)..(206): Phenotype: Strong Useful for making stronger plants
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLNPPSSTAEFSP

SEQ ID NO: 5234 - protein, 201 aa, Brassica rapa subsp. pekinensis
  misc_feature (1)..(201): useful for making plants with modulated biomass and growth as described in USSN 12/911,698
  misc_feature (1)..(201): Public GI no. 71834745
  misc_feature (1)..(201): Functional Homolog of  Ceres CLONE ID no. 92459 with e-value of 6.50E-66 and percent identity of 75.2
MGRRKVEIKLIENKSSRQVTFSKRRTGLIEKARQLSVLCESSVAVLVVSASGKLYNSSSGDNMTNIVDRYEIQHAGELRSLDLAEKTRNYLPHKELLESVKSNLEEPNVDSVSVDSLISLEDQLETALSATRARKTELTMEFVKMLQEKEELLREENLVLVSQIGTTNGRRENNSPVNSSGINPPETLPLLKVTSVIQRLS

SEQ ID NO: 5235 - protein, 196 aa, Brassica napus
  misc_feature (1)..(196): useful for making plants with modulated biomass and growth as described in USSN 12/911,698
  misc_feature (1)..(196): Public GI no. 31580813
  misc_feature (1)..(196): Functional Homolog of  Ceres CLONE ID no. 92459 with e-value of 3.09E-59 and percent identity of 67.5
MGRKKLEIKRIENKSSRQVTFSKRRNGLIEKARQLSVLCDASVALLVVSASGKLYNFSAGDNLVKILDRYGKQHADDLKALDLQSKAPKYGSHHELLELVESKLVESNSDVSVDSLVQLEDHLETALSVTRARKTELMLKLVDSLKEKEKLLKEENQGLASQMEKNNLAGAEADKMEMSPGQISDINRPVTLRLLY

SEQ ID NO: 5236 - protein, 197 aa, Brassica oleracea var. capitata
  misc_feature (1)..(197): useful for making plants with modulated biomass and growth as described in USSN 12/911,698
  misc_feature (1)..(197): Public GI no. 34591565
  misc_feature (1)..(197): Functional Homolog of  Ceres CLONE ID no. 92459 with e-value of 3.50E-58 and percent identity of 67.0
MGRKKLEIKRIENKSSRQVTFSKRRNGLIEKARQLSVLCDASVALLVVSASGKLYNFSAGDDLVKVIDRYGEQHADDDRKALDLQSEAPKYGSHHELLELVESKLVESNSDVSVDSLVQLENHLETALSVTRARKTELLLKLVDSLKEKEKLLKEENQGLASQMEKNNLAGAEADKMEVSPGQISDINCPVTLPLLY

SEQ ID NO: 5237 - protein, 197 aa, Brassica napus
  misc_feature (1)..(197): useful for making plants with modulated biomass and growth as described in USSN 12/911,698
  misc_feature (1)..(197): Ceres CLONE ID no. 1065387
  misc_feature (1)..(197): Functional Homolog of  Ceres CLONE ID no. 92459 with e-value of 1.30E-60 and percent identity of 67.0
MGRKKLEIKRIENKSSRQVTFSKRRNGLIEKARQLSVLCDASVALLVVSASGKLYSFSSGDNLVKILDRYGKQHDDDLKALDRQSKALDCGSHHELLELVESKLEESNVDNVSVGSLVQLEEHLENALSVTRARKTELMLKLVENLKEKEKLLEEENHVLASQMEKSNLVRAEADNMDVSPGQISDINLPVTLPLLN

SEQ ID NO: 5238 - protein, 197 aa, Brassica napus; identical to SEQ ID NO: 5237
  misc_feature (1)..(197): useful for making plants with modulated biomass and growth as described in USSN 12/911,698
  misc_feature (1)..(197): Public GI no. 17933450
  misc_feature (1)..(197): Functional Homolog of  Ceres CLONE ID no. 92459 with e-value of 1.59E-60 and percent identity of 66.8

SEQ ID NO: 5239 - protein, 196 aa, Brassica napus
  misc_feature (1)..(196): useful for making plants with modulated biomass and growth as described in USSN 12/911,698
  misc_feature (1)..(196): Public GI no. 17933456
  misc_feature (1)..(196): Functional Homolog of  Ceres CLONE ID no. 92459 with e-value of 4.99E-59 and percent identity of 66.4
MGRKKLEIKRIENKSSRQVTFSKRRNGLIEKARQLSVLCDASVALLVVSASGKLYNFSAGDDLVKIVDRYGKQHADDRKALDLQSEAPKYGSHHELLELVESKLVESNSDVSVDSLVQLENHLETALSVTRARKTELLLKLVDSLKEKEKLLKEENQGLASQMEKNNLAGAEADKMEVSPGQISDINCPVTLPLLY

SEQ ID NO: 5240 - protein, 196 aa, Brassica napus; identical to SEQ ID NO: 5239
  misc_feature (1)..(196): useful for making plants with modulated biomass and growth as described in USSN 12/911,698
  misc_feature (1)..(196): Ceres CLONE ID no. 1091989
  misc_feature (1)..(196): Functional Homolog of  Ceres CLONE ID no. 92459 with e-value of 4.99E-59 and percent identity of 66.4

SEQ ID NO: 5241 - protein, 196 aa, Brassica napus
  misc_feature (1)..(196): useful for making plants with modulated biomass and growth as described in USSN 12/911,698
  misc_feature (1)..(196): Public GI no. 17933458
  misc_feature (1)..(196): Functional Homolog of  Ceres CLONE ID no. 92459 with e-value of 1.19E-57 and percent identity of 65.6
MGRKKLEIKRIEKNSSRQVTFCKRRNGLIEKARQLSVLCEASVGLLVVSASDKLYSFSSGDRLEKILDRYGKKHADDLNALDLQSKSLNYSSHHELLELVESKLVESIDDVSVDSLVELEDHLETALSVTRARKAELMLKLVESLKEKENLLKEENQVLASQIEKKNLEGAEADNIEMSSGQISDINLPVTLPLLN

SEQ ID NO: 5242 - DNA, 614 bp, Arabidopsis thaliana
  misc_feature (1)..(614): useful for making plants with modulated biomass and growth as described in USSN 12/911,698
  misc_feature (1)..(614): Ceres CLONE ID no. 1952
  misc_feature (1)..(614): Also Known As Ceres ME LINE ME04701
  misc_feature (1)..(614): Also Known As Ceres  LEAD Number 28
ggaagtgaaggaggtatatccggaggtggtatgtctgggggcagtggaagtaaacacaaaattggaggaggtaaacacggaggtcttggaggtaaattcggaaagaaaagaggcatgtccggaagtggaggaggcatgtcaggaagtgaaggaggtgtgtctggaagtgaaggaagtatgtccggaggtggtatgtctgggggtagcggaagtaaacacaaaattggaggaggtaaacacggaggtcttagaggtaaattcggaaagaaaagaggtatgtcaggaagtgaaggaggtatgtctggaagtgaaggaggtgtgtcggaaagtggtatgtccgggagtggagggggtaaacacaaaatcggaggaggtaaacacaaatttggaggaggtaaacacggaggtggaggtggccacatggcggagtaaagaacaatggtcaagttgttccaacattaagcagatcattgtgcattagttcaagattgtatgattgggaaagtaaaagaaagaaaaaatattttctaataagttttatgtttatatgtaatgttgaatctgattattatgataaaaagacataaatgtgatacaatgtttattttaagagc

SEQ ID NO: 5243 - protein, 133 aa, Arabidopsis thaliana
  misc_feature (1)..(133): useful for making plants with modulated biomass and growth as described in USSN 12/911,698
  misc_feature (1)..(133): Ceres CLONE ID no. 1952
  misc_feature (1)..(133): Also Known As Ceres ME LINE ME04701
  misc_feature (1)..(133): Also Known As Ceres  LEAD Number 28
  misc_feature (1)..(133): Phenotype: INFLORESCENCE Useful for making ornamental plants with modified flowers
  misc_feature (1)..(133): Phenotype: ROSETTE LEAVES Useful for making ornamental plants with modified leaves
  misc_feature (1)..(133): Phenotype: Plant Architecture Useful for making plants with enhanced plant architecture
  misc_feature (1)..(133): Phenotype: Disorganized Rosette Useful for making plants with increased biomass
  misc_feature (1)..(133): Phenotype: Lanceolate Shaped Useful for making plants with increased biomass and foliage
MSGGSGSKHKIGGGKHGGLGGKFGKKRGMSGSGGGMSGSEGGVSGSEGSMSGGGMSGGSGSKHKIGGGKHGGLRGKFGKKRGMSGSEGGMSGSEGGVSESGMSGSGGGKHKIGGGKHKFGGGKHGGGGGHMAE

SEQ ID NO: 5244 - DNA, 1383 bp, Arabidopsis thaliana
  misc_feature (1)..(1383): useful for making plants with modulated biomass and growth as described in USSN 12/911,698
  misc_feature (1)..(1383): Ceres CLONE ID no. 123905
  misc_feature (1)..(1383): Also Known As Ceres ME LINE ME04717
  misc_feature (1)..(1383): Also Known As Ceres  LEAD Number 29
caaaaacacaaacaaaactcatattttcaatctccaggtgctttacaccaacagagtcgcaagaaaacaaaaaccaaactcggatttagtttgacagaagaaggaatcgagagtcgggtatgcattatcctaacaacagaaccgaattcgtcggagctccagccccaacccggtatcaaaaggagcagttgtcaccggagcaagagctttcagttattgtctctgctttgcaacacgtgatctcaggggaaaacgaaacggcgccgtgtcagggtttttccagtgacagcacagtgataagcgcgggaatgcctcggttggattcagacacttgtcaagtctgtaggatcgaaggatgtctcggctgtaactactttttcgcgccaaatcagagaattgaaaagaatcatcaacaagaagaagagattactagtagtagtaacagaagaagagagagctctcccgtggcgaagaaagcggaaggtggcgggaaaatcaggaagaggaagaacaagaagaatggttacagaggagttaggcaaagaccttggggaaaatttgcagctgagatcagagatcctaaaagagccacacgtgtttggcttggtactttcgaaaccgccgaagatgcggctcgagcttatgatcgagccgcgattggattccgtgggccaagggctaaactcaacttcccctttgtggattacacgtcttcagtttcatctcctgttgctgctgatgatataggagcaaatgcaagtgcaagcgccagtgtgagcgccacagattcagttgaagcagagcaatggaacggaggaggaggggattgcaatatggagtggatgaatatgatgatgatgatggattttgggaatggagattcttcagattcaggaaatacaattgctgatatgttccagtgataaatgagctctttcttgttggcgttttttggagttaagtgcaagaagagattgacactgtggcttgtttaaagtgaacaagaacaagaaagcatgtaattagtagtctcattcttttgtttgtggtcaattctatgtttatctcatataaaatctgagttaaacctatctgaggagagagtaaataaagaggttaagaaacccaacattggtctgaattataaacgtaagtgtcaacgttgtttataaaggagaaaactataattggtgacaaaagacataaagaaaagatgtctactcctacaaagcatcgcgtgcagctattcgacaaacaatggcatctcccagagaggaaattccgagctcttggctagttatcttgtaatgctgaaaacatgaatgtatttgagtttatttctgtaacattggaagcgaaataaaagggttatcaactgttacc

SEQ ID NO: 5245 - protein, 267 aa, Arabidopsis thaliana
  misc_feature (1)..(267): useful for making plants with modulated biomass and growth as described in USSN 12/911,698
  misc_feature (1)..(267): Ceres CLONE ID no. 123905
  misc_feature (1)..(267): Also Known As Ceres ME LINE ME04717
  misc_feature (1)..(267): Also Known As Ceres  LEAD Number 29
  misc_feature (134)..(197): Pfam Name: AP2; Pfam Description: AP2 domain
  misc_feature (1)..(267): Phenotype: INFLORESCENCE Useful for making ornamental plants with modified flowers
  misc_feature (1)..(267): Phenotype: ROSETTE LEAVES Useful for making ornamental plants with modified leaves
  misc_feature (1)..(267): Phenotype: Plant Architecture Useful for making plants with enhanced plant architecture
  misc_feature (1)..(267): Phenotype: Disorganized Rosette Useful for making plants with increased biomass
  misc_feature (1)..(267): Phenotype: Lanceolate Shaped Useful for making plants with increased biomass and foliage
  misc_feature (1)..(267): Phenotype: Short Useful for making shorter plants
  misc_feature (1)..(267): Phenotype: Reduced Apical Dominance Useful for modifying plant structure, i.e. increased branching
  misc_feature (1)..(267): Phenotype: Reduced fertility Useful for sterility, genetic confinement systems
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGANASASASVSATDSVEAEQWNGGGGDCNMEWMNMMMMMDFGNGDSSDSGNTIADMFQ

SEQ ID NO: 5246 - protein, 229 aa, Populus balsamifera subsp. trichocarpa
  misc_feature (1)..(229): useful for making plants with modulated biomass and growth as described in USSN 12/911,698
  misc_feature (1)..(229): 1460991
  misc_feature (1)..(229): Functional Homolog of  Ceres CLONE ID no. 123905  with e-value of 2.10E-35 and percent identity of 59.8
MVAALKNVVSGTASMDFSREMNSINMPIITSHPQFGSASNNGNGFCNSILPPSSDLDTCGVCKIKGCLGCNFFPPNQEDKKDDKKGKRKRVKKNYRGVRQRPWGKWAAEIRDPRKAARVWLGTFNTAEEAARAYDKAAIDFRGPRAKLNFPFPDSGIASFEESKEKQEKQQEISEKRSEFETETGKDNEFLDNIVDEELQEWMAMIMDFGNGGSSNSSGTASAAATIGF

SEQ ID NO: 5247 - protein, 256 aa, Zea mays
  misc_feature (1)..(256): useful for making plants with modulated biomass and growth as described in USSN 12/911,698
  misc_feature (1)..(256): Ceres CLONE ID no. 1494990
  misc_feature (1)..(256): Functional Homolog of  Ceres CLONE ID no. 123905  with e-value of 4.19E-37 and percent identity of 49.2
MEASRQYMIRFDGHFEEGPSSAAAEPPQPFASRAFSPEQEQSVMVAALLHVVSGYATPAPDLFFPAGKEACTACGVDGCLGCEFFGAEAGRAVAASDAPRAATAGGPQRRRRNKKSQYRGVRQRPWGKWAAEIRDPRRAVRVWLGTFDTAEDAARAYDRAAVKFRGPRAKLNFSFPEQHLRDDSGNAAAKSDACSPSPSPRSAEEEETGDLLWDGLVDLMKLDESDLCLLLPVDNTLDKFHAPGQRRSGSGVPLCY

SEQ ID NO: 5248 - protein, 266 aa, Triticum aestivum
  misc_feature (1)..(266): useful for making plants with modulated biomass and growth as described in USSN 12/911,698
  misc_feature (1)..(266): Ceres CLONE ID no. 634402
  misc_feature (1)..(266): Functional Homolog of  Ceres CLONE ID no. 123905  with e-value of 1.80E-36 and percent identity of 45.0
MTFSVSPATGASQEYMIRFDGHFEDPSSAAASAEPPLPFAGRAFSPQQEQSAMVAALLHVVSGYTTPAPDLFFPARKEACTACGMDGCLGCEFFGAEAGRAVAASDAPRAPAAGGPQRRRRNKKNQYRGVRQRPWGKWAAEIRDPRRAVRVWLGTFDTAEDAARAYDRAAVEFRGPRAKLNFSFPEQQQQQLGGSGNAAAKSDACSPSPSPRSADEDETGDLLWDGLVDLMKLDESDLCLLLPVDNTDKFHIEGKRRSGSGVPLCY

SEQ ID NO: 5249 - protein, 274 aa, Oryza sativa subsp. japonica
  misc_feature (1)..(274): useful for making plants with modulated biomass and growth as described in USSN 12/911,698
  misc_feature (1)..(274): Public GI no. 51536200
  misc_feature (1)..(274): Functional Homolog of  Ceres CLONE ID no. 123905  with e-value of 3.09E-34 and percent identity of 43.4
MTKKVIPAMAAARQDSCKTKLDERGGSHQAPSSARWISSEQEHSIIVAALRYVVSGCTTPPPEIVTVACGEACALCGIDGCLGCDFFGAEAAGNEEAVMATDYAAAAAAAAVAGGSGGKRVRRRRKKNVYRGVRHRPWGKWAAEIRDPRRAVRKWLGTFDTAEEAARAYDRAALEFRGARAKLNFPCSEPLPMPSQRNGNGGDAVTAATTTAEQMTPTLSPCSADAEETTTPVDWQMGADEAGSNQLWDGLQDLMKLDEADTWFPPFSGAASSF

SEQ ID NO: 5250 - DNA, 541 bp, Glycine max
  misc_feature (1)..(541): useful for making plants with modulated biomass and growth as described in USSN 12/911,698
  misc_feature (1)..(541): Ceres CLONE ID no. 679923
  misc_feature (1)..(541): Also Known As Ceres ME LINE ME03195
  misc_feature (1)..(541): Also Known As Ceres  LEAD Number 36
gctcaagtttccaagaccaagccaatggaaaacctttcaccattgatttacaaaaaccccattagaagaacttctaggcgatctacaatgtatcttggtgtgagaaaaaggccatggggaagatatgctgctgagattaggaacccatacaccaaagagagacactggctaggcacatttgacactgctgaagaggctgctatagcttatgatctttcatctatcaagatttgtggcattaatgctcgaactaattttcactacccttttgtgtctcttccaccacttcctatgtcgtcattgcctcctccaccgccaccgccgaccccagagttggatccaagtgttgaagtttgtctagagatgatgaatgctgcttcttacgatggtgatgatgaatctcttgttattgcttccattttgcaaagtttttctaattctggtaactgttctttttagtttttggttccaatgaggctatggcctgcctcttatcaaatcaataattctattttttttctttgcaaaaaaaaaaaaaaaa

SEQ ID NO: 5251 - protein, 144 aa, Glycine max
  misc_feature (1)..(144): useful for making plants with modulated biomass and growth as described in USSN 12/911,698
  misc_feature (1)..(144): Ceres CLONE ID no. 679923
  misc_feature (1)..(144): Also Known As Ceres ME LINE ME03195
  misc_feature (1)..(144): Also Known As Ceres  LEAD Number 36
  misc_feature (21)..(84): Pfam Name: AP2; Pfam Description: AP2 domain
  misc_feature (1)..(144): Phenotype: Late Flowering Useful for delaying flowering time
  misc_feature (1)..(144): Phenotype: Large Useful for making ornamental plants with modified flowers
  misc_feature (1)..(144): Phenotype: ROSETTE LEAVES Useful for making ornamental plants with modified leaves
  misc_feature (1)..(144): Phenotype: Curled 1 Useful for making plants with altered leaf shape e.g. curled leaves
  misc_feature (1)..(144): Phenotype: Plant Architecture Useful for making plants with enhanced plant architecture
  misc_feature (1)..(144): Phenotype: Short Useful for making shorter plants
  misc_feature (1)..(144): Phenotype: Short Petioles Useful for making smaller plants
  misc_feature (1)..(144): Phenotype: Strong Useful for making stronger plants
MENLSPLIYKNPIRRTSRRSTMYLGVRKRPWGRYAAEIRNPYTKERHWLGTFDTAEEAAIAYDLSSIKICGINARTNFHYPFVSLPPLPMSSLPPPPPPPTPELDPSVEVCLEMMNAASYDGDDESLVIASILQSFSNSGNCSF

SEQ ID NO: 5252 - protein, 129 aa, Populus balsamifera subsp. trichocarpa
  misc_feature (1)..(129): useful for making plants with modulated biomass and growth as described in USSN 12/911,698
  misc_feature (1)..(129): 1479788
  misc_feature (1)..(129): Functional Homolog of  Ceres CLONE ID no. 679923  with e-value of 3.80E-36 and percent identity of 69.0
MENFPPLLYRNPKRSSRQSSRYLGVRRRPWGRYAAEIRNPYTKERHWLGTFDTAEEAAVAYDLSSISFSGIERARTNFYYPFFAHPSPSQEAPPPPLPPPEMEKGDQLGMEDVDGNNALEILLKAGNGK

SEQ ID NO: 5253 - protein, 143 aa, Populus balsamifera subsp. trichocarpa
  misc_feature (1)..(143): useful for making plants with modulated biomass and growth as described in USSN 12/911,698
  misc_feature (1)..(143): 1533259
  misc_feature (1)..(143): Functional Homolog of  Ceres CLONE ID no. 679923  with e-value of 3.49E-42 and percent identity of 66.6
MENFPPLLYRNPKRSSRQSSRYLGVRRRPWGRYAAEIRNPYTKERHWLGTFDTAEEAAVAYDLSSISFSGIERARTNFYYPFFAHPSPSQEAPPPPLPPPEMEKGDQLGMEDVGTTQDDESIVIASILQSFCQSTSYSFHPQI

SEQ ID NO: 5254 - protein, 175 aa, Oryza sativa subsp. japonica
  misc_feature (1)..(175): useful for making plants with modulated biomass and growth as described in USSN 12/911,698
  misc_feature (1)..(175): Public GI no. 50941583
  misc_feature (1)..(175): Functional Homolog of  Ceres CLONE ID no. 679923  with e-value of 1.20E-32 and percent identity of 65.8
MADAAEQHHRQEETAAATTTPQQMMMRRRRARASSEYLGVRRRPWGRYAAEIRNPYTKERHWLGTFDTAEEAAVAYDLSAISISGAAAARTNFLYPDMHHHHPSPPQHALSPAVPPPPPPPPPSPLYDDDYLSPAAAEEEVEAGDDESLTIATILQSFQYQQSVPPASSGSMFYY

SEQ ID NO: 5255 - DNA, 1681 bp, Glycine max
  misc_feature (1)..(1681): useful for making plants with modulated biomass and growth as described in USSN 12/911,698
  misc_feature (1)..(1681): Ceres CLONE ID no. 691319
  misc_feature (1)..(1681): Also Known As Ceres ME LINE ME05057
  misc_feature (1)..(1681): Also Known As Ceres ME LINE ME09233
aaaagggtgtccaaagaaggaatcacacaagagaaattttgggtggatcttggtaatttaaatttggtccaaaaatagtaagaaaaaaaaaccatagttcatttaattttcatgtccttgctaacggtggcgcaccaaagggggtcaggtgagtttatccggttcacggaaagtcatggcggtggtggcgatgacgtcagtggtgacggtgaacatggttgtggacatgatgatggaagtggtgctggaggttcactagggttgaattttaaccaagtgatgcaacaaggtgaggtgacaatgcaaggtggttcattggtttcagggtataacaggggtgatccagagttgagagaaatagtttcagctttgacacacgtggtgtcttcagggtctggccagaggagcaccgaattgacccagcaaagtggttttcctatgatgtctgcttcttctctttcacgtttgtctgctttctcttcttcttctccttctccttcttctggagcctcttgggttggccacaaaagaggcagagaagaagaagagaatagtacttcacataacttgatgcaacaacaacaacaaagtgctccaagactcttcagaaacattggtgacttcatggtgccttctcaaggagactcatcatcagtgacagaagaagcccccacctccacaactacaactgtaaccgccgtcactgaaaacccaccaggaggtggggaaaggaggagaaagtacagaggagtgaggcagaggccatggggaaaatgggcagcagaaatccgtgatccacacaaagcagcaagagtttggctaggcacatttgacacagaagaagcagcagcaagagcctatgatgaagctgcattgaggttcagaggcaacagagcaaagcttaacttccctgaaaatgtaagagcagttccacccattcaaccttttcaagccaccactaggctaaccgtttctgattccaccacctctcaattccggccactctccgcggtggcgccacccttcattcagcagccacagattcagggctcctctgacttgatcagagactacttgcaatactctcagcttctacagagtgattttcaacagcaacaaatacaacaacaacagcagcagcagcggcagcagcagcagcggcagcggcagcagcggcagcagcagcagcaacaacaacaacaaccatctagtttgcttcagcagttgtactataatgcacaatttgcttcacttcaatcaccttcaatgctatcatcatctccttcattttcttcttctgtgtctccagcaccattcccattattcacaacctctgcttctttccccttgttttcaagtcaacaaatgggctatttccagccaccggaaagccgcaatcccgctggcggcgtgccggagtttccaacgtccacatggtcggataccagtagccagccaccaccttctggttgatacagtgttttagtttccttcatattttcctttttcttttttctttctttcattcttagcataaaaaaaaaagacttgttatacttatttcttttttcaagggtgaaactatgatatagttttttttaagtatttttggtactattctcgtatcagaattagagtttcagtaatttatgttgatattcaatacaaatctttattatgt

SEQ ID NO: 5256 - protein, 453 aa, Glycine max
  misc_feature (1)..(453): useful for making plants with modulated biomass and growth as described in USSN 12/911,698
  misc_feature (1)..(453): Ceres CLONE ID no. 691319
  misc_feature (1)..(453): Also Known As Ceres ME LINE ME05057
  misc_feature (1)..(453): Also Known As Ceres ME LINE ME09233
  misc_feature (209)..(272): Pfam Name: AP2; Pfam Description: AP2 domain
  misc_feature (1)..(453): Phenotype: ROSETTE LEAVES Useful for making ornamental plants with modified leaves
  misc_feature (1)..(453): Phenotype: Disorganized Rosette Useful for making plants with increased biomass
  misc_feature (1)..(453): Phenotype: Lanceolate Shaped Useful for making plants with increased biomass and foliage
  misc_feature (1)..(453): Phenotype: Short Useful for making shorter plants
MSLLTVAHQRGSGEFIRFTESHGGGGDDVSGDGEHGCGHDDGSGAGGSLGLNFNQVMQQGEVTMQGGSLVSGYNRGDPELREIVSALTHVVSSGSGQRSTELTQQSGFPMMSASSLSRLSAFSSSSPSPSSGASWVGHKRGREEEENSTSHNLMQQQQQSAPRLFRNIGDFMVPSQGDSSSVTEEAPTSTTTTVTAVTENPPGGGERRRKYRGVRQRPWGKWAAEIRDPHKAARVWLGTFDTEEAAARAYDEAALRFRGNRAKLNFPENVRAVPPIQPFQATTRLTVSDSTTSQFRPLSAVAPPFIQQPQIQGSSDLIRDYLQYSQLLQSDFQQQQIQQQQQQQRQQQQRQRQQRQQQQQQQQQPSSLLQQLYYNAQFASLQSPSMLSSSPSFSSSVSPAPFPLFTTSASFPLFSSQQMGYFQPPESRNPAGGVPEFPTSTWSDTSSQPPPSG

SEQ ID NO: 5257 - protein, 398 aa, Populus balsamifera subsp. trichocarpa
  misc_feature (1)..(398): useful for making plants with modulated biomass and growth as described in USSN 12/911,698
  misc_feature (1)..(398): 1443093
  misc_feature (1)..(398): Functional Homolog of  Ceres CLONE ID no. 691319  with e-value of 3.19E-73 and percent identity of 56.0
MGYSSSTEMSMVSELTHVVSGQRGSTSDWGSYGAVGLGGATITSNFGQAAPGSNTSTPASPPLSAYSSTSGSGLWIGQKRGREEEAGAAAQLMESLPRVYRGFNDFRSSQGDSSSSGATATEEVSASTIVIPTTTTPSTTATPSSEIASLEETGEQRRRYRGVRQRPWGKWAAEIRDPHKAARVWLGTFDTAEAAARAYDDAALRFRGNRAKLNFPENVRLLPAQTQNVTASQVPISHSQLSSHLQLQPISSPRQQAQRPQAPAPALFQSQADIIRDYWEYSQLLQSSGEFHHHQQQQQQQQQPSSLLQPMFYNPQVASLQSSALTSLSSSTSVSSLAAISSGSSPSTFSPSASSFPLLFAGQQLGYFRPPQNQNPASGSDFPVPPWTDSSHNPSSSG

SEQ ID NO: 5258 - protein, 393 aa, Populus balsamifera subsp. trichocarpa
  misc_feature (1)..(393): useful for making plants with modulated biomass and growth as described in USSN 12/911,698
  misc_feature (1)..(393): 1452324
  misc_feature (1)..(393): Functional Homolog of  Ceres CLONE ID no. 691319  with e-value of 1.69E-67 and percent identity of 54.8
MGYSSSAEMSAMVSALTHVVSGHRGSTSDWGSYGASGLGGATITSTIVQAAPGSNTSPASPSLSAYSSTSGSGSWIGQKRGREKEAGAAAQLKESLPRVHRGFDDFRSSLGDSPSSGATATEEVSASTLVFSTTATPSTTATPSSETASLGETGERKRRYRGVRQRPWGKWAAEIRDPHKAARVWLGTFETAEAAARAYDEAALRFRGSRAKLNFPENARLLPAQMQNVTASQVPISRSQLPSHHQLQSISSPRQQAQRPQVPAPALFQSQPDIIRDYWEYSQLLQSSGDFHGQQQPPPSNLLEQMFYNPQLASLQSSTLSSLPSSTSGSSFAAIPSGSISSTLSPSASSFPLLFAGQQLGYFRPPENQNPAAGSDFPVPPWTDCSRRPSSTG

SEQ ID NO: 5259 - DNA, 877 bp, Arabidopsis thaliana
  misc_feature (1)..(877): useful for making plants with modulated biomass and growth as described in USSN 12/911,698
  misc_feature (1)..(877): Ceres CLONE ID no. 98850
agattaggattaaattagggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgagatagaagcgctgttcaagccggagaaacctcaatgttttgaactcgatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttctcc

SEQ ID NO: 5260 - protein, 192 aa, Arabidopsis thaliana
  misc_feature (1)..(192): useful for making plants with modulated biomass and growth as described in USSN 12/911,698
  misc_feature (1)..(192): Ceres CLONE ID no. 98850
  misc_feature (69)..(162): Pfam Name: K-box; Pfam Description: K-box re.g.ion
  misc_feature (9)..(59): Pfam Name: SRF-TF; Pfam Description: SRF-type transcription factor (DNA-binding and dimerisation domain)
MGRRKIEIKRIENKSSRQVTFSKRRNGLIDKARQLSILCESSVAVVVVSASGKLYDSSSGDEIEALFKPEKPQCFELDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 5261 - DNA, 1614 bp, Arabidopsis thaliana
  misc_feature (1)..(1614): useful for making plants with modulated biomass and growth as described in USSN 12/911,698
  misc_feature (1)..(1614): Ceres CDNA ID no. 36533702
  misc_feature (1)..(1614): Also Known As Ceres ME LINE ME04012
aaacactttcatacatgagcaatattcaagaaatggagatgatattgatggtctctttgtgcttaacgaccctcattacccttttcttgcttaaacaattcctcaaacgaaccgccaacaaagtgaacttaccaccatctccatggaggcttccgttgattggtaacctccaccagcttagcctccaccctcaccgttccctccattccctaagccttcggtacggaccactcatgctccttcattttggccgtgtccccatactcgtagtatcctccggggaagcagctcaagaggtattgaaaacacacgatcttaagtttgccaaccgcccgagatcaaaagccgttcatgggcttatgaatggggggcgtgatgtggtgtttggtccctatggagaatattggagacagatgaagagtgtatgcattctcaatctgctcacgaacaaaatggttgcgtcctttgagaagataagagaagaagagctaaatgaaatgatcaagaagctggagaaagcaagttcttcttcttcgtcagaaaatctgagcgaactctttgttactctcccaagcgatgttacgagtagaattgccttgggaagaaaacatagtgaggacgaaaccgcaagggatctcaagaagcgagtgaggcagatcatggagcttttaggcgagttcccaatcggggactatgtcccggctttggcatggatagacaggatcaacggtttcaatgctagaataaaggaagtaagtcaagggtttagcgatcttatggacaaagtggtgcaagaacatttagaggcaggtaatcataaagaggactttgtcgatatactgttatcaatcgaaagcgagaagagtattggattccaagctcaaagagacgacatcaaattcatgatattggatatgtttataggagggacgtcaacaagttcaactctactagaatggataatgacggagctgatcagaaatccaaatgttatgaagaaactccaagacgagattcggtcaaccattaggccacatggttcatacataaaagaaaaagatgttgaaaatatgaaatacttgaaagccgtgattaaagaggtgtttcgggtgcatcctcctcttccactaatacttcccagattattaagtgaagatgtcaaagtaaagggatataacatagccgcaggaaccgaggtgataatcaatgcttgggccatccaaagagaccccgcgatatggggaccggatgcagaagaattcaaaccagaaagacatttagattcaactttggattatcatggaaaagatttaaacttcatcccattcggatcagggagaaggatttgtccagggataaatcttgctttgggtttggtagaggtgacagtggccaaccttgtaggccgatttgactggagggccgaggctggaccaaatggggatcaacctgatctaactgaagcttttggtctcgatgtttgccgaaagttccctctcattgcatttccatcttccgttatttaaaatgtttctctttttatcttttaccttgttatgcacttaattaataagaagcattgtaagatataataaaatccttcattttagaaaa

SEQ ID NO: 5262 - protein, 503 aa, Arabidopsis thaliana
  misc_feature (1)..(503): useful for making plants with modulated biomass and growth as described in USSN 12/911,698
  misc_feature (1)..(503): Ceres CDNA ID no. 36533702
  misc_feature (1)..(503): Also Known As Ceres ME LINE ME04012
  misc_feature (40)..(498): Pfam Name: p450; Pfam Description: Cytochrome P450
  misc_feature (1)..(503): Phenotype: Dark Green Useful for increasing chlorophyll and photosynthetic capacity
MSNIQEMEMILMVSLCLTTLITLFLLKQFLKRTANKVNLPPSPWRLPLIGNLHQLSLHPHRSLHSLSLRYGPLMLLHFGRVPILVVSSGEAAQEVLKTHDLKFANRPRSKAVHGLMNGGRDVVFGPYGEYWRQMKSVCILNLLTNKMVASFEKIREEELNEMIKKLEKASSSSSSENLSELFVTLPSDVTSRIALGRKHSEDETARDLKKRVRQIMELLGEFPIGDYVPALAWIDRINGFNARIKEVSQGFSDLMDKVVQEHLEAGNHKEDFVDILLSIESEKSIGFQAQRDDIKFMILDMFIGGTSTSSTLLEWIMTELIRNPNVMKKLQDEIRSTIRPHGSYIKEKDVENMKYLKAVIKEVFRVHPPLPLILPRLLSEDVKVKGYNIAAGTEVIINAWAIQRDPAIWGPDAEEFKPERHLDSTLDYHGKDLNFIPFGSGRRICPGINLALGLVEVTVANLVGRFDWRAEAGPNGDQPDLTEAFGLDVCRKFPLIAFPSSVI

SEQ ID NO: 5263 - protein, 503 aa, Arabidopsis thaliana
  misc_feature (1)..(503): useful for making plants with modulated biomass and growth as described in USSN 12/911,698
  misc_feature (1)..(503): Public GI no. 42569483
  misc_feature (1)..(503): Functional Homolog of  Ceres CDNA ID no. 36533702  with e-value of 1.49E-242 and percent identity of 89.4
MSNIQEMEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPMILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 5264 - protein, 497 aa, Arabidopsis thaliana
  misc_feature (1)..(497): useful for making plants with modulated biomass and growth as described in USSN 12/911,698
  misc_feature (1)..(497): Public GI no. 2880054
  misc_feature (1)..(497): Functional Homolog of  Ceres CDNA ID no. 36533702  with e-value of 1.69E-239 and percent identity of 89.3
MEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPMILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 5265 - protein, 497 aa, Arabidopsis thaliana
  misc_feature (1)..(497): useful for making plants with modulated biomass and growth as described in USSN 12/911,698
  misc_feature (1)..(497): Public GI no. 22329490
  misc_feature (1)..(497): Functional Homolog of  Ceres CDNA ID no. 36533702  with e-value of 1.49E-233 and percent identity of 86.6
MEMTLMVSLCLTTLLTLLLLKKFLKRTAKKVNLPPSPWRIPVIGNLHQLSLHPHRSLHSLSLRYGPLMLLHFGRVPILVVSSSEAAHEILKTHDLKFANRPKSKAVHGLMNGGRDVVFGPYGEYWRQMKSVCILNLLTNKMVASFEKVREEEVNAMMEKLEKASCSSSAENLSELFVTLTSDVTSRVSLGKKYWEDETAGGLKKRVRQIMELLREFPIGDYVPALAWIDRINGFNSKIVEVSRAYSDLMEKVVQEHLEAGEHKADFVNILLSIEKEKNNGFKVQRNDIKFMILDMFIGGISTSSTLLEWIMTELIRNPECMKKLQNEIRSTIRPHGSYIKEKEVENMRYLKAVIKEVFRVHPPLPLILPRLLTEDVKVKGYDIAAGTEVLINAWSIHRDPAIWGPDAEEFKPERHLDSTLDYHGQDLKYIPFGSGRRICPGINLAMGLVEVTLANLVGRFDWSVDPGPNGDQPDLAEDFGLDVCRKNPLIAFPSSVA

SEQ ID NO: 5266 - protein, 477 aa, Arabidopsis thaliana
  misc_feature (1)..(477): useful for making plants with modulated biomass and growth as described in USSN 12/911,698
  misc_feature (1)..(477): Public GI no. 4835796
  misc_feature (1)..(477): Functional Homolog of  Ceres CDNA ID no. 36533702  with e-value of 9.10E-218 and percent identity of 86.1
MEMTLMVSLCLTTLLTLLLLKKFLKRTAKKVNLPPSPWRIPVIGNLHQLSLHPHRSLHSLSLSEAAHEILKTHDLKFANRPKSKAVHGLMNGGRDVVFGPYGEYWRQMKSVCILNLLTNKMVASFEKVREEEVNAMMEKLEKASCSSSAENLSELFVTLTSDVTSRVSLGKKYWEDETAGGLKKRVRQIMELLREFPIGDYVPALAWIDRINGFNSKIVEVSRAYSDLMEKVVQEHLEAGEHKADFVNILLSIEKEKNNGFKVQRNDIKFMILDMFIGGISTSSTLLEWIMTELIRNPECMKKLQNEIRSTIRPHGSYIKEKEVENMRYLKAVIKEVFRVHPPLPLILPRLLTEDVKVKGYDIAAGTEVLINAWSIHRDPAIWGPDAEEFKPERHLDSTLDYHGQDLKYIPFGSGRRICPGINLAMGLVEVTLANLVGRFDWSVDPGPNGDQPDLAEDFGLDVCRKNPLIAFPSSVA

SEQ ID NO: 5267 - protein, 509 aa, Nepeta racemosa
  misc_feature (1)..(509): useful for making plants with modulated biomass and growth as described in USSN 12/911,698
  misc_feature (1)..(509): Public GI no. 3582021
  misc_feature (1)..(509): Functional Homolog of  Ceres CDNA ID no. 36533702  with e-value of 3.60E-113 and percent identity of 46.3
MVSLSYFLIALLCTLPFLLFLNKWRRSYSGKTPPPSPPKLPVIGNLHQLGLYPHRYLQSLSRRYGPLMQLHFGSVPVLVASSPEAAREIMKNQDIVFSNRPKMSIANRLFFNNRDVAFTQYGEYWRQIRSICVLQLLSNKRVQSFRRVREEETSIMVEKIMQLGSSSSTPVNLSELLLSLTNDVVCRVTLGKKYGGGNGSEEVDKLKEMLTEIQNLMGISPVWEFIPWLNWTRRFDGVDQRVDRIVKAFDGFLESVIQEHKERDGDKDGDGDGALDFVDILLQFQRENKNRSPVEDDTVKALILDMFVAGTDTTATALEWAVAELIKNPRAMKRLQNEVREVAGSKAEIEEEDLEKMPYLKASIKESLRLHVPVVLLVPRESTRDTNVLGYDIASGTRVLINAWAIARDPSVWENPEEFLPERFLDSSIDYKGLHFELLPFGAGRRGCPGATFAVAIDELALAKLVHKFDFGLPNGARMEELDMSETSGMTVHKKSPLLLLPIPHHAAP

SEQ ID NO: 5268 - protein, 494 aa, Ammi majus
  misc_feature (1)..(494): useful for making plants with modulated biomass and growth as described in USSN 12/911,698
  misc_feature (1)..(494): Public GI no. 46947673
  misc_feature (1)..(494): Functional Homolog of  Ceres CDNA ID no. 36533702  with e-value of 1.10E-102 and percent identity of 46.0
MKMLEQNPQYLYFFSLFLVTIFLYKWLTLKKTPLKNLPPSPPQYPIIGNLHQIGPDPQASLRDLAQKYGPLMFLKFGTVPVLVVSSADAAREALKTHDLVFADRPYSSVANKIFYNGKDMVFARYTEYWRQVKSICVTQLLSNKRVNSFHYVREEEVDLLVQNLENSHSKVANLTELLIEVTGNVVCRVSVGSGDKVDSYKILILEIMDMLGYSRSIEDFFPLLGWVDWLTGLRGKVAEAAKGVDTFLEGVLKEHLSTTGSKYNDFVSILLEIQEADAGSSMDNECIKSLIWDMLGAGTETISTALEWTLAALIKNPDAMFKLQNEVREIGKGKSKISEADLVKMNYLQAVMKESMRLYFTAPLLVPREARQDIKFMGYDISSGTQVLINAWAIARDPLLWDKPEEFRPERFLNSPIDYKGFHYEFLPFGAGRRGCPGIQFAMCINELVVANLVHKFNFELPDGKRLEDLDMTAASGITLRKKSPLLVVARPHV

SEQ ID NO: 5269 - protein, 471 aa, Persea americana
  misc_feature (1)..(471): useful for making plants with modulated biomass and growth as described in USSN 12/911,698
  misc_feature (1)..(471): Public GI no. 117188
  misc_feature (1)..(471): Functional Homolog of  Ceres CDNA ID no. 36533702  with e-value of 3.09E-107 and percent identity of 45.9
MAILVSLLFLAIALTFFLLKLNEKREKKPNLPPSPPNLPIIGNLHQLGNLPHRSLRSLANELGPLILLHLGHIPTLIVSTAEIAEEILKTHDLIFASRPSTTAARRIFYDCTDVAFSPYGEYWRQVRKICVLELLSIKRVNSYRSIREEEVGLMMERISQSCSTGEAVNLSELLLLLSSGTITRVAFGKKYEGEEERKNKFADLATELTTLMGAFFVGDYFPSFAWVDVLTGMDARLKRNHGELDAFVDHVIDDHLLSRKANGSDGVEQKDLVDVLLHLQKDSSLGVHLNRNNLKAVILDMFSGGTDTTAVTLEWAMAELIKHPDVMEKAQQEVRRVVGKKAKVEEEDLHQLHYLKLIIKETLRLHPVAPLLVPRESTRDVVIRGYHIPAKTRVFINAWAIGRDPKSWENAEEFLPERFVNNSVDFKGQDFQLIPFGAGRRGCPGIAFGISSVEISLANLLYWFNWELPGI

SEQ ID NO: 5270 - protein, 529 aa, Oryza sativa subsp. japonica
  misc_feature (1)..(529): useful for making plants with modulated biomass and growth as described in USSN 12/911,698
  misc_feature (1)..(529): Public GI no. 34904242
  misc_feature (1)..(529): Functional Homolog of  Ceres CDNA ID no. 36533702  with e-value of 2.70E-99 and percent identity of 45.5
MAVSLVVVVVVVIAIVVPLLYLVLLPAWKPARRDDGDGGMRRRLPPSPPWGLPLLGHLHLLGALPHRALRSLAAAHGPVLLLRLGRVPVVVVSSAAAAEEVMRTRDLEFASRPRVAMAERLLYGGRDVAFAPYGEYWRQTRRICVVHLLSARRVLSFRRVREEEAAALVARVRAAGGAVDLVEHLTAYSNTVVSRAVFGDESARGLYGDVDRGRVLRKLFDDFVELLGQEPMGELLPWLGWVDALNGMEVKVQRTFEALDGILEKVIDDHRRRRREVGRQMDDGGGGDHRDFVDVLLDVNETDMDAGVQLGTIEIKAIILDMFAAGTDTTTTVIEWAMAELITHPDAMRNAQDEIKAVVGITSHITEDHLDRLPYLKAVLKETLRLHPPLPLLVPHEPSSDTKILGYSIPACTRIVINAWTIGRDQATWGEHAEEFIPERFLESGLDYIGQDFVLVPFGAGRRGCPGVGFAVQAMEMALASLLYNFDWETRVVDRRSEFGTSSLDMSEMNGLSVRLKYGLPLIAISRFP

SEQ ID NO: 5271 - protein, 482 aa, Triticum aestivum
  misc_feature (1)..(482): useful for making plants with modulated biomass and growth as described in USSN 12/911,698
  misc_feature (1)..(482): Ceres CLONE ID no. 921721
  misc_feature (1)..(482): Functional Homolog of  Ceres CDNA ID no. 36533702  with e-value of 6.10E-102 and percent identity of 45.2
MEGRRHLPPSPRGLPLLGHLHLLGSLPHRALRSLAAAHGPVLLLRLGRVPAVVVSSPAAAEEVMRARDLAFASRPRSAMADRLLYGRDVAFAPYGEYWRQARRVCVVHLLSPLRILSFRGVREEEAAALVERVRGAAAGGAAVDLCELLVAYANTVVSRAAFGDDSARGLYEEGNKERELRKVFNDFQELLGTAPLGELLPWLGWLDAVRGMEGKIRRTFKALDGVLEKVIGDHRRRRQAGQQTGDDGGDHRDFVDVLLDVSDTDDEAGMRLSTTEIKAIILDMFAAGTDTTSTAMEWAMAEVITHPDSMRKLQDELRAAVGGSGHVITEDHIDKLHYLKAVVKETLRLHPPIPLLVPREPQDDAEILGHHVPAGTRVVINAWAVGRDPAAWERAEEFVPERFLDGAVDYKGQDFQLIPFGAGRRGCPGVGFAAATVEMALASLMYHFDWEPAGASLDMREVNGLAVHLKSGLPLVAKLRFR

SEQ ID NO: 5272 - protein, 515 aa, Triticum aestivum
  misc_feature (1)..(515): useful for making plants with modulated biomass and growth as described in USSN 12/911,698
  misc_feature (1)..(515): Ceres CLONE ID no. 703961
  misc_feature (1)..(515): Functional Homolog of  Ceres CDNA ID no. 36533702  with e-value of 6.10E-102 and percent identity of 45.2
MAVSPLALVLLLLAFAVSLLYILRRPAPLRSGSDGGRRHLPPSPRGLPLLGHLHLLGSLPHRALRSLAAAHGPVLLLRLGRVPAVVVSSPAAAEEVMRARDLAFASRPRSAMADRLLYGRDVAFAPYGEYWRQARRVCVVHLLSPLRILSFRGVREEEAAALVERVRGAAAGGAAVDLCELLVAYANTVVSRAAFGDDSARGLYEEGNKERELRKVFNDFQELLGTAPLGELLPWLGWLDAVRGMEGKIRRTFKALDGVLEKVIGDHRRRRQAGQQTGDDGGDHRDFVDVLLDVSDTDDEAGMRLSTTEIKAIILDMFAAGTDTTSTAMEWAMAEVITHPDSMRKLQDELRAAVGGSGHVITEDHIDKLHYLKAVVKETLRLHPPIPLLVPREPQDDAEILGHHVPAGTRVVINAWAVGRDPAAWERAEEFVPERFLDGAVDYKGQDFQLIPFGAGRRGCPGVGFAAATVEMALASLMYHFDWEPAGASLDMREVNGLAVHLKSGLPLVAKLRFR

SEQ ID NO: 5273 - protein, 502 aa, Persea americana
  misc_feature (1)..(502): useful for making plants with modulated biomass and growth as described in USSN 12/911,698
  misc_feature (1)..(502): Public GI no. 25282608
  misc_feature (1)..(502): Functional Homolog of  Ceres CDNA ID no. 36533702  with e-value of 3.69E-111 and percent identity of 45.2
MAILVSLLFLAIALTFFLLKLNEKREKKPNLPPSPPNLPIIGNLHQLGNLPHRSLRSLANELGPLILLHLGHIPTLIVSTAEIAEEILKTHDLIFASRPSTTAARRIFYDCTDVAFSPYGEYWRQVRKICVLELLSIKRVNSYRSIREEEVGLMMERISQSCSTGEAVNLSELLLLLSSGTITRVAFGKKYEGEEERKNKFADLATELTTLMGAFFVGDYFPSFAWVDVLTGMDARLKRNHGELDAFVDHVIDDHLLSRKANGSDGVEQKDLVDVLLHLQKDSSLGVHLNRNNLKAVILDMFSGGTDTTAVTLEWAMAELIKHPDVMEKAQQEVRRVVGKKAKVEEEDLHQLHYLKLIIKETLRLHPVAPLLVPRESTRDVVIRGYHIPAKTRVFINAWAIGRDPKSWENAEEFLPERFVNNSVDFKGQDFQLIPFGAGRRGCPGIAFGISSVEISLANLLYWFNWELPGDLTKEDLDMSEAVGITVHMKFPLQLVAKRHLS

SEQ ID NO: 5274 - DNA, 538 bp, Arabidopsis thaliana
  misc_feature (1)..(538): useful for making plants with modified plant phenotypes as described in USSN 12/139,269
  misc_feature (1)..(538): Ceres CLONE ID no. 40252
  misc_feature (1)..(538): Also known as  Ceres CDNA ID no. 23446918
aaccattcaaattgattgagtttgttatacaaaaaaaaaaaagaagaagaagccagaagtctgagagttttataagtaacgaaaatgaaatcgaccgtcatgatgattttcctcattatctacctcctcctcgtcgtgccttgcttcgctaaaggatcggagcaaacggattcagaggtgtacgagatcgattacaggggaccagagactcataactctagacctccaccggaaactatgcacggcaagccaccgtacatccaccacaatacctccgccgctgggctcggtgctcatgtaggaggaaagaactagagagagagcgagaccttttccaaggagaagactcagaagttgaagaggaagattacgagagttgtgatatatatatgagtaattattaatgatgttgatacacatttatactttaattatttatcatatgaagatgatcatcgatgtgtgatcagtacagttagtgtgaataacacactactctcctgatgtcatgtccggtcttttatttatttcatttttc

SEQ ID NO: 5275 - protein, 76 aa, Arabidopsis thaliana
  misc_feature (1)..(76): useful for making plants with modified plant phenotypes as described in USSN 12/139,269
  misc_feature (1)..(76): Utility: Useful for accelerating crop development and harvest
  misc_feature (1)..(76): Utility: Useful for delaying flowering time
  misc_feature (1)..(76): Utility: Useful for increasing chlorophyll and photosynthetic capacity
  misc_feature (1)..(76): Utility: Useful for making ornamental plants with modified flowers
  misc_feature (1)..(76): Utility: Useful for making ornamental plants with modified leaves
  misc_feature (1)..(76): Utility: Useful for making plants sterile and for genetic confinement
  misc_feature (1)..(76): Utility: Useful for making plants with increased biomass and foliage
  misc_feature (1)..(76): Utility: Useful for making smaller plants
  misc_feature (1)..(76): Utility: Useful for making taller plants
  misc_feature (1)..(76): Utility: Useful for modifying plant structure, ie increased branching
MKSTVMMIFLIIYLLLVVPCFAKGSEQTDSEVYEIDYRGPETHNSRPPPETMHGKPPYIHHNTSAAGLGAHVGGKN

SEQ ID NO: 5276 - protein, 67 aa, Brassica napus
  misc_feature (1)..(67): useful for making plants with modified plant phenotypes as described in USSN 12/139,269
  misc_feature (1)..(67): Ceres CLONE ID no. 1094231
  misc_feature (1)..(67): Utility: Useful for accelerating crop development and harvest
  misc_feature (1)..(67): Utility: Useful for delaying flowering time
  misc_feature (1)..(67): Utility: Useful for increasing chlorophyll and photosynthetic capacity
  misc_feature (1)..(67): Utility: Useful for making ornamental plants with modified flowers
  misc_feature (1)..(67): Utility: Useful for making ornamental plants with modified leaves
  misc_feature (1)..(67): Utility: Useful for making plants sterile and for genetic confinement
  misc_feature (1)..(67): Utility: Useful for making plants with increased biomass and foliage
  misc_feature (1)..(67): Utility: Useful for making smaller plants
  misc_feature (1)..(67): Utility: Useful for making taller plants
  misc_feature (1)..(67): Utility: Useful for modifying plant structure, ie increased branching
MYLLFVVPCFVAIASENTDSEVYEIDYRGPETHNSRPSPETSHGKPPFIHHKTSAAGSASAYVGGQN

SEQ ID NO: 5277 - protein, 75 aa, Brassica napus
  misc_feature (1)..(75): useful for making plants with modified plant phenotypes as described in USSN 12/139,269
  misc_feature (1)..(75): Ceres CLONE ID no. 967599
  misc_feature (1)..(75): Utility: Useful for accelerating crop development and harvest
  misc_feature (1)..(75): Utility: Useful for delaying flowering time
  misc_feature (1)..(75): Utility: Useful for increasing chlorophyll and photosynthetic capacity
  misc_feature (1)..(75): Utility: Useful for making ornamental plants with modified flowers
  misc_feature (1)..(75): Utility: Useful for making ornamental plants with modified leaves
  misc_feature (1)..(75): Utility: Useful for making plants sterile and for genetic confinement
  misc_feature (1)..(75): Utility: Useful for making plants with increased biomass and foliage
  misc_feature (1)..(75): Utility: Useful for making smaller plants
  misc_feature (1)..(75): Utility: Useful for making taller plants
  misc_feature (1)..(75): Utility: Useful for modifying plant structure, ie increased branching
MKSIVVILLTYLLLVAPCFAIGSENTNSDVYEIDYRGPETHNSRPPPETLHGKRPFIHHKTSAAGSAGAHVGGQN

SEQ ID NO: 5278 - DNA, 1057 bp, Arabidopsis thaliana
  misc_feature (1)..(1057): useful for making plants with modified plant phenotypes as described in USSN 12/139,269
  misc_feature (1)..(1057): Ceres CLONE ID no. 32791
  misc_feature (1)..(1057): Also known as  Ceres CDNA ID no. 23556617
gtttttgggattctcaaaaaactcaaaataaactttcctcattttttttttctttcttttgttttgttttctttataaaggagaaagaaagagaaagagagtttccgaaagctgaattgagttgggtgaagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttctagttgaaatcgaaaacgcgcagaaaagggagattgagcttgacaatgagaacatctatctaagaactaaggtagcagaagtggagaggtatcaacaacaccatcatcaaatggttagtggttcagagattaacgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgtatcatagtatctattctatggtatctcc

SEQ ID NO: 5279 - protein, 230 aa, Arabidopsis thaliana
  misc_feature (1)..(230): useful for making plants with modified plant phenotypes as described in USSN 12/139,269
  misc_feature (9)..(59): Pfam Name: SRF-TF; Pfam Description: SRF-type transcription factor (DNA-binding and dimerisation domain)
  misc_feature (74)..(173): Pfam Name: K-box; Pfam Description: K-box region
  misc_feature (1)..(230): Utility: Useful for accelerating flowering time
  misc_feature (1)..(230): Utility: Useful for delaying flowering time
  misc_feature (1)..(230): Utility: Useful for increasing seed/fruit yield or modifying fruit content
  misc_feature (1)..(230): Utility: Useful for making ornamental plants with modified flowers
  misc_feature (1)..(230): Utility: Useful for making ornamental plants with modified leaves
  misc_feature (1)..(230): Utility: Useful for making plants sterile and for genetic confinement
  misc_feature (1)..(230): Utility: Useful for making plants with altered leaf shape eg curled leaves
  misc_feature (1)..(230): Utility: Useful for making plants with increased biomass and foliage
  misc_feature (1)..(230): Utility: Useful for making smaller plants
  misc_feature (1)..(230): Utility: Useful for making stronger plants
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 5280 - protein, 223 aa, Arabidopsis thaliana
  misc_feature (1)..(223): useful for making plants with modified plant phenotypes as described in USSN 12/139,269
  misc_feature (1)..(223): Public GI no. 23194453
  misc_feature (1)..(223): Utility: Useful for accelerating flowering time
  misc_feature (1)..(223): Utility: Useful for delaying flowering time
  misc_feature (1)..(223): Utility: Useful for increasing seed/fruit yield or modifying fruit content
  misc_feature (1)..(223): Utility: Useful for making ornamental plants with modified flowers
  misc_feature (1)..(223): Utility: Useful for making ornamental plants with modified leaves
  misc_feature (1)..(223): Utility: Useful for making plants sterile and for genetic confinement
  misc_feature (1)..(223): Utility: Useful for making plants with altered leaf shape eg curled leaves
  misc_feature (1)..(223): Utility: Useful for making plants with increased biomass and foliage
  misc_feature (1)..(223): Utility: Useful for making smaller plants
  misc_feature (1)..(223): Utility: Useful for making stronger plants
MGRGKIEIKRIENTTNRQVTFCKRRNGLLKKAYELSVLCDAEVALIVFSSRGRLYEYSNNNIRSTIDRYKKACSDTSNTNTVTEINAQYYQQESAKLRQQIQMLQNSNRHLMGDSLSSLTVKELKQVENRLERGITRIRSKKHEMLLAEIEFLQKREIELENESVCLRTKIAEIERLQQANMVTGPELNAIQALASRNFFSPNVIEHPSAYSHPSDKKILHLG

SEQ ID NO: 5281 - protein, 223 aa, Arabidopsis thaliana
  misc_feature (1)..(223): useful for making plants with modified plant phenotypes as described in USSN 12/139,269
  misc_feature (1)..(223): Public GI no. 60100358
  misc_feature (1)..(223): Utility: Useful for accelerating flowering time
  misc_feature (1)..(223): Utility: Useful for delaying flowering time
  misc_feature (1)..(223): Utility: Useful for increasing seed/fruit yield or modifying fruit content
  misc_feature (1)..(223): Utility: Useful for making ornamental plants with modified flowers
  misc_feature (1)..(223): Utility: Useful for making ornamental plants with modified leaves
  misc_feature (1)..(223): Utility: Useful for making plants sterile and for genetic confinement
  misc_feature (1)..(223): Utility: Useful for making plants with altered leaf shape eg curled leaves
  misc_feature (1)..(223): Utility: Useful for making plants with increased biomass and foliage
  misc_feature (1)..(223): Utility: Useful for making smaller plants
  misc_feature (1)..(223): Utility: Useful for making stronger plants
MGRGKIEIKRIENTTNRQVTFCKRRNGLLKKAYELSVLCDAEVALIVFSSRGRLYEYSNNNIRSTIERYKKACSDHSSTSTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGQELNAIQALASRNFFNPPMIEDGTSYPQQPDKKILHLG

SEQ ID NO: 5282 - protein, 207 aa, Arabidopsis thaliana
  misc_feature (1)..(207): useful for making plants with modified plant phenotypes as described in USSN 12/139,269
  misc_feature (1)..(207): Public GI no. 3646326
  misc_feature (1)..(207): Utility: Useful for accelerating flowering time
  misc_feature (1)..(207): Utility: Useful for delaying flowering time
  misc_feature (1)..(207): Utility: Useful for increasing seed/fruit yield or modifying fruit content
  misc_feature (1)..(207): Utility: Useful for making ornamental plants with modified flowers
  misc_feature (1)..(207): Utility: Useful for making ornamental plants with modified leaves
  misc_feature (1)..(207): Utility: Useful for making plants sterile and for genetic confinement
  misc_feature (1)..(207): Utility: Useful for making plants with altered leaf shape eg curled leaves
  misc_feature (1)..(207): Utility: Useful for making plants with increased biomass and foliage
  misc_feature (1)..(207): Utility: Useful for making smaller plants
  misc_feature (1)..(207): Utility: Useful for making stronger plants
MGRGKIEIKRIENTTNRQVTFCKRRNGLLKKAYELSILCDAEVALIVFSTRGRLYEYSNNNSIRNTIERYKKACSDSTGSSSVTEINAQNSNRHLMGDALSTLTVKELKQVENRLERGITRIRSKKHELLLAEIEYFQKKEIELENENVYFRTKVSEVERLQQANMVSGSEMNAIQALASRHFFSQNMIEGGEATFPQQDKKNLHLG

SEQ ID NO: 5283 - protein, 222 aa, Glycine max
  misc_feature (1)..(222): useful for making plants with modified plant phenotypes as described in USSN 12/139,269
  misc_feature (1)..(222): Ceres CLONE ID no. 1044034
  misc_feature (1)..(222): Utility: Useful for accelerating flowering time
  misc_feature (1)..(222): Utility: Useful for delaying flowering time
  misc_feature (1)..(222): Utility: Useful for increasing seed/fruit yield or modifying fruit content
  misc_feature (1)..(222): Utility: Useful for making ornamental plants with modified flowers
  misc_feature (1)..(222): Utility: Useful for making ornamental plants with modified leaves
  misc_feature (1)..(222): Utility: Useful for making plants sterile and for genetic confinement
  misc_feature (1)..(222): Utility: Useful for making plants with altered leaf shape eg curled leaves
  misc_feature (1)..(222): Utility: Useful for making plants with increased biomass and foliage
  misc_feature (1)..(222): Utility: Useful for making smaller plants
  misc_feature (1)..(222): Utility: Useful for making stronger plants
MGRGKIEIKRIENTTNRQVTFCKRRNGLLKKAYELSVLCDAEVALIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 5284 - protein, 225 aa, Glycine max
  misc_feature (1)..(225): useful for making plants with modified plant phenotypes as described in USSN 12/139,269
  misc_feature (1)..(225): Public GI no. 4103342
  misc_feature (1)..(225): Utility: Useful for accelerating flowering time
  misc_feature (1)..(225): Utility: Useful for delaying flowering time
  misc_feature (1)..(225): Utility: Useful for increasing seed/fruit yield or modifying fruit content
  misc_feature (1)..(225): Utility: Useful for making ornamental plants with modified flowers
  misc_feature (1)..(225): Utility: Useful for making ornamental plants with modified leaves
  misc_feature (1)..(225): Utility: Useful for making plants sterile and for genetic confinement
  misc_feature (1)..(225): Utility: Useful for making plants with altered leaf shape eg curled leaves
  misc_feature (1)..(225): Utility: Useful for making plants with increased biomass and foliage
  misc_feature (1)..(225): Utility: Useful for making smaller plants
  misc_feature (1)..(225): Utility: Useful for making stronger plants
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 5285 - protein, 229 aa, Glycine max
  misc_feature (1)..(229): useful for making plants with modified plant phenotypes as described in USSN 12/139,269
  misc_feature (1)..(229): Public GI no. 2997615
  misc_feature (1)..(229): Utility: Useful for accelerating flowering time
  misc_feature (1)..(229): Utility: Useful for delaying flowering time
  misc_feature (1)..(229): Utility: Useful for increasing seed/fruit yield or modifying fruit content
  misc_feature (1)..(229): Utility: Useful for making ornamental plants with modified flowers
  misc_feature (1)..(229): Utility: Useful for making ornamental plants with modified leaves
  misc_feature (1)..(229): Utility: Useful for making plants sterile and for genetic confinement
  misc_feature (1)..(229): Utility: Useful for making plants with altered leaf shape eg curled leaves
  misc_feature (1)..(229): Utility: Useful for making plants with increased biomass and foliage
  misc_feature (1)..(229): Utility: Useful for making smaller plants
  misc_feature (1)..(229): Utility: Useful for making stronger plants
MGRGKIEIKRIENTTNRQVTFCKRRNGLLKKAYELSVLCDAEVALIVFSSRGRLYEYSNNSIKTTIERYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERVQQANMVSGQELNAIQALANSRNFFSPNIMEPAGPVSYSHQDKKMLHLG

SEQ ID NO: 5286 - protein, 223 aa, Glycine max
  misc_feature (1)..(223): useful for making plants with modified plant phenotypes as described in USSN 12/139,269
  misc_feature (1)..(223): Public GI no. 20385590
  misc_feature (1)..(223): Utility: Useful for accelerating flowering time
  misc_feature (1)..(223): Utility: Useful for delaying flowering time
  misc_feature (1)..(223): Utility: Useful for increasing seed/fruit yield or modifying fruit content
  misc_feature (1)..(223): Utility: Useful for making ornamental plants with modified flowers
  misc_feature (1)..(223): Utility: Useful for making ornamental plants with modified leaves
  misc_feature (1)..(223): Utility: Useful for making plants sterile and for genetic confinement
  misc_feature (1)..(223): Utility: Useful for making plants with altered leaf shape eg curled leaves
  misc_feature (1)..(223): Utility: Useful for making plants with increased biomass and foliage
  misc_feature (1)..(223): Utility: Useful for making smaller plants
  misc_feature (1)..(223): Utility: Useful for making stronger plants
MGRGKIEIKRIENTTNRQVTFCKRRNGLLKKAYELSVLCDAEVALIVFSSRGRVYEYSNNNIKSTIDRYKKASSDSTNGGFTMEINAQYYQQESAKLRQQIQMLQNSNRHLMGDSLASLTVKELKQLENRLERGITRIRSKKHELLLAEIEYLQKREIELENESVYLRTKIAEVERLQQANMVSTHEFNAIQALVSRNFFQPNMIEGGSTGYPLHDKKVLHLG

SEQ ID NO: 5287 - protein, 227 aa, Glycine max
  misc_feature (1)..(227): useful for making plants with modified plant phenotypes as described in USSN 12/139,269
  misc_feature (1)..(227): Public GI no. 27763670
  misc_feature (1)..(227): Utility: Useful for accelerating flowering time
  misc_feature (1)..(227): Utility: Useful for delaying flowering time
  misc_feature (1)..(227): Utility: Useful for increasing seed/fruit yield or modifying fruit content
  misc_feature (1)..(227): Utility: Useful for making ornamental plants with modified flowers
  misc_feature (1)..(227): Utility: Useful for making ornamental plants with modified leaves
  misc_feature (1)..(227): Utility: Useful for making plants sterile and for genetic confinement
  misc_feature (1)..(227): Utility: Useful for making plants with altered leaf shape eg curled leaves
  misc_feature (1)..(227): Utility: Useful for making plants with increased biomass and foliage
  misc_feature (1)..(227): Utility: Useful for making smaller plants
  misc_feature (1)..(227): Utility: Useful for making stronger plants
MGRGKIEIKRIENTTNRQVTFCKRRNGLLKKAYELSVLCDAEVALIVFSSRGRLYEYSNNSIKTTIGRYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERLQQANMVSGQELNAIQALASRNFFTPNMMEGGAVTFSHQDKKMLHLG

SEQ ID NO: 5288 - protein, 238 aa, Glycine max
  misc_feature (1)..(238): useful for making plants with modified plant phenotypes as described in USSN 12/139,269
  misc_feature (1)..(238): Public GI no. 2981133
  misc_feature (1)..(238): Utility: Useful for accelerating flowering time
  misc_feature (1)..(238): Utility: Useful for delaying flowering time
  misc_feature (1)..(238): Utility: Useful for increasing seed/fruit yield or modifying fruit content
  misc_feature (1)..(238): Utility: Useful for making ornamental plants with modified flowers
  misc_feature (1)..(238): Utility: Useful for making ornamental plants with modified leaves
  misc_feature (1)..(238): Utility: Useful for making plants sterile and for genetic confinement
  misc_feature (1)..(238): Utility: Useful for making plants with altered leaf shape eg curled leaves
  misc_feature (1)..(238): Utility: Useful for making plants with increased biomass and foliage
  misc_feature (1)..(238): Utility: Useful for making smaller plants
  misc_feature (1)..(238): Utility: Useful for making stronger plants
MAYQNEPQESSPLRKLGRGKVEIKRIENTTNRQVTFCKRRNGLLKKAYELSVLCDAEVALIVFSSRGRLYEYSNNSVKSTIERYKKACADSSNNGSVSEANAQFYQQEAAKLRSQIGNLQNSNRNMLGESLSALSVKELKSLEIKLEKGIGRIRSKKNELLFAEIEYMQKREIDLHNNNQLLRAKIAENERKRQHMNLMPGGVNFEIMQSQPFDSRNYSQVNGLPPANHYPHEDQLFS

SEQ ID NO: 5289 - protein, 226 aa, Glycine max
  misc_feature (1)..(226): useful for making plants with modified plant phenotypes as described in USSN 12/139,269
  misc_feature (1)..(226): Public GI no. 42794566
  misc_feature (1)..(226): Utility: Useful for accelerating flowering time
  misc_feature (1)..(226): Utility: Useful for delaying flowering time
  misc_feature (1)..(226): Utility: Useful for increasing seed/fruit yield or modifying fruit content
  misc_feature (1)..(226): Utility: Useful for making ornamental plants with modified flowers
  misc_feature (1)..(226): Utility: Useful for making ornamental plants with modified leaves
  misc_feature (1)..(226): Utility: Useful for making plants sterile and for genetic confinement
  misc_feature (1)..(226): Utility: Useful for making plants with altered leaf shape eg curled leaves
  misc_feature (1)..(226): Utility: Useful for making plants with increased biomass and foliage
  misc_feature (1)..(226): Utility: Useful for making smaller plants
  misc_feature (1)..(226): Utility: Useful for making stronger plants
MGRGKIEIKRIENTTNRQVTFCKRRNGLLKKAYELSVLCEAEVALIVFSSRGRLYEYANNSVRTTIDRYKKASDSSNPASVSETNSQYYQQEATKLRQQIGILQNANRHLMGESLSSMSVKELKQLETRLEKGISRIRSKKNELLFAEIEYMQKREVELQNDNIFLRGKIVENERAQQNMNMLPGGGGYEVMSQHPPYDSRNYLPVNLLEHNQHFSHQEPTALQLG

SEQ ID NO: 5290 - protein, 212 aa, Glycine max
  misc_feature (1)..(212): useful for making plants with modified plant phenotypes as described in USSN 12/139,269
  misc_feature (1)..(212): Public GI no. 42794562
  misc_feature (1)..(212): Utility: Useful for accelerating flowering time
  misc_feature (1)..(212): Utility: Useful for delaying flowering time
  misc_feature (1)..(212): Utility: Useful for increasing seed/fruit yield or modifying fruit content
  misc_feature (1)..(212): Utility: Useful for making ornamental plants with modified flowers
  misc_feature (1)..(212): Utility: Useful for making ornamental plants with modified leaves
  misc_feature (1)..(212): Utility: Useful for making plants sterile and for genetic confinement
  misc_feature (1)..(212): Utility: Useful for making plants with altered leaf shape eg curled leaves
  misc_feature (1)..(212): Utility: Useful for making plants with increased biomass and foliage
  misc_feature (1)..(212): Utility: Useful for making smaller plants
  misc_feature (1)..(212): Utility: Useful for making stronger plants
IENTTNRQVTFCKRRNGLLKKAYELSVLCDAEVALIVFSTRGRLYEYANNSIKSTIERYKKASADSSSTTSIAEANTQYYQQEASKLRQQIHILQNSNRHLMGDALSSLSIKELKQLENRLERGITRIRSKKHELLFAEIEYMQKREADLQNDNMYLRAKIAENENAQQANMLPGPEFDTLPTFDSRNYFQANILEAAPQYSHQDQTALHLG

SEQ ID NO: 5291 - protein, 228 aa, Glycine max
  misc_feature (1)..(228): useful for making plants with modified plant phenotypes as described in USSN 12/139,269
  misc_feature (1)..(228): Public GI no. 1568513
  misc_feature (1)..(228): Utility: Useful for accelerating flowering time
  misc_feature (1)..(228): Utility: Useful for delaying flowering time
  misc_feature (1)..(228): Utility: Useful for increasing seed/fruit yield or modifying fruit content
  misc_feature (1)..(228): Utility: Useful for making ornamental plants with modified flowers
  misc_feature (1)..(228): Utility: Useful for making ornamental plants with modified leaves
  misc_feature (1)..(228): Utility: Useful for making plants sterile and for genetic confinement
  misc_feature (1)..(228): Utility: Useful for making plants with altered leaf shape eg curled leaves
  misc_feature (1)..(228): Utility: Useful for making plants with increased biomass and foliage
  misc_feature (1)..(228): Utility: Useful for making smaller plants
  misc_feature (1)..(228): Utility: Useful for making stronger plants
MGRGKIEIKRIENNTNRQVTFCKRRNGLLKKAYELSVLCDAEIALIVFSTRGRVYEYANNNIKGTIERYKKATAETSNACTTQELNAQFYQQESKKLRQQIQLLQNTNRHLVGEGLSALNVRELKQLENRLERGITRIRSKKHEMILAETENLQKREIQLEQENTFLRSKIAENERLQELSMMPATGQEYNAFQQYFARNMLQLNMMEGGVPSYDPLPAHDKKSLQLE

SEQ ID NO: 5292 - protein, 242 aa, Glycine max
  misc_feature (1)..(242): useful for making plants with modified plant phenotypes as described in USSN 12/139,269
  misc_feature (1)..(242): Public GI no. 861081
  misc_feature (1)..(242): Utility: Useful for accelerating flowering time
  misc_feature (1)..(242): Utility: Useful for delaying flowering time
  misc_feature (1)..(242): Utility: Useful for increasing seed/fruit yield or modifying fruit content
  misc_feature (1)..(242): Utility: Useful for making ornamental plants with modified flowers
  misc_feature (1)..(242): Utility: Useful for making ornamental plants with modified leaves
  misc_feature (1)..(242): Utility: Useful for making plants sterile and for genetic confinement
  misc_feature (1)..(242): Utility: Useful for making plants with altered leaf shape eg curled leaves
  misc_feature (1)..(242): Utility: Useful for making plants with increased biomass and foliage
  misc_feature (1)..(242): Utility: Useful for making smaller plants
  misc_feature (1)..(242): Utility: Useful for making stronger plants
MSFYDDQSGNLSPQRKLGRGKIEIKRIENTTNRQVTFCKRRNGLLKKAYELSVLCDAEVALIVFSTRGRLYEYANNSVKGTIERYKKACTDSPNTSSVSEANAQFYQQEASKLRQEISSIQKNNRNMMGESLGSLTVRDLKGLETKLEKGISRIRSKKNELLFAEIEYMQKKEIDLHNNNQYLRAKIAENERAQQHMNLMPGSSDYELAPPQSFDGRNYIQLNGLQPNNHYSRQDQTALQLV

SEQ ID NO: 5293 - protein, 225 aa, Glycine max
  misc_feature (1)..(225): useful for making plants with modified plant phenotypes as described in USSN 12/139,269
  misc_feature (1)..(225): Public GI no. 1067169
  misc_feature (1)..(225): Utility: Useful for accelerating flowering time
  misc_feature (1)..(225): Utility: Useful for delaying flowering time
  misc_feature (1)..(225): Utility: Useful for increasing seed/fruit yield or modifying fruit content
  misc_feature (1)..(225): Utility: Useful for making ornamental plants with modified flowers
  misc_feature (1)..(225): Utility: Useful for making ornamental plants with modified leaves
  misc_feature (1)..(225): Utility: Useful for making plants sterile and for genetic confinement
  misc_feature (1)..(225): Utility: Useful for making plants with altered leaf shape eg curled leaves
  misc_feature (1)..(225): Utility: Useful for making plants with increased biomass and foliage
  misc_feature (1)..(225): Utility: Useful for making smaller plants
  misc_feature (1)..(225): Utility: Useful for making stronger plants
MGRGKIEIKRIENNTNRQVTFCKRRNGLLKKAYELSVLCEAEIALIVFSTRGRVYEYSNNNIRAIIDRYKKATVETSNAFTTQELNAQFYQQESKKLRQQIQLIQNSNRHLVGEGLSSLNVRELKQLENRLERGIARIRSKKHEMILAESEDLQKREIQLEQENAFLRSKIAENERLQELSMMPAGGQEYNAIQQYLARNMLQLNMMEGVPSYPLPSDKKSLDLE

SEQ ID NO: 5294 - protein, 223 aa, Glycine max
  misc_feature (1)..(223): useful for making plants with modified plant phenotypes as described in USSN 12/139,269
  misc_feature (1)..(223): Public GI no. 24967137
  misc_feature (1)..(223): Utility: Useful for accelerating flowering time
  misc_feature (1)..(223): Utility: Useful for delaying flowering time
  misc_feature (1)..(223): Utility: Useful for increasing seed/fruit yield or modifying fruit content
  misc_feature (1)..(223): Utility: Useful for making ornamental plants with modified flowers
  misc_feature (1)..(223): Utility: Useful for making ornamental plants with modified leaves
  misc_feature (1)..(223): Utility: Useful for making plants sterile and for genetic confinement
  misc_feature (1)..(223): Utility: Useful for making plants with altered leaf shape eg curled leaves
  misc_feature (1)..(223): Utility: Useful for making plants with increased biomass and foliage
  misc_feature (1)..(223): Utility: Useful for making smaller plants
  misc_feature (1)..(223): Utility: Useful for making stronger plants
MGRGKIEIKRIENNTNRQVTFCKRRNGLLKKAYELSVLCDAEIALIVFSTRGRLYEYSNNNVKATIERYKKATAETSSAYTTQELNAQFYQQESKKLRQQIQMMQNTNRHLVGEGLSSLNVRELKQLENRLERGITRIRSKKHEAILAETEDLHKREIQLEQENAFLRSKIAENERLQELSMMPSGGEEYNAFQQYLARNMLQLNMMETALPSYDPLSPDHKR

SEQ ID NO: 5295 - DNA, 721 bp, Arabidopsis thaliana
  misc_feature (1)..(721): useful for making plants with modified plant phenotypes as described in USSN 12/139,269
  misc_feature (1)..(721): Ceres CLONE ID no. 39319
  misc_feature (1)..(721): Also known as  Ceres CDNA ID no. 23372895
atttttctcaccgtcgagagaacaaaacacaagttgcagactttatccaaatttagggttttctttttcttcttactcagattatcatcagatcttcgaaaccccaaatttacaaatcagatcagcttcccggttagtactaccctcaaatcaactaagtttcatgtctgaacttgactcccaggttcccactgcctttgatccgtttgctgatgcgaatgttgaggactcaggtgccggaacaaaagaatacgttcatatccgtgtccagcagcgaaatggtaggaaaagcttgacaaccgtccagggcctgaagaaagagtacagctataccaagatacttaaggacctcaaaaaagagttttgctgcaacggcactgtggttcaggattcagaactcggacaggttatacagcttcaaggtgaccaacgtaagaacgtctccacattccttgtccaggctggtttggtgaagaaggataacatcaagatccatggtttctaagctatctagtggatcatattattaataaaaccatatctttctcttctttcatctcttgttgcgaattttgggtttgattcatcaaaatcgtcttcttcctagtgttcttcttctgtttggtattcgaattttaatggcttatgtccaccatacttcttcccctgttttcgtgttactctgtttcacatcttacttatcttataatatcagtttgtt

SEQ ID NO: 5296 - protein, 113 aa, Arabidopsis thaliana
  misc_feature (1)..(113): useful for making plants with modified plant phenotypes as described in USSN 12/139,269
  misc_feature (25)..(106): Pfam Name: SUI1; Pfam Description: Translation initiation factor SUI1
  misc_feature (25)..(106): Pfam Name: SUI1; Pfam Description: Translation initiation factor SUI1
  misc_feature (1)..(113): Utility: Useful for accelerating flowering time
  misc_feature (1)..(113): Utility: Useful for making smaller plants
MSELDSQVPTAFDPFADANVEDSGAGTKEYVHIRVQQRNGRKSLTTVQGLKKEYSYTKILKDLKKEFCCNGTVVQDSELGQVIQLQGDQRKNVSTFLVQAGLVKKDNIKIHGF

SEQ ID NO: 5297 - protein, 113 aa, Glycine max
  misc_feature (1)..(113): useful for making plants with modified plant phenotypes as described in USSN 12/139,269
  misc_feature (1)..(113): Ceres CLONE ID no. 1016818
  misc_feature (1)..(113): Utility: Useful for accelerating flowering time
  misc_feature (1)..(113): Utility: Useful for making smaller plants
  misc_feature (112)..(112): Xaa is any aa, unknown or other
MSELDSQVPTAFDPFADANAEDSGAGTKEYVHIRVQQRNGRKSLTTVQGLKKEYSYTKILKDLKKEFCCNGTVVQDSELGQVIQLQGDQRKNVSTFLVQAGLVKKDNIKIHXF

SEQ ID NO: 5298 - protein, 94 aa, Brassica napus
  misc_feature (1)..(94): useful for making plants with modified plant phenotypes as described in USSN 12/139,269
  misc_feature (1)..(94): Ceres CLONE ID no. 947724
  misc_feature (1)..(94): Utility: Useful for accelerating flowering time
  misc_feature (1)..(94): Utility: Useful for making smaller plants
MSKLDSQVPTAFDPFADANAEDSGAGTKEYVHIRVQQRNGRKSLTTVQGLKKEYSYTKILKDLKKEFCCNGTVVQDSELGQVIQLQGDQRKNVS

SEQ ID NO: 5299 - protein, 113 aa, Brassica napus
  misc_feature (1)..(113): useful for making plants with modified plant phenotypes as described in USSN 12/139,269
  misc_feature (1)..(113): Public GI no. 6165638
  misc_feature (1)..(113): Utility: Useful for accelerating flowering time
  misc_feature (1)..(113): Utility: Useful for making smaller plants
MSELDSQVPTAFDPFADANAEDSGAGTKEYVHIRVQQRNGRKSLTTVQGLKKEYSYTKILKDLKKEFCCNGTVVQDSELGQVIQLQGDQRKNVSTFLVQAGLVKKDDIQIHGF

SEQ ID NO: 5300 - protein, 75 aa, Brassica napus
  misc_feature (1)..(75): useful for making plants with modified plant phenotypes as described in USSN 12/139,269
  misc_feature (1)..(75): Ceres CLONE ID no. 1088967
  misc_feature (1)..(75): Utility: Useful for accelerating flowering time
  misc_feature (1)..(75): Utility: Useful for making smaller plants
MSELDSQVPTAFDPFADANAEDSGAGTKEYVHIRVQQRNGRKSLTTVQGLKKEYSYSKILKDLKKEFCCNGTVVQ

SEQ ID NO: 5301 - protein, 121 aa, Arabidopsis thaliana
  misc_feature (1)..(121): useful for making plants with modified plant phenotypes as described in USSN 12/139,269
  misc_feature (1)..(121): Ceres CLONE ID no. 27929
  misc_feature (1)..(121): Utility: Useful for accelerating flowering time
  misc_feature (1)..(121): Utility: Useful for making smaller plants
MSELDSQVPTAFDPFADANVEDSGAGTKEYVHIRVQQRNGRKSLTTVQGLKKEYSYTKILKECCVGPKKRVVTLRQSLLTQTSRLALEEIKLKFIDTASIFGHGRFQTSLEKMRFYNRVTK

SEQ ID NO: 5302 - protein, 113 aa, Arabidopsis thaliana
  misc_feature (1)..(113): useful for making plants with modified plant phenotypes as described in USSN 12/139,269
  misc_feature (1)..(113): Public GI no. 4585973
  misc_feature (1)..(113): Utility: Useful for accelerating flowering time
  misc_feature (1)..(113): Utility: Useful for making smaller plants
MSDLEVQVPTAFDPFADANAEDSGAGTKEYVHIRVQQRNGRKSLTTVQGLKKEYSYSKILKDLKKEFCCNGTVVQDSELGQVIQLQGDQRKNVSTFLVQAGLVKKDNIKIHGF

SEQ ID NO: 5303 - protein, 75 aa, Zea mays
  misc_feature (1)..(75): useful for making plants with modified plant phenotypes as described in USSN 12/139,269
  misc_feature (1)..(75): Ceres CLONE ID no. 1555168
  misc_feature (1)..(75): Utility: Useful for accelerating flowering time
  misc_feature (1)..(75): Utility: Useful for making smaller plants
MRIQQRNGRKSLTTVQGLKKEFSYSKILKDLKKEFCCNGTVVQDPELGQAARYRSFSSRVIRGRTSRISSSRPAL

SEQ ID NO: 5304 - protein, 115 aa, Triticum aestivum
  misc_feature (1)..(115): useful for making plants with modified plant phenotypes as described in USSN 12/139,269
  misc_feature (1)..(115): Ceres CLONE ID no. 774974
  misc_feature (1)..(115): Utility: Useful for accelerating flowering time
  misc_feature (1)..(115): Utility: Useful for making smaller plants
MSDLDVQVPTAFDPFAEANAEDSGAGAGSKNYVHVRVQQRNGRKSLTTVQGLKKDYSYNKILKDLKKEFCCNGTVVQDPELGQVIQLQGDQRKNVATFLVQAGLAKKESIKIHGF

SEQ ID NO: 5305 - protein, 117 aa, Zea mays
  misc_feature (1)..(117): useful for making plants with modified plant phenotypes as described in USSN 12/139,269
  misc_feature (1)..(117): Ceres CLONE ID no. 705811
  misc_feature (1)..(117): Utility: Useful for accelerating flowering time
  misc_feature (1)..(117): Utility: Useful for making smaller plants
MSDLDVQLPSAFDPFAEANAEDSGAGPGTKDYVHVRIQQRNGRKSLTTVQGLKNEFSYNKILKDLKKEFCCNGTVVQDPELGQVRYENNAFQACKNGICRLVDILICLSAAGHSAPR

SEQ ID NO: 5306 - protein, 153 aa, Glycine max
  misc_feature (1)..(153): useful for making plants with modified plant phenotypes as described in USSN 12/139,269
  misc_feature (1)..(153): Ceres CLONE ID no. 516874
  misc_feature (1)..(153): Utility: Useful for accelerating flowering time
  misc_feature (1)..(153): Utility: Useful for making smaller plants
  misc_feature (142)..(142): Xaa is any aa, unknown or other
MVDLEIQVPTPFDPFAEARESDAPGAKEYVHIRIQQRNGKKSLTTVQGLKKEFSYEKILKDLKKEFCCNGTVVQDKELGKIIQLQGDQHVMHGATITSAFEGTWHMVLVSPFPSAPPLLLTWLWKRQQQWRVEHGQLNAKPXVAVLDRGSIAE

SEQ ID NO: 5307 - protein, 112 aa, Brassica napus
  misc_feature (1)..(112): useful for making plants with modified plant phenotypes as described in USSN 12/139,269
  misc_feature (1)..(112): Ceres CLONE ID no. 1097485
  misc_feature (1)..(112): Utility: Useful for accelerating flowering time
  misc_feature (1)..(112): Utility: Useful for making smaller plants
MVELDIQVPLAYDPFAEAQDTDAPGTKEYIHVRIQQRNGKKSLTTVQGLKKEYSYEKILKDLKKDFCCNGNVVQDKVLGKIIQLQGDQRKKVSHFLVQTGIAKKDQIKIHGF

SEQ ID NO: 5308 - protein, 85 aa, Brassica napus
  misc_feature (1)..(85): useful for making plants with modified plant phenotypes as described in USSN 12/139,269
  misc_feature (1)..(85): Ceres CLONE ID no. 1126017
  misc_feature (1)..(85): Utility: Useful for accelerating flowering time
  misc_feature (1)..(85): Utility: Useful for making smaller plants
  misc_feature (76)..(76): Xaa is any aa, unknown or other
MVELDIQVPLAYDPFAEAQDTDAPGTKEYIHVRIQQRNGKKSLTTVQGLKKEYSYEKILKDLKKDFCCNGNVVQDXVLGKIIQLQ

SEQ ID NO: 5309 - protein, 86 aa, Brassica napus
  misc_feature (1)..(86): useful for making plants with modified plant phenotypes as described in USSN 12/139,269
  misc_feature (1)..(86): Ceres CLONE ID no. 1084637
  misc_feature (1)..(86): Utility: Useful for accelerating flowering time
  misc_feature (1)..(86): Utility: Useful for making smaller plants
  misc_feature (24)..(24): Xaa is any aa, unknown or other
  misc_feature (46)..(46): Xaa is any aa, unknown or other
  misc_feature (79)..(79): Xaa is any aa, unknown or other
  misc_feature (81)..(81): Xaa is any aa, unknown or other
  misc_feature (85)..(85): Xaa is any aa, unknown or other
MVELDIQVPSAFDPFAEAQESDAXGTKEYIHVRIQQRNGKKSLTTXQGLKKAYSYEKILKDLKKDFCCNGNVVQDKELXQXHSAXG

SEQ ID NO: 5310 - DNA, 1490 bp, Arabidopsis thaliana
  misc_feature (1)..(1490): useful for making plants with modified plant phenotypes as described in USSN 12/139,269
  misc_feature (1)..(1490): Ceres CLONE ID no. 41337
  misc_feature (1)..(1490): Also known as  Ceres CDNA ID no. 23388491
  misc_feature (384)..(384): s is g or c
aaaaaagattcgatttttgactgcaaaaaagagaatttctaaaagcaaatcggagagcttcggcgatggcgttatcacgactttcttcacgatccaacactttcctaaagccggcgattaccgccttgccctcctccatccgccgtcatgtttccacagactcatcaccgatcacaatcgaaaccgccgtccctttcacatcgcatctatgtgaatcaccgtcacgctccgtcgagacttcatcggaggagatcttagcctttttccgtgacatggctcggatgaggaggatggagatcgcagcagattctctttacaaggcgaagctgatccgtgggttctgtcatttgtacgatggtcaagaggctttagcggtgggaatgsaagcggcgattaccaaaaaagatgcgattatcacatcgtatcgtgatcactgtactttcattggtcgtggtgggaagcttgttgatgctttctctgagcttatggggagaaaaactggttgttctcatggtaaaggaggatctatgcatttctataagaaagatgcttccttttatggtggacatgggattgttggtgctcagattccattgggatgtggtttggcttttgctcagaagtataataaggatgaggctgtgacttttgctttgtatggtgatggtgctgcgaatcagggacagttgtttgaggccttgaacatttcggctttgtgggatttgcctgcgattcttgtttgcgagaataaccattatggaatgggaacggctacatggaggtcggctaagtctccggcttatttcaagcgtggagattatgttcctggcttgaaggtggatggtatggatgcactggctgtgaaacaggcgtgcaagtttgccaaggagcatgctctcaagaatggtcctattatccttgagatggacacttacagataccacggtcactctatgtctgacccaggaagcacttaccgtactcgtgatgaaatctctggcgtgagacaggtgcgtgatccaattgaaagggtgcgaaagttgctcttaactcatgacatagctaccgaaaaagagcttaaggacatggagaaagagataaggaaagaagtagatgacgccgtagctcaggccaaggagagcccgataccagatgcatctgagctattcacaaacatgtacgtgaaagactgcggagttgagtcgtttggagcagacagaaaagaactcaaagtaacacttccatagaatcttgcttcccaaggagatgattggttcaataaatcagaaggcaaggctacacaaatctttttaacttgctaccaaaaatatttctggttttttttttttgtattttcatttcaagtgtaaagccattgcttcaccagtttgccaactttgtttcccacacttaaatttgacaccaagcaaaagaagcttcggatatcactctgtgagataaagttagagaaataagcagagagagtagtt

SEQ ID NO: 5311 - protein, 393 aa, Arabidopsis thaliana
  misc_feature (1)..(393): useful for making plants with modified plant phenotypes as described in USSN 12/139,269
  misc_feature (68)..(365): Pfam Name: E1_dh; Pfam Description: Dehydrogenase E1 component
  misc_feature (1)..(393): Utility: Useful for accelerating flowering time
  misc_feature (1)..(393): Utility: Useful for increasing chlorophyll and photosynthetic capacity
  misc_feature (1)..(393): Utility: Useful for making ornamental plants with modified flowers
  misc_feature (1)..(393): Utility: Useful for making smaller plants
MALSRLSSRSNTFLKPAITALPSSIRRHVSTDSSPITIETAVPFTSHLCESPSRSVETSSEEILAFFRDMARMRRMEIAADSLYKAKLIRGFCHLYDGQEALAVGMEAAITKKDAIITSYRDHCTFIGRGGKLVDAFSELMGRKTGCSHGKGGSMHFYKKDASFYGGHGIVGAQIPLGCGLAFAQKYNKDEAVTFALYGDGAANQGQLFEALNISALWDLPAILVCENNHYGMGTATWRSAKSPAYFKRGDYVPGLKVDGMDALAVKQACKFAKEHALKNGPIILEMDTYRYHGHSMSDPGSTYRTRDEISGVRQVRDPIERVRKLLLTHDIATEKELKDMEKEIRKEVDDAVAQAKESPIPDASELFTNMYVKDCGVESFGADRKELKVTLP

SEQ ID NO: 5312 - protein, 321 aa, Arabidopsis thaliana
  misc_feature (1)..(321): useful for making plants with modified plant phenotypes as described in USSN 12/139,269
  misc_feature (1)..(321): Ceres CLONE ID no. 37506
  misc_feature (1)..(321): Utility: Useful for accelerating flowering time
  misc_feature (1)..(321): Utility: Useful for increasing chlorophyll and photosynthetic capacity
  misc_feature (1)..(321): Utility: Useful for making ornamental plants with modified flowers
  misc_feature (1)..(321): Utility: Useful for making smaller plants
MRRMEIAADSLYKAKLIRGFCHLYDGQEAVAIGMEAAITKKDAIITAYRDHCIFLGRGGSLHEVFSELMGRQAGCSKGKGGSMHFYKKESSFYGGHGIVGAQVPLGCGIAFAQKYNKEEAVTFALYGDGAANQGQLFEALNISALWDLPAILVCENNHYGMGTAEWRAAKSPSYYKRGDYVPGLKVDGMDAFAVKQACKFAKQHALEKGPIILEMDTYRYHGHSMSDPGSTYRTRDEISGVRQERDPIERIKKLVLSHDLATEKELKDMEKEIRKEVDDAIAKAKDCPMPEPSELFTNVYVKGFGTESFGPDRKEVKASLP

SEQ ID NO: 5313 - protein, 370 aa, Zea mays
  misc_feature (1)..(370): useful for making plants with modified plant phenotypes as described in USSN 12/139,269
  misc_feature (1)..(370): Ceres CLONE ID no. 293206
  misc_feature (1)..(370): Utility: Useful for accelerating flowering time
  misc_feature (1)..(370): Utility: Useful for increasing chlorophyll and photosynthetic capacity
  misc_feature (1)..(370): Utility: Useful for making ornamental plants with modified flowers
  misc_feature (1)..(370): Utility: Useful for making smaller plants
MAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREGGCSRGKGGSMHFYKKDANFYGGHGIVGAQVPLGCGLAFAQKYKKEETATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLAHDLATAAELKDMEKEIRKQVDDAIAKAKESSMPDTSELFTNVYKKGFNVESFGPDRKELRATLP

SEQ ID NO: 5314 - protein, 370 aa, Zea mays
  misc_feature (1)..(370): useful for making plants with modified plant phenotypes as described in USSN 12/139,269
  misc_feature (1)..(370): Ceres CLONE ID no. 297432
  misc_feature (1)..(370): Utility: Useful for accelerating flowering time
  misc_feature (1)..(370): Utility: Useful for increasing chlorophyll and photosynthetic capacity
  misc_feature (1)..(370): Utility: Useful for making ornamental plants with modified flowers
  misc_feature (1)..(370): Utility: Useful for making smaller plants
MAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREGGCSRGKGGSMHFYKKDANFYGGHGIVGAQVPLGCGLAFAQKYKEEETATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLAHDLATAAELKDMEKEIRKQVDDAIAKAKESSMPDTSELFTNVYKKGFNVESFGPDRKELRATLP

SEQ ID NO: 5315 - protein, 370 aa, Zea mays
  misc_feature (1)..(370): useful for making plants with modified plant phenotypes as described in USSN 12/139,269
  misc_feature (1)..(370): Ceres CLONE ID no. 246807
  misc_feature (1)..(370): Utility: Useful for accelerating flowering time
  misc_feature (1)..(370): Utility: Useful for increasing chlorophyll and photosynthetic capacity
  misc_feature (1)..(370): Utility: Useful for making ornamental plants with modified flowers
  misc_feature (1)..(370): Utility: Useful for making smaller plants
MAARPVSDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREGGCSRGKGGSMHFYKKDANFYGGHGIVGAQVPLGCGLAFAQKYKKEETATFALYGDCAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLAHDLATAAELKDMEKEIRKQVDDAIAKAKESSMPDTSELFTNVYKKGFNVESFGPDRKELRATLP

SEQ ID NO: 5316 - protein, 370 aa, Zea mays
  misc_feature (1)..(370): useful for making plants with modified plant phenotypes as described in USSN 12/139,269
  misc_feature (1)..(370): Ceres CLONE ID no. 246886
  misc_feature (1)..(370): Utility: Useful for accelerating flowering time
  misc_feature (1)..(370): Utility: Useful for increasing chlorophyll and photosynthetic capacity
  misc_feature (1)..(370): Utility: Useful for making ornamental plants with modified flowers
  misc_feature (1)..(370): Utility: Useful for making smaller plants
MAARPISDSTAAFTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREAGCSRGKGGSMHFYKKDANFYGGHGIVGAQVPLGCGLAFAQKYKKEDTATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLTHDLANAAELKNMEKEIRKQVDDAIAKAKESSMPDTSELFTNVYKKGFGVESFGPDRKEMRASLP

SEQ ID NO: 5317 - protein, 324 aa, Zea mays
  misc_feature (1)..(324): useful for making plants with modified plant phenotypes as described in USSN 12/139,269
  misc_feature (1)..(324): Ceres CLONE ID no. 994766
  misc_feature (1)..(324): Utility: Useful for accelerating flowering time
  misc_feature (1)..(324): Utility: Useful for increasing chlorophyll and photosynthetic capacity
  misc_feature (1)..(324): Utility: Useful for making ornamental plants with modified flowers
  misc_feature (1)..(324): Utility: Useful for making smaller plants
MSLMRRFEIAADSLYKAKLIRGFCHLYDGQEAVAVGMEAAATRADAIITAYRDHCAYLARGGDPVAAFAELMGRRDGCSRGKGGSMHFYKRDANFFGGHGIVGAQVPLGCGIAFAQRYRKEGTVTFDLYGDGAANQGQLFEALNMAALWKLPVILVCENNHYGMGTAEWRASKSPAYYKRGDYVPGLKVDGMDVLAVKQACKFAKEHALENGPIILEMDTYRYHGHSMSDPGSTYRTRDEIAGIRQERDPIERVRKLMLVHEFATAQELKDMEKEIRKQVDAAIAKAKECPLPDPSELFTNVYVNDCGLESFGVDRKEVRTVLP

SEQ ID NO: 5318 - protein, 334 aa, Glycine max
  misc_feature (1)..(334): useful for making plants with modified plant phenotypes as described in USSN 12/139,269
  misc_feature (1)..(334): Ceres CLONE ID no. 554851
  misc_feature (1)..(334): Utility: Useful for accelerating flowering time
  misc_feature (1)..(334): Utility: Useful for increasing chlorophyll and photosynthetic capacity
  misc_feature (1)..(334): Utility: Useful for making ornamental plants with modified flowers
  misc_feature (1)..(334): Utility: Useful for making smaller plants
MHYFKEMSMMRRMEIALDNLYKAREIRGFCHLYDGQESIAMGIEAAVTFEDCLITAYRDHCQAYCRGDSVHQIIAELMGKRTGSTNGKGGSMHFYRKKTNFYGGHGIVGAQCALGTGLGFALKYQKKPNVAITMYGDGAANQGQLFEAANMAALWKLPVLYVCENNHYAMGTSTARGAASTEYYKRLMPVPGIRFAANNVFAVREVTKFAKEYSIKEGPICLEMQTYRYHGHSMSDPGVTYRKKQEIDEYRKTKDCITLVKQLIIDNKVATEEDLKEVERAIKKEVDETVEKVREDAYPDAKDLLKDVYIEDPKEPQHIRGVEYDKSFAPRGLP

SEQ ID NO: 5319 - DNA, 468 bp, Arabidopsis thaliana
  misc_feature (1)..(468): useful for making plants with modified plant phenotypes as described in USSN 12/139,269
  misc_feature (1)..(468): Ceres CLONE ID no. 314
  misc_feature (1)..(468): Also known as  Ceres CDNA ID no. 23388929
aatcgaatacctgagaaaatggcgaagcctttgggaacaaccggcgaatttttccggcgaagagatgaatggaggaagcatccgatgctttcgaatcaaatgagacacgctcttcccggacttggaatcggcgtcgccgccttctgcgtttatctcgtcggtgagcagatctacaacaaagctttggctccttccaaatcatctcaccaccaccaggaacagactgctccgtctcactgaagagcatctttcttcttcgatgagatgcttgaaacagtggcacaaggctgaactcagggtctcttcttggttactagttttcgttggattgtcttaataatcatgtttaaatcgaatacaaagaatttgatatctatatttgaactgtaaagcttgttggctcaaaggttctctttgtatcgcacaagttaagatttctgcatattcttatcttatttgatacttgct

SEQ ID NO: 5320 - protein, 73 aa, Arabidopsis thaliana
  misc_feature (1)..(73): useful for making plants with modified plant phenotypes as described in USSN 12/139,269
  misc_feature (1)..(73): Utility: Useful for delaying flowering time
  misc_feature (1)..(73): Utility: Useful for making larger plants
  misc_feature (1)..(73): Utility: Useful for making ornamental plants with modified flowers
  misc_feature (1)..(73): Utility: Useful for making plants sterile and for genetic confinement
  misc_feature (1)..(73): Utility: Useful for making stronger plants
MAKPLGTTGEFFRRRDEWRKHPMLSNQMRHALPGLGIGVAAFCVYLVGEQIYNKALAPSKSSHHHQEQTAPSH

SEQ ID NO: 5321 - protein, 72 aa, Arabidopsis thaliana
  misc_feature (1)..(72): useful for making plants with modified plant phenotypes as described in USSN 12/139,269
  misc_feature (1)..(72): Ceres CLONE ID no. 13483
  misc_feature (1)..(72): Utility: Useful for delaying flowering time
  misc_feature (1)..(72): Utility: Useful for making larger plants
  misc_feature (1)..(72): Utility: Useful for making ornamental plants with modified flowers
  misc_feature (1)..(72): Utility: Useful for making plants sterile and for genetic confinement
  misc_feature (1)..(72): Utility: Useful for making stronger plants
MAKPLGTTGEFFRRRDEWRKHPMLSNQMRHALPGLGIGVGAFCVYLVGEQIYSKLMAPSSQSSHQKQPAPSH

SEQ ID NO: 5322 - protein, 72 aa, Arabidopsis thaliana
  misc_feature (1)..(72): useful for making plants with modified plant phenotypes as described in USSN 12/139,269
  misc_feature (1)..(72): Public GI no. 21387015
  misc_feature (1)..(72): Utility: Useful for delaying flowering time
  misc_feature (1)..(72): Utility: Useful for making larger plants
  misc_feature (1)..(72): Utility: Useful for making ornamental plants with modified flowers
  misc_feature (1)..(72): Utility: Useful for making plants sterile and for genetic confinement
  misc_feature (1)..(72): Utility: Useful for making stronger plants
MAKPLGTTGEFFRRRDEWRKHPMLSNQMRHALPGIGIGVGAFCVYLVGEQIYSKLMAPSSQSSHQKQPAPSH

SEQ ID NO: 5323 - protein, 73 aa, Glycine max
  misc_feature (1)..(73): useful for making plants with modified plant phenotypes as described in USSN 12/139,269
  misc_feature (1)..(73): Ceres CLONE ID no. 481859
  misc_feature (1)..(73): Utility: Useful for delaying flowering time
  misc_feature (1)..(73): Utility: Useful for making larger plants
  misc_feature (1)..(73): Utility: Useful for making ornamental plants with modified flowers
  misc_feature (1)..(73): Utility: Useful for making plants sterile and for genetic confinement
  misc_feature (1)..(73): Utility: Useful for making stronger plants
MGSGSGKHTGEFFRRRDAWRKHPMLTNQLRHATPGLGIAVVAFGIYLVGEQVYNRLYAPDPHSISHVKAGDHH

SEQ ID NO: 5324 - protein, 67 aa, Zea mays
  misc_feature (1)..(67): useful for making plants with modified plant phenotypes as described in USSN 12/139,269
  misc_feature (1)..(67): Ceres CLONE ID no. 366717
  misc_feature (1)..(67): Utility: Useful for delaying flowering time
  misc_feature (1)..(67): Utility: Useful for making larger plants
  misc_feature (1)..(67): Utility: Useful for making ornamental plants with modified flowers
  misc_feature (1)..(67): Utility: Useful for making plants sterile and for genetic confinement
  misc_feature (1)..(67): Utility: Useful for making stronger plants
MASGGKGLNATGEFFRRRDEWRRHPMAGNQLRHATPGLGIAIVAFGIYLVGEAAYNRLYRPSGDNHH

SEQ ID NO: 5325 - protein, 66 aa, Zea mays
  misc_feature (1)..(66): useful for making plants with modified plant phenotypes as described in USSN 12/139,269
  misc_feature (1)..(66): Public GI no. 50909577
  misc_feature (1)..(66): Utility: Useful for delaying flowering time
  misc_feature (1)..(66): Utility: Useful for making larger plants
  misc_feature (1)..(66): Utility: Useful for making ornamental plants with modified flowers
  misc_feature (1)..(66): Utility: Useful for making plants sterile and for genetic confinement
  misc_feature (1)..(66): Utility: Useful for making stronger plants
MAGKGLNATGEFFRRRDDWRRHPMVGNQLRHATPGLGIAIVAFGIYLVGEAAYNRLYRPSGDHHHH

SEQ ID NO: 5326 - protein, 67 aa, Triticum aestivum
  misc_feature (1)..(67): useful for making plants with modified plant phenotypes as described in USSN 12/139,269
  misc_feature (1)..(67): Ceres CLONE ID no. 696513
  misc_feature (1)..(67): Utility: Useful for delaying flowering time
  misc_feature (1)..(67): Utility: Useful for making larger plants
  misc_feature (1)..(67): Utility: Useful for making ornamental plants with modified flowers
  misc_feature (1)..(67): Utility: Useful for making plants sterile and for genetic confinement
  misc_feature (1)..(67): Utility: Useful for making stronger plants
MATGGKGLNATGEFFRRRDEWRRHPMVGNQLRHATPGLGIAIVAFGIYLVGEAAYNRLYRRAGDNHH

SEQ ID NO: 5327 - DNA, 1081 bp, Arabidopsis thaliana
  misc_feature (1)..(1081): useful for making plants with modified plant phenotypes as described in USSN 12/139,269
  misc_feature (1)..(1081): Ceres CLONE ID no. 332
  misc_feature (1)..(1081): Also known as  Ceres CDNA ID no. 23367869
attatcatatcctcttcttccttcttcactatcaatcttcttctccactacaacacaaatggagaaatcatcctcaatgaaacaatggaagaagggtcctgctcggggtaaaggcggtccacaaaacgctctttgtcagtaccgtggagtcaggcaaaggacttggggcaaatgggtggctgagatcagagagcccaagaagagggcaagactttggcttggctctttcgctacagctgaagaagcagctatggcttatgatgaggctgccttgaaactctatgggcacgacgcatacctcaacttacctcatcttcagcggaatacaagaccttctctgagtaactctcagaggttcaaatgggtaccttcaaggaagtttatatctatgtttccttcatgtggtatgctaaacgtgaatgctcagcctagtgttcacataatccagcaaagactagaagaactcaagaaaactggacttttatctcaatcctattcttctagttcttcctccaccgaatcaaaaactaatactagctttcttgatgagaagaccagcaagggagaaacagacaatatgttcgaaggtggtgatcagaagaaaccagagatcgacctgaccgagtttcttcagcaactaggaatcttgaaggatgaaaatgaagcagaaccaagtgaggtagcagagtgtcattcccctccaccatggaacgagcaagaagaaactggaagtcctttcagaactgagaatttcagctgggataccctgatcgagatgccaagaagtgaaaccacaactatgcaatttgactccagcaacttcggaagctatgattttgaggatgatgtatccttcccttccatctgggactactacggaagcttagattgagtaaaagcaatttaaggtagatcaagattcagaagtacacaaatggttttggatttagtgtagcgttttggaaaagagacataggtagtgagagtgcagtcttttattatgcagcaataaagtgagtcagtgtacaaccgagttgttcgctttttttggtatattaattaagcatgttcattttttcgc

SEQ ID NO: 5328 - protein, 277 aa, Arabidopsis thaliana
  misc_feature (1)..(277): useful for making plants with modified plant phenotypes as described in USSN 12/139,269
  misc_feature (26)..(89): Pfam Name: AP2; Pfam Description: AP2 domain
  misc_feature (1)..(277): Utility: Useful for delaying flowering time
  misc_feature (1)..(277): Utility: Useful for making larger plants
  misc_feature (1)..(277): Utility: Useful for making ornamental plants with modified flowers
  misc_feature (1)..(277): Utility: Useful for making ornamental plants with modified leaves
  misc_feature (1)..(277): Utility: Useful for making plants sterile and for genetic confinement
  misc_feature (1)..(277): Utility: Useful for making plants with  enhanced chemical composition
  misc_feature (1)..(277): Utility: Useful for making plants with altered leaf shape eg curled leaves
  misc_feature (1)..(277): Utility: Useful for making plants with increased biomass
  misc_feature (1)..(277): Utility: Useful for making plants with increased biomass and foliage
  misc_feature (1)..(277): Utility: Useful for making shorter plants and plants with modified flowers
  misc_feature (1)..(277): Utility: Useful for making smaller plants
  misc_feature (1)..(277): Utility: Useful for making taller plants and plants with longer inflorescences
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 5329 - protein, 292 aa, Arabidopsis thaliana
  misc_feature (1)..(292): useful for making plants with modified plant phenotypes as described in USSN 12/139,269
  misc_feature (1)..(292): Public GI no. 55168209
  misc_feature (1)..(292): Utility: Useful for delaying flowering time
  misc_feature (1)..(292): Utility: Useful for making larger plants
  misc_feature (1)..(292): Utility: Useful for making ornamental plants with modified flowers
  misc_feature (1)..(292): Utility: Useful for making ornamental plants with modified leaves
  misc_feature (1)..(292): Utility: Useful for making plants sterile and for genetic confinement
  misc_feature (1)..(292): Utility: Useful for making plants with  enhanced chemical composition
  misc_feature (1)..(292): Utility: Useful for making plants with altered leaf shape eg curled leaves
  misc_feature (1)..(292): Utility: Useful for making plants with increased biomass
  misc_feature (1)..(292): Utility: Useful for making plants with increased biomass and foliage
  misc_feature (1)..(292): Utility: Useful for making shorter plants and plants with modified flowers
  misc_feature (1)..(292): Utility: Useful for making smaller plants
  misc_feature (1)..(292): Utility: Useful for making taller plants and plants with longer inflorescences
MDGEGGGLADLARAARAWHAPPPMEPSDDACTVAAPAAETAASSSGAGGGGGGGRTKKKAAGKGGPENGKFRYRGVRQRSWGKWVAEIREPRKRSRKWLGTFATAEDAARAYDRAALLLYGPRAHLNLTAPPPLPPPPPSSAAAAAASSSSAASSTSAPPLRPLLPRPPHLHPAFHHQPFHHHLLQPQPPPPPPPLYYAATASTSTVTTTTTAPPPQLAAAAPAAVLVAAAVSSTAETQAVVATAPEDAASAAAAAAAEEEAAWGFHGGDEEDYAAALLWSEPDPWFDLFLK

SEQ ID NO: 5330 - protein, 300 aa, Arabidopsis thaliana
  misc_feature (1)..(300): useful for making plants with modified plant phenotypes as described in USSN 12/139,269
  misc_feature (1)..(300): Public GI no. 25992100
  misc_feature (1)..(300): Utility: Useful for delaying flowering time
  misc_feature (1)..(300): Utility: Useful for making larger plants
  misc_feature (1)..(300): Utility: Useful for making ornamental plants with modified flowers
  misc_feature (1)..(300): Utility: Useful for making ornamental plants with modified leaves
  misc_feature (1)..(300): Utility: Useful for making plants sterile and for genetic confinement
  misc_feature (1)..(300): Utility: Useful for making plants with  enhanced chemical composition
  misc_feature (1)..(300): Utility: Useful for making plants with altered leaf shape eg curled leaves
  misc_feature (1)..(300): Utility: Useful for making plants with increased biomass
  misc_feature (1)..(300): Utility: Useful for making plants with increased biomass and foliage
  misc_feature (1)..(300): Utility: Useful for making shorter plants and plants with modified flowers
  misc_feature (1)..(300): Utility: Useful for making smaller plants
  misc_feature (1)..(300): Utility: Useful for making taller plants and plants with longer inflorescences
MAIMDEAANMVCVPLDYSRKRKSRSRRDRTKNVEETLAKWKEYNEKLDNEGKGKPVRKVPAKGSKKGCMRGKGGPENWRCKYRGVRQRIWGKWVAEIREPKRGSRLWLGTFGTAIEAALAYDDAARAMYGPCARLNLPNYACDSVSWATTSASASASDCTVASGFGEVCPVDGALHEADTPLSSVKDEGTAMDIVEPTSIDEDTLKSGWDCLDKLNMDEMFDVDELLAMLDSTPVFTKDYNSDGKHNNMVSDSQCQEPNAVVDPMTVDYGFDFLKPGRQEDLNFSSDDLAFIDLDSELVV

SEQ ID NO: 5331 - protein, 263 aa, Arabidopsis thaliana
  misc_feature (1)..(263): useful for making plants with modified plant phenotypes as described in USSN 12/139,269
  misc_feature (1)..(263): Public GI no. 38099059
  misc_feature (1)..(263): Utility: Useful for delaying flowering time
  misc_feature (1)..(263): Utility: Useful for making larger plants
  misc_feature (1)..(263): Utility: Useful for making ornamental plants with modified flowers
  misc_feature (1)..(263): Utility: Useful for making ornamental plants with modified leaves
  misc_feature (1)..(263): Utility: Useful for making plants sterile and for genetic confinement
  misc_feature (1)..(263): Utility: Useful for making plants with  enhanced chemical composition
  misc_feature (1)..(263): Utility: Useful for making plants with altered leaf shape eg curled leaves
  misc_feature (1)..(263): Utility: Useful for making plants with increased biomass
  misc_feature (1)..(263): Utility: Useful for making plants with increased biomass and foliage
  misc_feature (1)..(263): Utility: Useful for making shorter plants and plants with modified flowers
  misc_feature (1)..(263): Utility: Useful for making smaller plants
  misc_feature (1)..(263): Utility: Useful for making taller plants and plants with longer inflorescences
MSRKKKVRRRSTGPDSVSEIIKKWKEQNQKLQEENGARKAPAKGSKKGCMAGKGGPENSNCKYRGVRQRTWGKWVAEIREPNRGNRLWLGSFPTAVEAAHAYDEAARAMYGATARVNFSERSLDANSGCTSAPPVLMSNGPTAVSHPADGKDESESPSLRSDGPTATLRRSDAKDEPESAGTVVHEVKTEVSNDSTSVREERKTVEVFQPKGKALHKEEKVSYDYFNVEEVLDMIIVELSADRKMEVHEEYQDGDDGFSLFSY

SEQ ID NO: 5332 - protein, 264 aa, Arabidopsis thaliana
  misc_feature (1)..(264): useful for making plants with modified plant phenotypes as described in USSN 12/139,269
  misc_feature (1)..(264): Public GI no. 45385108
  misc_feature (1)..(264): Utility: Useful for delaying flowering time
  misc_feature (1)..(264): Utility: Useful for making larger plants
  misc_feature (1)..(264): Utility: Useful for making ornamental plants with modified flowers
  misc_feature (1)..(264): Utility: Useful for making ornamental plants with modified leaves
  misc_feature (1)..(264): Utility: Useful for making plants sterile and for genetic confinement
  misc_feature (1)..(264): Utility: Useful for making plants with  enhanced chemical composition
  misc_feature (1)..(264): Utility: Useful for making plants with altered leaf shape eg curled leaves
  misc_feature (1)..(264): Utility: Useful for making plants with increased biomass
  misc_feature (1)..(264): Utility: Useful for making plants with increased biomass and foliage
  misc_feature (1)..(264): Utility: Useful for making shorter plants and plants with modified flowers
  misc_feature (1)..(264): Utility: Useful for making smaller plants
  misc_feature (1)..(264): Utility: Useful for making taller plants and plants with longer inflorescences
MSRKKKVRRRSTGPDSVAEIIKKWKEQNQKLQEENGSRKAPAKGSKKGCMAGKGGPENSNCKYRGVRQRTWGKWVAEIREPNRGNRLWLGSFPTAVEAAHAYDEAARAMYGATARVNFSERSPDANSGCTSAPPVLMSNGPTAVSYPSDEKDESESPPSLMSDAPTATLHRSDAKGEPESAGTLVHEVKTEVSNDSRSIREERKTVEVFQPEGKALHKEEKVSYDYFNVEEVLDMIIVELSADRKMEVHEEYQDGDDGFSLFSY

SEQ ID NO: 5333 - protein, 274 aa, Arabidopsis thaliana
  misc_feature (1)..(274): useful for making plants with modified plant phenotypes as described in USSN 12/139,269
  misc_feature (1)..(274): Public GI no. 58700406
  misc_feature (1)..(274): Utility: Useful for delaying flowering time
  misc_feature (1)..(274): Utility: Useful for making larger plants
  misc_feature (1)..(274): Utility: Useful for making ornamental plants with modified flowers
  misc_feature (1)..(274): Utility: Useful for making ornamental plants with modified leaves
  misc_feature (1)..(274): Utility: Useful for making plants sterile and for genetic confinement
  misc_feature (1)..(274): Utility: Useful for making plants with  enhanced chemical composition
  misc_feature (1)..(274): Utility: Useful for making plants with altered leaf shape eg curled leaves
  misc_feature (1)..(274): Utility: Useful for making plants with increased biomass
  misc_feature (1)..(274): Utility: Useful for making plants with increased biomass and foliage
  misc_feature (1)..(274): Utility: Useful for making shorter plants and plants with modified flowers
  misc_feature (1)..(274): Utility: Useful for making smaller plants
  misc_feature (1)..(274): Utility: Useful for making taller plants and plants with longer inflorescences
MERGEGRRGDCSVQVRKKRTRRKSDGPDSIAETIKWWKEQNQKLQEENSSRKAPAKGSKKGCMAGKGGPENSNCAYRGVRQRTWGKWVAEIREPNRGRRLWLGSFPTALEAAHAYDEAARAMYGPTARVNFADNSTDANSGCTSAPSLMMSNGPATIPSDEKDELESPPFIVANGPAVLYQPDKKDVLERVVPEVQDVKTEGSNGLKRVCQERKNMEVCESEGIVLHKEVNISYDYFNVHEVVEMIIVELSADQKTEVHEEYQEGDDGFSLFSY

SEQ ID NO: 5334 - protein, 281 aa, Arabidopsis thaliana
  misc_feature (1)..(281): useful for making plants with modified plant phenotypes as described in USSN 12/139,269
  misc_feature (1)..(281): Public GI no. 25989383
  misc_feature (1)..(281): Utility: Useful for delaying flowering time
  misc_feature (1)..(281): Utility: Useful for making larger plants
  misc_feature (1)..(281): Utility: Useful for making ornamental plants with modified flowers
  misc_feature (1)..(281): Utility: Useful for making ornamental plants with modified leaves
  misc_feature (1)..(281): Utility: Useful for making plants sterile and for genetic confinement
  misc_feature (1)..(281): Utility: Useful for making plants with  enhanced chemical composition
  misc_feature (1)..(281): Utility: Useful for making plants with altered leaf shape eg curled leaves
  misc_feature (1)..(281): Utility: Useful for making plants with increased biomass
  misc_feature (1)..(281): Utility: Useful for making plants with increased biomass and foliage
  misc_feature (1)..(281): Utility: Useful for making shorter plants and plants with modified flowers
  misc_feature (1)..(281): Utility: Useful for making smaller plants
  misc_feature (1)..(281): Utility: Useful for making taller plants and plants with longer inflorescences
MLFRFVSCNVQLCGIIELPHWVRKKRTRRKSDGPDSIAETIKWWKEQNQKLQEENSSRKAPAKGSKKGCMAGKGGPENSNCAYRGVRQRTWGKWVAEIREPNRGRRLWLGSFPTALEAAHAYDEAARAMYGPTARVNFADNSTDANSGCTSAPSLMMSNGPATIPSDEKDELESPPFIVANGPAVLYQPDKKDVLERVVPEVQDVKTEGSNGLKRVCQERKNMEVCESEGIVLHKEVNISYDYFNVHEVVEMIIVELSADQKTEVHEEYQEGDDGFSLFSY

SEQ ID NO: 5335 - protein, 250 aa, Arabidopsis thaliana
  misc_feature (1)..(250): useful for making plants with modified plant phenotypes as described in USSN 12/139,269
  misc_feature (1)..(250): Public GI no. 42822041
  misc_feature (1)..(250): Utility: Useful for delaying flowering time
  misc_feature (1)..(250): Utility: Useful for making larger plants
  misc_feature (1)..(250): Utility: Useful for making ornamental plants with modified flowers
  misc_feature (1)..(250): Utility: Useful for making ornamental plants with modified leaves
  misc_feature (1)..(250): Utility: Useful for making plants sterile and for genetic confinement
  misc_feature (1)..(250): Utility: Useful for making plants with  enhanced chemical composition
  misc_feature (1)..(250): Utility: Useful for making plants with altered leaf shape eg curled leaves
  misc_feature (1)..(250): Utility: Useful for making plants with increased biomass
  misc_feature (1)..(250): Utility: Useful for making plants with increased biomass and foliage
  misc_feature (1)..(250): Utility: Useful for making shorter plants and plants with modified flowers
  misc_feature (1)..(250): Utility: Useful for making smaller plants
  misc_feature (1)..(250): Utility: Useful for making taller plants and plants with longer inflorescences
MERVEVLGGGSSAGQVRKKRMRRKSTGPDSIAETIKRWKEHNQKIHEDRKAPAKGSKKGCMAGKGGPENGNCAYRGVRQRTWGKWVAEIREPNRGRRLWLGSFPTALEAAHAYDEAARAMYGPTARVNFSESSADANSGCTSALSLLASNIPPASQRSDDKDEVESVETEVHEVKMEVNDDMRSVHVERKTLEVFQSEESVLRKEGDVSYDYFHVEDVLEMIIVELNAAKKIEVHEEYQDGDDGFSLFSY

SEQ ID NO: 5336 - protein, 264 aa, Arabidopsis thaliana
  misc_feature (1)..(264): useful for making plants with modified plant phenotypes as described in USSN 12/139,269
  misc_feature (1)..(264): Public GI no. 52145406
  misc_feature (1)..(264): Utility: Useful for delaying flowering time
  misc_feature (1)..(264): Utility: Useful for making larger plants
  misc_feature (1)..(264): Utility: Useful for making ornamental plants with modified flowers
  misc_feature (1)..(264): Utility: Useful for making ornamental plants with modified leaves
  misc_feature (1)..(264): Utility: Useful for making plants sterile and for genetic confinement
  misc_feature (1)..(264): Utility: Useful for making plants with  enhanced chemical composition
  misc_feature (1)..(264): Utility: Useful for making plants with altered leaf shape eg curled leaves
  misc_feature (1)..(264): Utility: Useful for making plants with increased biomass
  misc_feature (1)..(264): Utility: Useful for making plants with increased biomass and foliage
  misc_feature (1)..(264): Utility: Useful for making shorter plants and plants with modified flowers
  misc_feature (1)..(264): Utility: Useful for making smaller plants
  misc_feature (1)..(264): Utility: Useful for making taller plants and plants with longer inflorescences
MTRKKKVRRRSTGPDSVAETIKKWKEQNQKLQQENGSRKAPAKGSKKGCMAGKGGPENSNCAYRGVRQRTWGKWVAEIREPNRGNRLWLGSFPTAVEAARAYDDAARAMYGATARVNFPEHSPDANSGCTMAPSLLLSNGATAVSHPSDGKDESESPPSLVSNAPTAALHRSDAKDEFESSGTVAHKVKAEVSNDLRSTHEEHKALEVTQPKGKALHKEANVSYDYFNVEEVLDMIIVELSADVKMEAHEEYQEGDDGFSLFSY

SEQ ID NO: 5337 - protein, 282 aa, Glycine max
  misc_feature (1)..(282): useful for making plants with modified plant phenotypes as described in USSN 12/139,269
  misc_feature (1)..(282): Ceres CLONE ID no. 557009
  misc_feature (1)..(282): Utility: Useful for delaying flowering time
  misc_feature (1)..(282): Utility: Useful for making larger plants
  misc_feature (1)..(282): Utility: Useful for making ornamental plants with modified flowers
  misc_feature (1)..(282): Utility: Useful for making ornamental plants with modified leaves
  misc_feature (1)..(282): Utility: Useful for making plants sterile and for genetic confinement
  misc_feature (1)..(282): Utility: Useful for making plants with  enhanced chemical composition
  misc_feature (1)..(282): Utility: Useful for making plants with altered leaf shape eg curled leaves
  misc_feature (1)..(282): Utility: Useful for making plants with increased biomass
  misc_feature (1)..(282): Utility: Useful for making plants with increased biomass and foliage
  misc_feature (1)..(282): Utility: Useful for making shorter plants and plants with modified flowers
  misc_feature (1)..(282): Utility: Useful for making smaller plants
  misc_feature (1)..(282): Utility: Useful for making taller plants and plants with longer inflorescences
MDTCKKSPLKPWKKGPTRGKGGPQNASCEYRGVRQRTWGKWVAEIREPKKRTRLWLGSFATAEEAAMAYDEAARRLYGPDAYLNLPHLQPRSTSTITSGKFKWFPSKNFISMFPSCGLLNVNAQPSVHLIHQRLQELKRNSVVSQSSSSSSNDPKAEIQNVDSKNHGEDENPPKDVQTSSEEVLGDLQEKPQIDLHEFLQQMGILKEERQSERTDSSGSSTVREAVLTDDCDHLGVFSDKSVNWEALIEMHGLAGIQESEVTQLEAYEPNDDLTFSTSIWNF

SEQ ID NO: 5338 - protein, 316 aa, Glycine max
  misc_feature (1)..(316): useful for making plants with modified plant phenotypes as described in USSN 12/139,269
  misc_feature (1)..(316): Public GI no. 27960757
  misc_feature (1)..(316): Utility: Useful for delaying flowering time
  misc_feature (1)..(316): Utility: Useful for making larger plants
  misc_feature (1)..(316): Utility: Useful for making ornamental plants with modified flowers
  misc_feature (1)..(316): Utility: Useful for making ornamental plants with modified leaves
  misc_feature (1)..(316): Utility: Useful for making plants sterile and for genetic confinement
  misc_feature (1)..(316): Utility: Useful for making plants with  enhanced chemical composition
  misc_feature (1)..(316): Utility: Useful for making plants with altered leaf shape eg curled leaves
  misc_feature (1)..(316): Utility: Useful for making plants with increased biomass
  misc_feature (1)..(316): Utility: Useful for making plants with increased biomass and foliage
  misc_feature (1)..(316): Utility: Useful for making shorter plants and plants with modified flowers
  misc_feature (1)..(316): Utility: Useful for making smaller plants
  misc_feature (1)..(316): Utility: Useful for making taller plants and plants with longer inflorescences
MEGLQRSSSTFRRKKRPRRSRDGPNSVSETIKQWKEVKQQLEHDPQGAKRARKPPAKGSKKGCMQGKGGPENTQCGFRGVRQRTWGKWVAEIRESNRVSRLWLGTFPTAEVAAQAYDEAAKAMYGPLARTNFPVQDAQAAPTVVVQVATEGVVRGSSASCESTTTSNHSDVASSSHNKQLQIQAPEISSQSDLLESTQSVEYIQQQSVPDAVSSIAMSTSEEDVYEPLEPISNLPDGEAHCAISRCFGPRTWPETWTRRRRGCPAASSTPSSGVPAPALAPQRAEAVPSPRGGNGRRCRGSDRAMVDVMRAVFILE

SEQ ID NO: 5339 - DNA, 800 bp, Arabidopsis thaliana
  misc_feature (1)..(800): useful for making plants with modified plant phenotypes as described in USSN 12/139,269
  misc_feature (1)..(800): Ceres CLONE ID no. 907
  misc_feature (1)..(800): Also known as  Ceres CDNA ID no. 23366311
atcatcattccttcttacatcaaatcaattcctaaaatcagagaaaaacatagggacaaaggaaacaacttcaaagatatggagatcaaagttgacgaaggtcatcaaaaaggtactaaagaagacattacaaggccactacttgaagaagacaaagacttcccggatatagaaagaacgacatggatacaaaaggcaataggtcaaacatttcaaaccactgctcatttagctaatctcttaccaacaggaaccgttctcgcgtttcagcttctatcgccaattttctcaaatggcggtcaatgcgatttagtgagcaagataatgacatcgacactggtagcaatatgtggattctcttgcttcatacttagcttcacagattcttacaaagacaaaaacggtactatttgctatggtcttgcaacaatccatgggttttggatcattgatggatccacaactcttcctcaagagttatctaagagatataagctaagatttatagattttgttcatgctttcatgtcgttattcgtgtttggtgcggtggttttattcgatcgaaatgcggtaaattgtttctttccatcaccgtcagcagaagcattggaagttcttacagctttgccggtaggcgtaggggtgttttctagtatgttgtttgcaacatttcctacaacacgcaatgggattggttttccactttctagtaaatgatatcaatatgctgttttttttttaatatcaatatgttattattatttgtaaggttgatttttatatataacttgtggttc

SEQ ID NO: 5340 - protein, 213 aa, Arabidopsis thaliana
  misc_feature (1)..(213): useful for making plants with modified plant phenotypes as described in USSN 12/139,269
  misc_feature (43)..(208): Pfam Name: DUF679; Pfam Description: Protein of unknown function (DUF679)
  misc_feature (1)..(213): Utility: Useful for delaying flowering time
  misc_feature (1)..(213): Utility: Useful for increasing chlorophyll and photosynthetic capacity
  misc_feature (1)..(213): Utility: Useful for making lethal plants for genetic confinement systems
  misc_feature (1)..(213): Utility: Useful for making ornamental plants with modified leaves
  misc_feature (1)..(213): Utility: Useful for making plants sterile and for genetic confinement
  misc_feature (1)..(213): Utility: Useful for making plants with increased biomass and foliage
  misc_feature (1)..(213): Utility: Useful for making smaller plants
MEIKVDEGHQKGTKEDITRPLLEEDKDFPDIERTTWIQKAIGQTFQTTAHLANLLPTGTVLAFQLLSPIFSNGGQCDLVSKIMTSTLVAICGFSCFILSFTDSYKDKNGTICYGLATIHGFWIIDGSTTLPQELSKRYKLRFIDFVHAFMSLFVFGAVVLFDRNAVNCFFPSPSAEALEVLTALPVGVGVFSSMLFATFPTTRNGIGFPLSSK

SEQ ID NO: 5341 - protein, 214 aa, Arabidopsis thaliana
  misc_feature (1)..(214): useful for making plants with modified plant phenotypes as described in USSN 12/139,269
  misc_feature (1)..(214): Public GI no. 9757729
  misc_feature (1)..(214): Utility: Useful for delaying flowering time
  misc_feature (1)..(214): Utility: Useful for increasing chlorophyll and photosynthetic capacity
  misc_feature (1)..(214): Utility: Useful for making lethal plants for genetic confinement systems
  misc_feature (1)..(214): Utility: Useful for making ornamental plants with modified leaves
  misc_feature (1)..(214): Utility: Useful for making plants sterile and for genetic confinement
  misc_feature (1)..(214): Utility: Useful for making plants with increased biomass and foliage
  misc_feature (1)..(214): Utility: Useful for making smaller plants
MEINVDEEAGIIKEETVPLLDDQNRNRDLPDIERNTMMQKAIGKTFQTTANLANLLPTGTVLAFQILSPICTNVGRCDLTSRFMTALLVSICGFSCFILSFTDSYKDLNGSVCYGFATIHGFWIIDGSATLPQELSKSYKLRFIDFVHAIMSFLVFGAVVLFDQNVVNCFYPEPSAEVVELLTTLPVAVGVFCSMVFAKFPTTRHGIGFPLSAK

SEQ ID NO: 5342 - protein, 224 aa, Arabidopsis thaliana
  misc_feature (1)..(224): useful for making plants with modified plant phenotypes as described in USSN 12/139,269
  misc_feature (1)..(224): Public GI no. 50940339
  misc_feature (1)..(224): Utility: Useful for delaying flowering time
  misc_feature (1)..(224): Utility: Useful for increasing chlorophyll and photosynthetic capacity
  misc_feature (1)..(224): Utility: Useful for making lethal plants for genetic confinement systems
  misc_feature (1)..(224): Utility: Useful for making ornamental plants with modified leaves
  misc_feature (1)..(224): Utility: Useful for making plants sterile and for genetic confinement
  misc_feature (1)..(224): Utility: Useful for making plants with increased biomass and foliage
  misc_feature (1)..(224): Utility: Useful for making smaller plants
MASPAVVRQRPTVGKQAGEGESAAAAGDGGGGRPPAARRPSLLSQALASTASLANLLPTGTVMAFQLLAPTFTNNGACDATTSLLTAALLALLALSCVLASFTDSVRGPDGRVYYGLATPRGLWLLDYPPAGAGAPPQPDTSRYRMRAIDGVHALLSVGVFGVVAARDKNVVGCFWPSPAKGTEEVLGIVPLGVGVMCSLLFVVFPTTRHGIGYPVTNNTTSSS

SEQ ID NO: 5343 - protein, 200 aa, Arabidopsis thaliana
  misc_feature (1)..(200): useful for making plants with modified plant phenotypes as described in USSN 12/139,269
  misc_feature (1)..(200): Public GI no. 52354409
  misc_feature (1)..(200): Utility: Useful for delaying flowering time
  misc_feature (1)..(200): Utility: Useful for increasing chlorophyll and photosynthetic capacity
  misc_feature (1)..(200): Utility: Useful for making lethal plants for genetic confinement systems
  misc_feature (1)..(200): Utility: Useful for making ornamental plants with modified leaves
  misc_feature (1)..(200): Utility: Useful for making plants sterile and for genetic confinement
  misc_feature (1)..(200): Utility: Useful for making plants with increased biomass and foliage
  misc_feature (1)..(200): Utility: Useful for making smaller plants
MEETKQSLIASLPSAPRKPKSKVERVVRKTFKGTAHLSNLLPTGSVMSFQIMCPVLTHQGQCPTITSRWLTCFLVSLCAISCFLFSFTDSIRDPNGKVRYGLATWSGLLVMDGSITLTEEEKEKYKLKILDFIHAIMSMLVFFAVSMFDQNVTRCLFPVPSEETKEILTSLPFVIGVICGAFFLAFPTRRHGIGSPLTKE

SEQ ID NO: 5344 - DNA, 1296 bp, Arabidopsis thaliana
  misc_feature (1)..(1296): useful for making plants with modified plant phenotypes as described in USSN 12/139,269
  misc_feature (1)..(1296): Ceres CLONE ID no. 1241
  misc_feature (1)..(1296): Also known as  Ceres CDNA ID no. 23366283
tgaatttcgaaaaatcagtccgttgtgaaagcccaagaataaggattctataatttcaggtctcatttaattatataaccgatctacactttgatctccgacaattcactttcccaataagaaccaactgagagagagagagcgccggagaagaagaattttagagagcgatggacgagggagttatagcagtttccgccatggatgctttcgagaagcttgagaaagttggtgaagggacatacgggaaagtttacagagccagagagaaagctaccgggaaaatcgtcgctctaaagaagacgcgtctccatgaggacgaagaaggcgttccttccaccactctccgcgagatctccattttgcgaatgctcgctcgtgatcctcacgtcgtcaggttaatggatgttaagcaaggactaagcaaagaaggcaaaactgtactgtacctggtttttgaatacatggacactgatgtcaagaaattcatcagaagtttccgtagcactggcaagaacattccaacccaaactatcaagagcttgatgtatcaactatgcaaaggtatggcattctgccatggtcacgggatattgcacagagatctcaagcctcacaatctcttgatggatcccaagacaatgaggctcaaaatagcagatcttggtttagccagagccttcactctgccaatgaagaagtatacccatgagatattaactctttggtatagagctccagaggttcttcttggtgccacccattactctacagctgtggatatgtggtctgttggctgcatatttgctgaacttgtgaccaaccaagcaatctttcagggagactctgagctccaacagctcctccatattttcaagttgtttgggacacccaatgaagaaatgtggccaggagtgagcacactcaagaactggcatgaatacccacagtggaaaccatcgactctatcctctgctgttccaaacctcgacgaggctggagttgatcttctatctaaaatgctgcagtacgagccagcgaaacgaatctcagcaaagatggctatggagcatccttactttgatgatctgccagaaaagtcctctctctaaggatttaaaatcttcagttagtatctttccaagttttatggtttttctagttttgcttctttcaagcatatctctagtgtgctgcttccccctctatgaatcatcctttctttagcataatatatcacttctgattgttgtttctttctattcaaatatttggattaacggctttaatgttctt

SEQ ID NO: 5345 - protein, 313 aa, Arabidopsis thaliana
  misc_feature (1)..(313): useful for making plants with modified plant phenotypes as described in USSN 12/139,269
  misc_feature (14)..(304): Pfam Name: Pkinase; Pfam Description: Protein kinase domain
  misc_feature (14)..(210): Pfam Name: Pkinase_Tyr; Pfam Description: Protein tyrosine kinase
  misc_feature (1)..(313): Utility: Useful for delaying flowering time
  misc_feature (1)..(313): Utility: Useful for increasing chlorophyll and photosynthetic capacity
  misc_feature (1)..(313): Utility: Useful for making ornamental plants with modified leaves
  misc_feature (1)..(313): Utility: Useful for making plants with increased biomass and foliage
  misc_feature (1)..(313): Utility: Useful for making smaller plants
MDEGVIAVSAMDAFEKLEKVGEGTYGKVYRAREKATGKIVALKKTRLHEDEEGVPSTTLREISILRMLARDPHVVRLMDVKQGLSKEGKTVLYLVFEYMDTDVKKFIRSFRSTGKNIPTQTIKSLMYQLCKGMAFCHGHGILHRDLKPHNLLMDPKTMRLKIADLGLARAFTLPMKKYTHEILTLWYRAPEVLLGATHYSTAVDMWSVGCIFAELVTNQAIFQGDSELQQLLHIFKLFGTPNEEMWPGVSTLKNWHEYPQWKPSTLSSAVPNLDEAGVDLLSKMLQYEPAKRISAKMAMEHPYFDDLPEKSSL

SEQ ID NO: 5346 - protein, 315 aa, Arabidopsis thaliana
  misc_feature (1)..(315): useful for making plants with modified plant phenotypes as described in USSN 12/139,269
  misc_feature (1)..(315): Public GI no. 15218072
  misc_feature (1)..(315): Utility: Useful for delaying flowering time
  misc_feature (1)..(315): Utility: Useful for increasing chlorophyll and photosynthetic capacity
  misc_feature (1)..(315): Utility: Useful for making ornamental plants with modified leaves
  misc_feature (1)..(315): Utility: Useful for making plants with increased biomass and foliage
  misc_feature (1)..(315): Utility: Useful for making smaller plants
MDNNGVKPAVSAMEAFEKLEKVGEGTYGKVYRAREKATGMIVALKKTRLHEDEEGVPPTTLREISILRMLARDPHIVRLMDVKQGINKEGKTVLYLVFEYVDTDLKKFIRSFRQAGQNIPQNTVKCLMYQLCKGMAFCHGHGVLHRDLKPHNLLMDRKTMTLKIADLGLARAFTLPMKKYTHEILTLWYRAPEVLLGATHYSTGVDMWSVGCIFAELVTKQAIFAGDSELQQLLRIFRLLGTPNEEVWPGVSKLKDWHEYPQWKPLSLSTAVPNLDEAGLDLLSKMLEYEPAKRISAKKAMEHPYFDDLPDKSSL

SEQ ID NO: 5347 - protein, 303 aa, Arabidopsis thaliana
  misc_feature (1)..(303): useful for making plants with modified plant phenotypes as described in USSN 12/139,269
  misc_feature (1)..(303): Ceres CLONE ID no. 108339
  misc_feature (1)..(303): Utility: Useful for delaying flowering time
  misc_feature (1)..(303): Utility: Useful for increasing chlorophyll and photosynthetic capacity
  misc_feature (1)..(303): Utility: Useful for making ornamental plants with modified leaves
  misc_feature (1)..(303): Utility: Useful for making plants with increased biomass and foliage
  misc_feature (1)..(303): Utility: Useful for making smaller plants
MEAFEKLEKVGEGTYGKVYRAREKATGMIVALKKTRLHEDEEGVPPTTLREISILRMLARDPHIVRLMDVKQGINKEGKTVLYLVFEYVDTDLKKFIRSFRQAGQNIPQNTVKCLMYQLCKGMAFCHGHGVLHRDLKPHNLLMDRKTMTLKIADLGLARAFTLPMKKYTHEILTLWYRAPEVLLGATHYSTGVDMWSVGCIFAELVTKQAIFAGDSELQQLLRIFRLLGTPNEEVWPGVSKLKDWHEYPQWKPLSLSTAVPNLDEAGLDLLSKMLEYEPAKRISAKKAMEHPYFDDLPDKSSL

SEQ ID NO: 5348 - protein, 303 aa, Arabidopsis thaliana; identical to SEQ ID NO: 5347
  misc_feature (1)..(303): useful for making plants with modified plant phenotypes as described in USSN 12/139,269
  misc_feature (1)..(303): Public GI no. 21536682
  misc_feature (1)..(303): Utility: Useful for delaying flowering time
  misc_feature (1)..(303): Utility: Useful for increasing chlorophyll and photosynthetic capacity
  misc_feature (1)..(303): Utility: Useful for making ornamental plants with modified leaves
  misc_feature (1)..(303): Utility: Useful for making plants with increased biomass and foliage
  misc_feature (1)..(303): Utility: Useful for making smaller plants

SEQ ID NO: 5349 - protein, 317 aa, Glycine max
  misc_feature (1)..(317): useful for making plants with modified plant phenotypes as described in USSN 12/139,269
  misc_feature (1)..(317): Ceres CLONE ID no. 473347
  misc_feature (1)..(317): Utility: Useful for delaying flowering time
  misc_feature (1)..(317): Utility: Useful for increasing chlorophyll and photosynthetic capacity
  misc_feature (1)..(317): Utility: Useful for making ornamental plants with modified leaves
  misc_feature (1)..(317): Utility: Useful for making plants with increased biomass and foliage
  misc_feature (1)..(317): Utility: Useful for making smaller plants
MEMEKTGAGVVVLSAKEAFEKLEKVGEGTYGKVYRAREKATGKIVALKKTRLHEDQDGVPPTTLREVSILRMLSRDPHVVRLMDVKQGQNKEGKTVLYLVFEYMDTDLKKFIRSFDQPGQNIPPETIKSLMYQLCKGIAFCHGHGILHRDLKPHNLLMDRKTMMLKIADLGLARAFTVPIKKYTHEILTLWYRAPEVLLGATHYSMAVDIWSVGCIFAELVTRRALFPGDSELQQLLHIFRLLGTPNEEVWPGVSKLKDWHEYPQWNSQSLSTAVPGLEELGLDLLSQMLEYEPSKRISAKKAMEHAYFDDLDKRNL

SEQ ID NO: 5350 - protein, 303 aa, Zea mays
  misc_feature (1)..(303): useful for making plants with modified plant phenotypes as described in USSN 12/139,269
  misc_feature (1)..(303): Ceres CLONE ID no. 224792
  misc_feature (1)..(303): Utility: Useful for delaying flowering time
  misc_feature (1)..(303): Utility: Useful for increasing chlorophyll and photosynthetic capacity
  misc_feature (1)..(303): Utility: Useful for making ornamental plants with modified leaves
  misc_feature (1)..(303): Utility: Useful for making plants with increased biomass and foliage
  misc_feature (1)..(303): Utility: Useful for making smaller plants
MDLYEKLEKVGEGTYGKVYRAREKATGRIVALKKTRLPEDDEGVPPTAMREVSLLRMLSQDPHVVRLLDLKQGVNKEGQTILYLVFEYMDTDLKKFIRGHRSNNEKIPAATVKILMYQLCKGVAFVHGRGVLHRDLKPHNLLMDRKTMALKIADLGLSRAITVPVKKYTHEILTLWYRAPEILLGATHYSTPVDIWSVGCIFAELVTNQPLFPGDSELQQLLHIFKLLGTPNEQVWPGVGKLPNWHEYPQWKPTKLSALVPGLDADGYDLLEKLLEYEPAKRIPAKKALEHPYFKDVRKGDAH

SEQ ID NO: 5351 - protein, 271 aa, Triticum aestivum
  misc_feature (1)..(271): useful for making plants with modified plant phenotypes as described in USSN 12/139,269
  misc_feature (1)..(271): Ceres CLONE ID no. 704321
  misc_feature (1)..(271): Utility: Useful for delaying flowering time
  misc_feature (1)..(271): Utility: Useful for increasing chlorophyll and photosynthetic capacity
  misc_feature (1)..(271): Utility: Useful for making ornamental plants with modified leaves
  misc_feature (1)..(271): Utility: Useful for making plants with increased biomass and foliage
  misc_feature (1)..(271): Utility: Useful for making smaller plants
MDDEGIPPTALREISLLRLLSSSLYVVRLLAVEQATKGGGAGGGGKPVLYLVFEFLDTDLKKFVDAYRRGPAPKPLPTQVVKSFLYQLCKGIAHCHGHGVLHRDLKPQNLLVDKEKMILKIADLGLSRAFTVPMKSYTHEIVTLWYRAPEVLLGATHYSTSVDIWSIGCIFAEMVRKQALFPGDSELQQLLHIFKLLGTPTEEDWPGVTALRDWHEFPQWKAQRLTRAVPTLEPEGIDLLSKMLQFDPANRISAKAALEHPYFNSLDKSQF

SEQ ID NO: 5352 - DNA, 845 bp, Arabidopsis thaliana
  misc_feature (1)..(845): useful for making plants with modified plant phenotypes as described in USSN 12/139,269
  misc_feature (1)..(845): Ceres CLONE ID no. 1610
  misc_feature (1)..(845): Also known as  Ceres CDNA ID no. 23388204
ctcttaaagcttctcgttttctctgccgtctctctcattcgcgcgacgcaaacgatcttcagccatggccaccgccgcagatgttgacgctgagattcagcaggcgctcactaacgaagtcaagctcttcaaccgctggacctatgacgacgttacggtcacagacatcagtcttgttgactacattggagttcaggcagctaaacatgctacctttgttccccacaccgctggaagatactctgtgaagagattcaggaaggctcagtgccccattgttgagaggctcaccaactctctcatgatgcacgggaggaacaacggtaagaaattgatggctgtcaggatcatcaagcacgccatggagattatccacctcttgtctgacttgaacccaattcaggtcatcattgacgccattgtcaacagtggtccacgtgaagatgctaccagaattggatctgctggtgttgttaggagacaagctgttgatatctctcctctaagacgtgttaaccaggctatcttcttgattaccactggtgctcgtgaagctgctttcagaaacatcaagactatagctgagtgccttgctgatgaattgatcaacgcagccaagggctcttccaacagctatgccatcaagaagaaggatgagattgaaagagttgccaaggctaatcgttaaggattttccttttgccctgtgcgttacaatctcgtatcaatgagtttaatgttttatcttcatttagattgaaatatgtatctcagatgtttgctcttttgttttatgaagtttatttcgtctgaactactttgaatagataaatttttgatgcttc

SEQ ID NO: 5353 - protein, 207 aa, Arabidopsis thaliana
  misc_feature (1)..(207): useful for making plants with modified plant phenotypes as described in USSN 12/139,269
  misc_feature (54)..(207): Pfam Name: Ribosomal_S7; Pfam Description: Ribosomal protein S7p/S5e
  misc_feature (1)..(207): Utility: Useful for delaying flowering time
  misc_feature (1)..(207): Utility: Useful for increasing chlorophyll and photosynthetic capacity
  misc_feature (1)..(207): Utility: Useful for increasing increasing anthocyanin content
  misc_feature (1)..(207): Utility: Useful for making lethal plants for genetic confinement systems
  misc_feature (1)..(207): Utility: Useful for making plants with increased biomass and foliage
  misc_feature (1)..(207): Utility: Useful for making smaller plants
MATAADVDAEIQQALTNEVKLFNRWTYDDVTVTDISLVDYIGVQAAKHATFVPHTAGRYSVKRFRKAQCPIVERLTNSLMMHGRNNGKKLMAVRIIKHAMEIIHLLSDLNPIQVIIDAIVNSGPREDATRIGSAGVVRRQAVDISPLRRVNQAIFLITTGAREAAFRNIKTIAECLADELINAAKGSSNSYAIKKKDEIERVAKANR

SEQ ID NO: 5354 - protein, 207 aa, Arabidopsis thaliana [sequence omitted]

SEQ ID NO: 5355 - protein, 207 aa, Arabidopsis thaliana [sequence omitted]

SEQ ID NO: 5356 - protein, 207 aa, Arabidopsis thaliana
  misc_feature (1)..(207): useful for making plants with modified plant phenotypes as described in USSN 12/139,269
  misc_feature (1)..(207): Ceres CLONE ID no. 8397
  misc_feature (1)..(207): Utility: Useful for delaying flowering time
  misc_feature (1)..(207): Utility: Useful for increasing chlorophyll and photosynthetic capacity
  misc_feature (1)..(207): Utility: Useful for increasing increasing anthocyanin content
  misc_feature (1)..(207): Utility: Useful for making lethal plants for genetic confinement systems
  misc_feature (1)..(207): Utility: Useful for making plants with increased biomass and foliage
  misc_feature (1)..(207): Utility: Useful for making smaller plants
MAASAEIDAEIQQQLTNEVKLFNRWSFDDVSVTDISLVDYIGVQPSKHATFVPHTAGRYSVKRFRKAQCPIVERLTNSLMMHGRNNGKKLMAVRIVKHAMEIIHLLSDLNPIQVIIDAIVNSGPREDATRIGSAGVVRRQAVDISPLRRVNQAIFLLTTGAGEAAFRNIKTIAECLADELINAAKGSSNSYAIKKKDEIERVAKANR

SEQ ID NO: 5357 - protein, 207 aa, Arabidopsis thaliana; identical to SEQ ID NO: 5356
  misc_feature (1)..(207): useful for making plants with modified plant phenotypes as described in USSN 12/139,269
  misc_feature (1)..(207): Public GI no. 21617886
  misc_feature (1)..(207): Utility: Useful for delaying flowering time
  misc_feature (1)..(207): Utility: Useful for increasing chlorophyll and photosynthetic capacity
  misc_feature (1)..(207): Utility: Useful for increasing increasing anthocyanin content
  misc_feature (1)..(207): Utility: Useful for making lethal plants for genetic confinement systems
  misc_feature (1)..(207): Utility: Useful for making plants with increased biomass and foliage
  misc_feature (1)..(207): Utility: Useful for making smaller plants

SEQ ID NO: 5358 - protein, 197 aa, Arabidopsis thaliana
  misc_feature (1)..(197): useful for making plants with modified plant phenotypes as described in USSN 12/139,269
  misc_feature (1)..(197): Public GI no. 3043428
  misc_feature (1)..(197): Utility: Useful for delaying flowering time
  misc_feature (1)..(197): Utility: Useful for increasing chlorophyll and photosynthetic capacity
  misc_feature (1)..(197): Utility: Useful for increasing increasing anthocyanin content
  misc_feature (1)..(197): Utility: Useful for making lethal plants for genetic confinement systems
  misc_feature (1)..(197): Utility: Useful for making plants with increased biomass and foliage
  misc_feature (1)..(197): Utility: Useful for making smaller plants
RSDPTQIEVKLFNRWSFDDVQLSDVSLIDYIGVVPSKHATYVPHTAGRYSVKRFRKAQCPIVERLTNSLMMHGRNNGKKLMAVRIIKHAMEIIHLLTDQNPIQVIVDAVVNSGPREDATRIGSAGVVRRQAVDISPLRRVNQAIYLLTTGAREAAFRNIKSIAECLADELINAAKGSSNSYAIKKKDEIERVAKANR

SEQ ID NO: 5359 - protein, 204 aa, Glycine max
  misc_feature (1)..(204): useful for making plants with modified plant phenotypes as described in USSN 12/139,269
  misc_feature (1)..(204): Ceres CLONE ID no. 533766
  misc_feature (1)..(204): Utility: Useful for delaying flowering time
  misc_feature (1)..(204): Utility: Useful for increasing chlorophyll and photosynthetic capacity
  misc_feature (1)..(204): Utility: Useful for increasing increasing anthocyanin content
  misc_feature (1)..(204): Utility: Useful for making lethal plants for genetic confinement systems
  misc_feature (1)..(204): Utility: Useful for making plants with increased biomass and foliage
  misc_feature (1)..(204): Utility: Useful for making smaller plants
MADEAVVVPDPTQIDVKLFNRWSFDDIEITDISLADYIGVATSKHATYVPHTAGRYSVKRFRKAQCPIVERLTNSLMMHGRNNGKKLLAVRIIKHAMEIIHLLTDQNPIQVIVDAVINSGPREDATRIGSAGVVRRQAVDISPLRRVNQAIYLLTTGAREAAFRNIKTIAECLADELINAAKGSSNSYAIKKKDEIERVAKANR

SEQ ID NO: 5360 - protein, 204 aa, Triticum aestivum
  misc_feature (1)..(204): useful for making plants with modified plant phenotypes as described in USSN 12/139,269
  misc_feature (1)..(204): Ceres CLONE ID no. 792839
  misc_feature (1)..(204): Utility: Useful for delaying flowering time
  misc_feature (1)..(204): Utility: Useful for increasing chlorophyll and photosynthetic capacity
  misc_feature (1)..(204): Utility: Useful for increasing increasing anthocyanin content
  misc_feature (1)..(204): Utility: Useful for making lethal plants for genetic confinement systems
  misc_feature (1)..(204): Utility: Useful for making plants with increased biomass and foliage
  misc_feature (1)..(204): Utility: Useful for making smaller plants
MAEIEATVPDPSQIDVKLFNRWSFDDVEVTDMSLADYIGVSPSKHATYVPHTAGRYSVKRFRKAQCPIVERLTNSLMMHGRNNGKKLMAVRIIKHAMEIIHLLTDLNPIQVIVDAVINSGPREDATRIGSAGVVRRQAVDISPLRRVNQAIYLLTTGAREAAFRNIKTIAECLADELINAAKGSSNSYAIKKKDEIERVAKANR

SEQ ID NO: 5361 - protein, 204 aa, Glycine max; identical to SEQ ID NO: 5360
  misc_feature (1)..(204): useful for making plants with modified plant phenotypes as described in USSN 12/139,269
  misc_feature (1)..(204): Ceres CLONE ID no. 471212
  misc_feature (1)..(204): Utility: Useful for delaying flowering time
  misc_feature (1)..(204): Utility: Useful for increasing chlorophyll and photosynthetic capacity
  misc_feature (1)..(204): Utility: Useful for increasing increasing anthocyanin content
  misc_feature (1)..(204): Utility: Useful for making lethal plants for genetic confinement systems
  misc_feature (1)..(204): Utility: Useful for making plants with increased biomass and foliage
  misc_feature (1)..(204): Utility: Useful for making smaller plants

SEQ ID NO: 5362 - protein, 200 aa, Triticum aestivum
  misc_feature (1)..(200): useful for making plants with modified plant phenotypes as described in USSN 12/139,269
  misc_feature (1)..(200): Ceres CLONE ID no. 1033671
  misc_feature (1)..(200): Utility: Useful for delaying flowering time
  misc_feature (1)..(200): Utility: Useful for increasing chlorophyll and photosynthetic capacity
  misc_feature (1)..(200): Utility: Useful for increasing increasing anthocyanin content
  misc_feature (1)..(200): Utility: Useful for making lethal plants for genetic confinement systems
  misc_feature (1)..(200): Utility: Useful for making plants with increased biomass and foliage
  misc_feature (1)..(200): Utility: Useful for making smaller plants
MAVAEPVPGGDVKLFNRWTFEDVQVTDISLNDYLAVTSMKHYTFLPHSAGRYSAKRFRKAQCPIIERLTNSLMMHGRNNGKKIMAVRIIKHTMEIIHLLTDANPIQIIVDAIINSGPREDATRIGSAGVVRRQAVDISPLRRVNQAIYLLTTGARESAFRNVKTIAECLADELINAAKGSSNSYAIKKKDEIERVAKANR

SEQ ID NO: 5363 - protein, 199 aa, Zea mays
  misc_feature (1)..(199): useful for making plants with modified plant phenotypes as described in USSN 12/139,269
  misc_feature (1)..(199): Ceres CLONE ID no. 1281072
  misc_feature (1)..(199): Utility: Useful for delaying flowering time
  misc_feature (1)..(199): Utility: Useful for increasing chlorophyll and photosynthetic capacity
  misc_feature (1)..(199): Utility: Useful for increasing increasing anthocyanin content
  misc_feature (1)..(199): Utility: Useful for making lethal plants for genetic confinement systems
  misc_feature (1)..(199): Utility: Useful for making plants with increased biomass and foliage
  misc_feature (1)..(199): Utility: Useful for making smaller plants
MAEVEQPQDAVKLFNRWTFDDVQVNDISLNDYLAVTAAKHATFLPHSAGRYSKKRFRKAQCAIVERLTNSLMMHGRNNGKKVMAVRIMKHTLEIIHLLTDTNPIQVVVDAIINSGPREDATRIGSAGVVRRQAVDISPLRRVNQAIYLLTTGARESAFRNIKTIAECLADELINAAKGSSNSYAIKKKDEIERVAKANR

SEQ ID NO: 5364 - protein, 199 aa, Zea mays
  misc_feature (1)..(199): useful for making plants with modified plant phenotypes as described in USSN 12/139,269
  misc_feature (1)..(199): Ceres CLONE ID no. 287037
  misc_feature (1)..(199): Utility: Useful for delaying flowering time
  misc_feature (1)..(199): Utility: Useful for increasing chlorophyll and photosynthetic capacity
  misc_feature (1)..(199): Utility: Useful for increasing increasing anthocyanin content
  misc_feature (1)..(199): Utility: Useful for making lethal plants for genetic confinement systems
  misc_feature (1)..(199): Utility: Useful for making plants with increased biomass and foliage
  misc_feature (1)..(199): Utility: Useful for making smaller plants
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGVVRRQAVDISPLRRVNQAIYLLTTGARESAFRNIKTIAECLADELINAAKGSSNSYAIKKKDEIERVAKANR

SEQ ID NO: 5365 - protein, 200 aa, Triticum aestivum
  misc_feature (1)..(200): useful for making plants with modified plant phenotypes as described in USSN 12/139,269
  misc_feature (1)..(200): Ceres CLONE ID no. 741488
  misc_feature (1)..(200): Utility: Useful for delaying flowering time
  misc_feature (1)..(200): Utility: Useful for increasing chlorophyll and photosynthetic capacity
  misc_feature (1)..(200): Utility: Useful for increasing increasing anthocyanin content
  misc_feature (1)..(200): Utility: Useful for making lethal plants for genetic confinement systems
  misc_feature (1)..(200): Utility: Useful for making plants with increased biomass and foliage
  misc_feature (1)..(200): Utility: Useful for making smaller plants
MAVVEPVPGGDVKLFNRWTFEDVQVTDISLNDYLAVTSMKHYTFLPHSAGRYSAKRFRKAQCPIIERLTNSLMMHGRNNGKKIMAVRIIKHTMEIIHLLTDANPIQIIVDAIINSGPREDATRIGSAGVVRRQAVDISPLRRVNQAIYLLTTGARESAFRNVKTIAECLADELINAAKGSSNSYAIKKKDEIERVAKANR

SEQ ID NO: 5366 - protein, 200 aa, Triticum aestivum
  misc_feature (1)..(200): useful for making plants with modified plant phenotypes as described in USSN 12/139,269
  misc_feature (1)..(200): Public GI no. 34893994
  misc_feature (1)..(200): Utility: Useful for delaying flowering time
  misc_feature (1)..(200): Utility: Useful for increasing chlorophyll and photosynthetic capacity
  misc_feature (1)..(200): Utility: Useful for increasing increasing anthocyanin content
  misc_feature (1)..(200): Utility: Useful for making lethal plants for genetic confinement systems
  misc_feature (1)..(200): Utility: Useful for making plants with increased biomass and foliage
  misc_feature (1)..(200): Utility: Useful for making smaller plants
MAVVEQPQQQVVKLFNCWSFEDVQVNDISLADYLAVSSTKHATYLPHTAGRYSAKRFRKAQCPLVERLTNSLMMHGRNNGKKIMAVRIVKHAMEIIHLLTDANPIQVIVDAIINSGPREDATRIGSAGAVRRQAVDISPLRRVNQAIYLLTTGARESAFRNIKTIAECLADELINAAKGSSNSYAIKKKDEIERVAKANR

SEQ ID NO: 5367 - protein, 212 aa, Triticum aestivum
  misc_feature (1)..(212): useful for making plants with modified plant phenotypes as described in USSN 12/139,269
  misc_feature (1)..(212): Public GI no. 40748265
  misc_feature (1)..(212): Utility: Useful for delaying flowering time
  misc_feature (1)..(212): Utility: Useful for increasing chlorophyll and photosynthetic capacity
  misc_feature (1)..(212): Utility: Useful for increasing increasing anthocyanin content
  misc_feature (1)..(212): Utility: Useful for making lethal plants for genetic confinement systems
  misc_feature (1)..(212): Utility: Useful for making plants with increased biomass and foliage
  misc_feature (1)..(212): Utility: Useful for making smaller plants
MDAGVVAATIPADGSLESKVHTDVMLFNRWSYDGVDINDMSVEDYITATANKHPVYMPHTAGRYQAKRFRKAQCPIVERLTNSLMMHGRNNGKKLMAVRIIKHAMEIIHLLTDQNPIQVIVDAVINSGPREDATRIGSAGVVRRQAVDISPLRRVNQAIYLLTTGARESAFRNIKTIAECLADELINAAKGSSNSYAIKKKDEIERVAKANR

SEQ ID NO: 5368 - DNA, 632 bp, Arabidopsis thaliana; identical to SEQ ID NO: 1734
  misc_feature (1)..(632): useful for making plants with modified plant phenotypes as described in USSN 12/139,269
  misc_feature (1)..(632): Ceres CLONE ID no. 2403
  misc_feature (1)..(632): Also known as  Ceres CDNA ID no. 23358989

SEQ ID NO: 5369 - protein, 77 aa, Arabidopsis thaliana
  misc_feature (1)..(77): useful for making plants with modified plant phenotypes as described in USSN 12/139,269
  misc_feature (1)..(73): Pfam Name: ubiquitin; Pfam Description: Ubiquitin family
  misc_feature (1)..(77): Utility: Useful for delaying flowering time
  misc_feature (1)..(77): Utility: Useful for increasing chlorophyll and photosynthetic capacity
  misc_feature (1)..(77): Utility: Useful for making plants with increased tolerance to cold stress
  misc_feature (1)..(77): Utility: Useful for making smaller plants
MIKVKTLTGKEIEIDIEPTDTIDRIKERVEEKEGIPPVQQRLIYAGKQLADDKTAKDYAIEGGSVLHLVLALRGGLL

SEQ ID NO: 5370 - protein, 154 aa, Zea mays; identical to SEQ ID NO: 1736
  misc_feature (1)..(154): useful for making plants with modified plant phenotypes as described in USSN 12/139,269
  misc_feature (1)..(154): Ceres CLONE ID no. 1482731
  misc_feature (1)..(154): Utility: Useful for delaying flowering time
  misc_feature (1)..(154): Utility: Useful for increasing chlorophyll and photosynthetic capacity
  misc_feature (1)..(154): Utility: Useful for making plants with increased tolerance to cold stress
  misc_feature (1)..(154): Utility: Useful for making smaller plants

SEQ ID NO: 5371 - protein, 76 aa, Triticum aestivum
  misc_feature (1)..(76): useful for making plants with modified plant phenotypes as described in USSN 12/139,269
  misc_feature (1)..(76): Ceres CLONE ID no. 1005253
  misc_feature (1)..(76): Utility: Useful for delaying flowering time
  misc_feature (1)..(76): Utility: Useful for increasing chlorophyll and photosynthetic capacity
  misc_feature (1)..(76): Utility: Useful for making plants with increased tolerance to cold stress
  misc_feature (1)..(76): Utility: Useful for making smaller plants
MIKVKTLTGKEIEIDIEPTDTIDRIKERVEEKEGIPPVQQRLIYAGKQLADDKTAKDYNIEGGSVLHLVLALRGGQ

SEQ ID NO: 5372 - protein, 145 aa, Brassica napus
  misc_feature (1)..(145): useful for making plants with modified plant phenotypes as described in USSN 12/139,269
  misc_feature (1)..(145): Ceres CLONE ID no. 1123804
  misc_feature (1)..(145): Utility: Useful for delaying flowering time
  misc_feature (1)..(145): Utility: Useful for increasing chlorophyll and photosynthetic capacity
  misc_feature (1)..(145): Utility: Useful for making plants with increased tolerance to cold stress
  misc_feature (1)..(145): Utility: Useful for making smaller plants
MQIFVKTLTGKTITLEVEGSDTIDNVKSKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHL

SEQ ID NO: 5373 - protein, 153 aa, Zea mays
  misc_feature (1)..(153): useful for making plants with modified plant phenotypes as described in USSN 12/139,269
  misc_feature (1)..(153): Ceres CLONE ID no. 273687
  misc_feature (1)..(153): Utility: Useful for delaying flowering time
  misc_feature (1)..(153): Utility: Useful for increasing chlorophyll and photosynthetic capacity
  misc_feature (1)..(153): Utility: Useful for making plants with increased tolerance to cold stress
  misc_feature (1)..(153): Utility: Useful for making smaller plants
MQIFVKTLTGKTITLEVESSDTVDNVKAKIQDKEGIPPDQQRLIFAGKQLEDGRTLADYNIQKESTLHLVLRLRGGTMIKVKTLTGKEIEIDIEPTDSIDRIKERVEEKEGIPPVQQRLIYAGKQLADDKTAKDYNIEGGSVLHLVLALRGGY

SEQ ID NO: 5374 - protein, 77 aa, Glycine max
  misc_feature (1)..(77): useful for making plants with modified plant phenotypes as described in USSN 12/139,269
  misc_feature (1)..(77): Ceres CLONE ID no. 522921
  misc_feature (1)..(77): Utility: Useful for delaying flowering time
  misc_feature (1)..(77): Utility: Useful for increasing chlorophyll and photosynthetic capacity
  misc_feature (1)..(77): Utility: Useful for making plants with increased tolerance to cold stress
  misc_feature (1)..(77): Utility: Useful for making smaller plants
MIKVKTLTGKEIEIDIEPTDTIDRIKERVEEKEGIPPVQQRLIYAGKQLADDKTAKEYNIEGGSVLHLVLALRGGTY

SEQ ID NO: 5375 - protein, 154 aa, Zea mays
  misc_feature (1)..(154): useful for making plants with modified plant phenotypes as described in USSN 12/139,269
  misc_feature (1)..(154): Ceres CLONE ID no. 1439969
  misc_feature (1)..(154): Utility: Useful for delaying flowering time
  misc_feature (1)..(154): Utility: Useful for increasing chlorophyll and photosynthetic capacity
  misc_feature (1)..(154): Utility: Useful for making plants with increased tolerance to cold stress
  misc_feature (1)..(154): Utility: Useful for making smaller plants
  misc_feature (151)..(151): Xaa is any aa, unknown or other
MQIFVKTLTGKTITLEVESSNTIDNVKSKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRXGSD

SEQ ID NO: 5376 - protein, 147 aa, Brassica napus; identical to SEQ ID NO: 1738
  misc_feature (1)..(147): useful for making plants with modified plant phenotypes as described in USSN 12/139,269
  misc_feature (1)..(147): Ceres CLONE ID no. 1036726
  misc_feature (1)..(147): Utility: Useful for delaying flowering time
  misc_feature (1)..(147): Utility: Useful for increasing chlorophyll and photosynthetic capacity
  misc_feature (1)..(147): Utility: Useful for making plants with increased tolerance to cold stress
  misc_feature (1)..(147): Utility: Useful for making smaller plants
  misc_feature (132)..(132): Xaa is any aa, unknown or other

SEQ ID NO: 5377 - protein, 153 aa, Glycine max; identical to SEQ ID NO: 1739
  misc_feature (1)..(153): useful for making plants with modified plant phenotypes as described in USSN 12/139,269
  misc_feature (1)..(153): Ceres CLONE ID no. 513071
  misc_feature (1)..(153): Utility: Useful for delaying flowering time
  misc_feature (1)..(153): Utility: Useful for increasing chlorophyll and photosynthetic capacity
  misc_feature (1)..(153): Utility: Useful for making plants with increased tolerance to cold stress
  misc_feature (1)..(153): Utility: Useful for making smaller plants
  misc_feature (146)..(146): Xaa is any aa, unknown or other

SEQ ID NO: 5378 - protein, 76 aa, Zea mays
  misc_feature (1)..(76): useful for making plants with modified plant phenotypes as described in USSN 12/139,269
  misc_feature (1)..(76): Ceres CLONE ID no. 1464066
  misc_feature (1)..(76): Utility: Useful for delaying flowering time
  misc_feature (1)..(76): Utility: Useful for increasing chlorophyll and photosynthetic capacity
  misc_feature (1)..(76): Utility: Useful for making plants with increased tolerance to cold stress
  misc_feature (1)..(76): Utility: Useful for making smaller plants
MIKVKTLTGKEIEINIEPNDTIDRIKERVEEREGIPPVQQRLIYAGKQLADDKTVKDYNIEGGSVLHLVLALRGGC

SEQ ID NO: 5379 - protein, 76 aa, Zea mays
  misc_feature (1)..(76): useful for making plants with modified plant phenotypes as described in USSN 12/139,269
  misc_feature (1)..(76): Ceres CLONE ID no. 1453619
  misc_feature (1)..(76): Utility: Useful for delaying flowering time
  misc_feature (1)..(76): Utility: Useful for increasing chlorophyll and photosynthetic capacity
  misc_feature (1)..(76): Utility: Useful for making plants with increased tolerance to cold stress
  misc_feature (1)..(76): Utility: Useful for making smaller plants
  misc_feature (55)..(55): Xaa is any aa, unknown or other
  misc_feature (56)..(56): Xaa is any aa, unknown or other
MIKVKTLTGKEIEIDIEPTDTIDRIKERVEEKEGIPPVQQRLIYAGEALADDKTXXDYNIEGGSVLHLVLALRGGQ

SEQ ID NO: 5380 - DNA, 638 bp, Arabidopsis thaliana
  misc_feature (1)..(638): useful for making plants with modified plant phenotypes as described in USSN 12/139,269
  misc_feature (1)..(638): Ceres CLONE ID no. 2835
  misc_feature (1)..(638): Also known as  Ceres CDNA ID no. 23387874
aacaccgaatctctcaacacaaacaaaatcacacatctctcttcatctttttgtttcctgcaagaatctgaatctgctttactattgtgtcatcatgatgaacatcgacgatacgacgtctccaatggcccacccgatcggtccatctcagcctccttccgaccaaaccaaacaagatccgccaagtttgccccaagaagcagcttcttctgtttcggccgacaagaaagatctagctttgcttgaagagaaaccgaagcagagtcaagaagaagatagagtggacactgggagagagaggttaaagaagcatcggagagagatcgctggtagggtttggataccggagatatggggacaagaagagcttcttaaggattggatcgattgttcaacgtttgacacgtgtctagtccctgccggaatctcgtctgcacgtactgctctcgtagaggaagctaggcgagctgcttcagcttctggtgggttacataatcgttgcttgatcttacgttgaatttaatataataagataacatacttataaatgtggttcttgttcctcaataatataaggcactattgttacattgttgataatattctaactcattttactcgtaactttatgaaacatt

SEQ ID NO: 5381 - protein, 140 aa, Arabidopsis thaliana; identical to SEQ ID NO: 2903
  misc_feature (1)..(140): useful for making plants with modified plant phenotypes as described in USSN 12/139,269
  misc_feature (1)..(140): Utility: Useful for delaying flowering time
  misc_feature (1)..(140): Utility: Useful for making larger plants
  misc_feature (1)..(140): Utility: Useful for making plants with increased size and biomass

SEQ ID NO: 5382 - protein, 138 aa, Brassica napus
  misc_feature (1)..(138): useful for making plants with modified plant phenotypes as described in USSN 12/139,269
  misc_feature (1)..(138): Ceres CLONE ID no. 1048082
  misc_feature (1)..(138): Utility: Useful for delaying flowering time
  misc_feature (1)..(138): Utility: Useful for making larger plants
  misc_feature (1)..(138): Utility: Useful for making plants with increased size and biomass
MMNIDDTTSPMAHPIVPSQPPSDQTQQDPSSPNEASSVTDKKDDQAFPEEKPKQNQEEERVDTGREKLKKHRRDVAGRVWIPDIWGQEELLKDWIDCSTFDTCLVPAGISSARAALVDEARRAASASGGLHSRCLISR

SEQ ID NO: 5383 - protein, 126 aa, Brassica napus; identical to SEQ ID NO: 2904
  misc_feature (1)..(126): useful for making plants with modified plant phenotypes as described in USSN 12/139,269
  misc_feature (1)..(126): Ceres CLONE ID no. 1085655
  misc_feature (1)..(126): Utility: Useful for delaying flowering time
  misc_feature (1)..(126): Utility: Useful for making larger plants
  misc_feature (1)..(126): Utility: Useful for making plants with increased size and biomass

SEQ ID NO: 5384 - protein, 135 aa, Brassica napus; identical to SEQ ID NO: 2905
  misc_feature (1)..(135): useful for making plants with modified plant phenotypes as described in USSN 12/139,269
  misc_feature (1)..(135): Ceres CLONE ID no. 1087946
  misc_feature (1)..(135): Utility: Useful for delaying flowering time
  misc_feature (1)..(135): Utility: Useful for making larger plants
  misc_feature (1)..(135): Utility: Useful for making plants with increased size and biomass
  misc_feature (7)..(7): Xaa is any aa, unknown or other

SEQ ID NO: 5385 - protein, 179 aa, Glycine max
  misc_feature (1)..(179): useful for making plants with modified plant phenotypes as described in USSN 12/139,269
  misc_feature (1)..(179): Ceres CLONE ID no. 642424
  misc_feature (1)..(179): Utility: Useful for delaying flowering time
  misc_feature (1)..(179): Utility: Useful for making larger plants
  misc_feature (1)..(179): Utility: Useful for making plants with increased size and biomass
MAHQSSSSESDDRQIPSHHQPLDLNSPHPSKDIIFNNNMELQQEESNLNKHEYDEDIRDKDKDVVTTQNPSAASETTLLCCNEENMALQEEETSDVAAAKEEEEEEDSGRERLNRHRVEVAGRVWIPDIWGQEELLKDWIDCTAFDATLVPSRISTAREALVQECTRANSAGLRIENRC

SEQ ID NO: 5386 - protein, 173 aa, Zea mays
  misc_feature (1)..(173): useful for making plants with modified plant phenotypes as described in USSN 12/139,269
  misc_feature (1)..(173): Ceres CLONE ID no. 1570772
  misc_feature (1)..(173): Utility: Useful for delaying flowering time
  misc_feature (1)..(173): Utility: Useful for making larger plants
  misc_feature (1)..(173): Utility: Useful for making plants with increased size and biomass
MASFSDVEALPETGEVDHQAKECEAETAVTEENLATLQEQHDDKAPVPYHQEVFAPEHAGEAPAPEEHGDEKDLQVAEPKAAADDQESTRDRLKRHRREMAGRVWVPETWGQEKLLKDWVDCAVFDRPMVPMGLLTARRALIAECCTRRPDRAASSSSSTSSSNPLRVRNGCS

SEQ ID NO: 5387 - DNA, 1197 bp, Arabidopsis thaliana
  misc_feature (1)..(1197): useful for making plants with modified plant phenotypes as described in USSN 12/139,269
  misc_feature (1)..(1197): Ceres CLONE ID no. 3000
  misc_feature (1)..(1197): Also known as  Ceres CDNA ID no. 23373149
atatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctcttcctcttcttcagcctctgtcaaggccaagatcatggctcatcctcactaccaccgcctcttggccgcttatgtcaattgtcagaaggttggagcaccaccggaggttgtggcgaggctggaggaggcatgctcgtctgccgcagccgcagccgcatctatggggccaacagggtgtcttggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgccactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttgggcaatcctttcccaatggatcacatctcctccaccatgctttgatcgatcctttaaaacgttattttattatatttataatcattaaacatcttataatatgtataatctatggttctcggtatacttaggaacatatgaaacatgttccaattgatgaacaagcgtttgatgttgtggtgtgtatccttttgtgttggtctattgttatgtgaaattcctattcctattataatgatagtaaagcttttttgacc

SEQ ID NO: 5388 - protein, 286 aa, Arabidopsis thaliana
  misc_feature (1)..(286): useful for making plants with modified plant phenotypes as described in USSN 12/139,269
  misc_feature (214)..(248): Pfam Name: Homeobox; Pfam Description: Homeobox domain
  misc_feature (23)..(67): Pfam Name: KNOX1; Pfam Description: KNOX1 domain
  misc_feature (74)..(125): Pfam Name: KNOX2; Pfam Description: KNOX2 domain
  misc_feature (166)..(187): Pfam Name: ELK; Pfam Description: ELK domain
  misc_feature (1)..(286): Utility: Useful for delaying flowering time
  misc_feature (1)..(286): Utility: Useful for increasing chlorophyll and photosynthetic capacity
  misc_feature (1)..(286): Utility: Useful for making larger plants
  misc_feature (1)..(286): Utility: Useful for making ornamental plants with modified flowers
  misc_feature (1)..(286): Utility: Useful for making ornamental plants with modified leaves
  misc_feature (1)..(286): Utility: Useful for making plants sterile and for genetic confinement
  misc_feature (1)..(286): Utility: Useful for making plants with altered leaf shape eg curled leaves
  misc_feature (1)..(286): Utility: Useful for making plants with increased biomass
  misc_feature (1)..(286): Utility: Useful for making plants with increased biomass and foliage
  misc_feature (1)..(286): Utility: Useful for making plants with modified flowers
  misc_feature (1)..(286): Utility: Useful for making smaller plants
  misc_feature (1)..(286): Utility: Useful for modifying plant architecture, ie amount of branching
  misc_feature (1)..(286): Utility: Useful for plants with fused leaves eg ornamentals
MEIHHNEIVAGGINPCSSSSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLGNPFPMDHISSTML

SEQ ID NO: 5389 - protein, 350 aa, Glycine max
  misc_feature (1)..(350): useful for making plants with modified plant phenotypes as described in USSN 12/139,269
  misc_feature (1)..(350): Ceres CLONE ID no. 541719
  misc_feature (1)..(350): Utility: Useful for delaying flowering time
  misc_feature (1)..(350): Utility: Useful for increasing chlorophyll and photosynthetic capacity
  misc_feature (1)..(350): Utility: Useful for making larger plants
  misc_feature (1)..(350): Utility: Useful for making ornamental plants with modified flowers
  misc_feature (1)..(350): Utility: Useful for making ornamental plants with modified leaves
  misc_feature (1)..(350): Utility: Useful for making plants sterile and for genetic confinement
  misc_feature (1)..(350): Utility: Useful for making plants with altered leaf shape eg curled leaves
  misc_feature (1)..(350): Utility: Useful for making plants with increased biomass
  misc_feature (1)..(350): Utility: Useful for making plants with increased biomass and foliage
  misc_feature (1)..(350): Utility: Useful for making plants with modified flowers
  misc_feature (1)..(350): Utility: Useful for making smaller plants
  misc_feature (1)..(350): Utility: Useful for modifying plant architecture, ie amount of branching
  misc_feature (1)..(350): Utility: Useful for plants with fused leaves eg ornamentals
MTMMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFACNEGAERNGSSEEDVDLHNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLGNPFPMDLSHPML

SEQ ID NO: 5390 - protein, 352 aa, Glycine max
  misc_feature (1)..(352): useful for making plants with modified plant phenotypes as described in USSN 12/139,269
  misc_feature (1)..(352): Ceres CLONE ID no. 524559
  misc_feature (1)..(352): Utility: Useful for delaying flowering time
  misc_feature (1)..(352): Utility: Useful for increasing chlorophyll and photosynthetic capacity
  misc_feature (1)..(352): Utility: Useful for making larger plants
  misc_feature (1)..(352): Utility: Useful for making ornamental plants with modified flowers
  misc_feature (1)..(352): Utility: Useful for making ornamental plants with modified leaves
  misc_feature (1)..(352): Utility: Useful for making plants sterile and for genetic confinement
  misc_feature (1)..(352): Utility: Useful for making plants with altered leaf shape eg curled leaves
  misc_feature (1)..(352): Utility: Useful for making plants with increased biomass
  misc_feature (1)..(352): Utility: Useful for making plants with increased biomass and foliage
  misc_feature (1)..(352): Utility: Useful for making plants with modified flowers
  misc_feature (1)..(352): Utility: Useful for making smaller plants
  misc_feature (1)..(352): Utility: Useful for modifying plant architecture, ie amount of branching
  misc_feature (1)..(352): Utility: Useful for plants with fused leaves eg ornamentals
MTMMPLVTSHHAGHHPINPSNNNNVNTNCLFIPNCSNSTGTPSIMLHNNHNNNKTDDDDNNNNTGLGYYFMESDHHHHHHGNNNNNGSSSSSSSSAVKAKIMAHPHYHRLLAAYVNCQKVGAPPEVVARLEEACASAATMAGGDAAAGSSCIGEDPALDQFMEAYCEMLTKYEQELSKPLKEAMLFLQRIECQFKNLTISSSDFASNEGGDRNGSSEEDVDLHNMIDPQAEDRDLKGQLLRKYSGYLGSLKQEFMKKRKKGKLPKEARQQLLEWWNRHYKWPYPSESQKLALAESTGLDQKQINNWFINQRKRHWKPSEDMQFVVMDPSHPHYYMDNVLGNPFPMDLSHPML

SEQ ID NO: 5391 - protein, 302 aa, Glycine max
  misc_feature (1)..(302): useful for making plants with modified plant phenotypes as described in USSN 12/139,269
  misc_feature (1)..(302): Ceres CLONE ID no. 537272
  misc_feature (1)..(302): Utility: Useful for delaying flowering time
  misc_feature (1)..(302): Utility: Useful for increasing chlorophyll and photosynthetic capacity
  misc_feature (1)..(302): Utility: Useful for making larger plants
  misc_feature (1)..(302): Utility: Useful for making ornamental plants with modified flowers
  misc_feature (1)..(302): Utility: Useful for making ornamental plants with modified leaves
  misc_feature (1)..(302): Utility: Useful for making plants sterile and for genetic confinement
  misc_feature (1)..(302): Utility: Useful for making plants with altered leaf shape eg curled leaves
  misc_feature (1)..(302): Utility: Useful for making plants with increased biomass
  misc_feature (1)..(302): Utility: Useful for making plants with increased biomass and foliage
  misc_feature (1)..(302): Utility: Useful for making plants with modified flowers
  misc_feature (1)..(302): Utility: Useful for making smaller plants
  misc_feature (1)..(302): Utility: Useful for modifying plant architecture, ie amount of branching
  misc_feature (1)..(302): Utility: Useful for plants with fused leaves eg ornamentals
MDMTNMETNRKFLSLPLSNNNNSGDNRRVPVTSNSIAQEHHYSHHHNPTDTCSVRDKIMAHPLFPRLLSSYLNCLKVGAPPEVVASLEESYAKYESFNASSGRIGGGSIGEDPALDQFMEAYCEMLIKYEQELTKPFKEAMLFFSRIECQLKALAVSSDFGQSETSSKNEVDVHENNLDSQAEDRELKVQLLRKYSGYLGSLKKEFLKKKKNGKLPKEARQQLLDWWNRHYKWPYPSESQKQALAESTGLDMKQINNWFINQRKRHWKPSEDMQFAVMDATNYYMENVMCKPFPMDSMPMLL

SEQ ID NO: 5392 - protein, 194 aa, Triticum aestivum
  misc_feature (1)..(194): useful for making plants with modified plant phenotypes as described in USSN 12/139,269
  misc_feature (1)..(194): Ceres CLONE ID no. 1250120
  misc_feature (1)..(194): Utility: Useful for delaying flowering time
  misc_feature (1)..(194): Utility: Useful for increasing chlorophyll and photosynthetic capacity
  misc_feature (1)..(194): Utility: Useful for making larger plants
  misc_feature (1)..(194): Utility: Useful for making ornamental plants with modified flowers
  misc_feature (1)..(194): Utility: Useful for making ornamental plants with modified leaves
  misc_feature (1)..(194): Utility: Useful for making plants sterile and for genetic confinement
  misc_feature (1)..(194): Utility: Useful for making plants with altered leaf shape eg curled leaves
  misc_feature (1)..(194): Utility: Useful for making plants with increased biomass
  misc_feature (1)..(194): Utility: Useful for making plants with increased biomass and foliage
  misc_feature (1)..(194): Utility: Useful for making plants with modified flowers
  misc_feature (1)..(194): Utility: Useful for making smaller plants
  misc_feature (1)..(194): Utility: Useful for modifying plant architecture, ie amount of branching
  misc_feature (1)..(194): Utility: Useful for plants with fused leaves eg ornamentals
MEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 5393 - protein, 275 aa, Zea mays
  misc_feature (1)..(275): useful for making plants with modified plant phenotypes as described in USSN 12/139,269
  misc_feature (1)..(275): Ceres CLONE ID no. 276087
  misc_feature (1)..(275): Utility: Useful for delaying flowering time
  misc_feature (1)..(275): Utility: Useful for increasing chlorophyll and photosynthetic capacity
  misc_feature (1)..(275): Utility: Useful for making larger plants
  misc_feature (1)..(275): Utility: Useful for making ornamental plants with modified flowers
  misc_feature (1)..(275): Utility: Useful for making ornamental plants with modified leaves
  misc_feature (1)..(275): Utility: Useful for making plants sterile and for genetic confinement
  misc_feature (1)..(275): Utility: Useful for making plants with altered leaf shape eg curled leaves
  misc_feature (1)..(275): Utility: Useful for making plants with increased biomass
  misc_feature (1)..(275): Utility: Useful for making plants with increased biomass and foliage
  misc_feature (1)..(275): Utility: Useful for making plants with modified flowers
  misc_feature (1)..(275): Utility: Useful for making smaller plants
  misc_feature (1)..(275): Utility: Useful for modifying plant architecture, ie amount of branching
  misc_feature (1)..(275): Utility: Useful for plants with fused leaves eg ornamentals
MSAAEADAIKAKIVAHPQYSALLAAYLDCQKVGAPPDLLERLTAMAAKLDARPPGRHGPRDPELDQFMEAYCNMLVKYREELTRPIDEAMEFLKRVEAQLDSIAGGGSSSSARLSLADGKSSEGAGSSEDDDMDPSGRENEPPEIDPRAEDKELKYQLLKKYSGYLSSLRQEFSKKKKKGKLPKEARQKLLHWWELHYKWPYPSETEKIALAEATGLDQKQINNWFINQRKRHWKPSEDMPFVMMEGFHPQTAAALYLDGGAFMADGMTTYRLGS

SEQ ID NO: 5394 - protein, 275 aa, Zea mays; identical to SEQ ID NO: 5393
  misc_feature (1)..(275): useful for making plants with modified plant phenotypes as described in USSN 12/139,269
  misc_feature (1)..(275): Ceres CLONE ID no. 1060946
  misc_feature (1)..(275): Utility: Useful for delaying flowering time
  misc_feature (1)..(275): Utility: Useful for increasing chlorophyll and photosynthetic capacity
  misc_feature (1)..(275): Utility: Useful for making larger plants
  misc_feature (1)..(275): Utility: Useful for making ornamental plants with modified flowers
  misc_feature (1)..(275): Utility: Useful for making ornamental plants with modified leaves
  misc_feature (1)..(275): Utility: Useful for making plants sterile and for genetic confinement
  misc_feature (1)..(275): Utility: Useful for making plants with altered leaf shape eg curled leaves
  misc_feature (1)..(275): Utility: Useful for making plants with increased biomass
  misc_feature (1)..(275): Utility: Useful for making plants with increased biomass and foliage
  misc_feature (1)..(275): Utility: Useful for making plants with modified flowers
  misc_feature (1)..(275): Utility: Useful for making smaller plants
  misc_feature (1)..(275): Utility: Useful for modifying plant architecture, ie amount of branching
  misc_feature (1)..(275): Utility: Useful for plants with fused leaves eg ornamentals

SEQ ID NO: 5395 - protein, 270 aa, Zea mays
  misc_feature (1)..(270): useful for making plants with modified plant phenotypes as described in USSN 12/139,269
  misc_feature (1)..(270): Ceres CLONE ID no. 303119
  misc_feature (1)..(270): Utility: Useful for delaying flowering time
  misc_feature (1)..(270): Utility: Useful for increasing chlorophyll and photosynthetic capacity
  misc_feature (1)..(270): Utility: Useful for making larger plants
  misc_feature (1)..(270): Utility: Useful for making ornamental plants with modified flowers
  misc_feature (1)..(270): Utility: Useful for making ornamental plants with modified leaves
  misc_feature (1)..(270): Utility: Useful for making plants sterile and for genetic confinement
  misc_feature (1)..(270): Utility: Useful for making plants with altered leaf shape eg curled leaves
  misc_feature (1)..(270): Utility: Useful for making plants with increased biomass
  misc_feature (1)..(270): Utility: Useful for making plants with increased biomass and foliage
  misc_feature (1)..(270): Utility: Useful for making plants with modified flowers
  misc_feature (1)..(270): Utility: Useful for making smaller plants
  misc_feature (1)..(270): Utility: Useful for modifying plant architecture, ie amount of branching
  misc_feature (1)..(270): Utility: Useful for plants with fused leaves eg ornamentals
MSAAEAEAIKAKIVAHPQYSALLAAYLDCQKVGAPPDVLERLTAMAAKLDASAAGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMRDGMYRLGS

SEQ ID NO: 5396 - DNA, 1394 bp, Arabidopsis thaliana
  misc_feature (1)..(1394): useful for making plants with modified plant phenotypes as described in USSN 12/139,269
  misc_feature (1)..(1394): Ceres CLONE ID no. 3036
  misc_feature (1)..(1394): Also known as  Ceres CDNA ID no. 23388317
aacgcagtgtctctgattttcacttggttaaagacctctagcttcacggtcaaacatcataaaccttttgccgccgtcactaataggaattaactgatctcgtcaatggcggaggtggaggagattgcgcacgaggagcagaatatcgagaagagggagaagaagaaaggtaaacacgagaagccgaagccatgggatgatgacccaaacatcgaccgttggacaatcgagaagtttgatccggcatggaaccccactggtatgactgaaaccagcacgttctcaacactctttcctcaatacagagagaagtatcttcaggagtgttggcctagagttgaatctgctcttaaggagtacggtgtcgcctgcaagctcaacttggttgaaggttctatgactgtttcgacgacgaggaagacaagagatccatacatcattgtcaaagctagggatttgattaagcttctttccagaagtgtccctgctcctcaggcaattaagattctcgaagatgaggtgcaatgtgatatcatcaagatcggtaacttggttagaaataaggaaagatttgttaaaagaaggcagcggcttgtgggtcctaattcttctaccttgaaggcgctggaaatattaaccaactgttacattctagttcagggaagtactgtagccgctatgggtccatttaaaggtctcaaacagctcagaaggattgtggaagactgcgtacagaatataatgcatcctgtataccatataaagactctcatgatgaaaaaagaactggagaaggatccagctcttgcaaatgaaagctgggataggtttcttcccacattcaggaagaaaaatgttaagcaaaagaaacccaaaagcaaggagaagaagccatacacacctttcccacctcctcaaccacctagcaagattgatatgcagttggagtctggagaatacttcatgagagataaaaagaagtcagagaaaaaatggcaggagaagcaagagaaacagtcagagaagagcacagagaacaaaagaaagagagatgcctcattcctcccacctgaggagcctatgaacaacaatagcaacgcaaacaaatcagaggatggaaagaatgatataaccgagttaacaaattccttgaagagcaagacgaaggagttgaaaaagcagaaaaagacacacgagagagtgaatgcggaggagtatattgctggtccatcttcttctgctgataaatcttccaagaagtccaaaaagattagagattaattctaaatcctgttttttttttttaaaaaaaaagagagaaaagattgaaacttatctatgctcaaaactgtaaaaacaagttaaatctttatttcagccgtcaagttacttcg

SEQ ID NO: 5397 - protein, 391 aa, Arabidopsis thaliana
  misc_feature (1)..(391): useful for making plants with modified plant phenotypes as described in USSN 12/139,269
  misc_feature (1)..(391): Utility: Useful for delaying flowering time
  misc_feature (1)..(391): Utility: Useful for increasing chlorophyll and photosynthetic capacity
  misc_feature (1)..(391): Utility: Useful for making ornamental plants with modified flowers
  misc_feature (1)..(391): Utility: Useful for making ornamental plants with modified leaves
  misc_feature (1)..(391): Utility: Useful for making plants sterile and for genetic confinement
  misc_feature (1)..(391): Utility: Useful for making plants with increased biomass and foliage
  misc_feature (1)..(391): Utility: Useful for making smaller plants
  misc_feature (1)..(391): Utility: Useful for modifying plant structure, ie increased branching
MAEVEEIAHEEQNIEKREKKKGKHEKPKPWDDDPNIDRWTIEKFDPAWNPTGMTETSTFSTLFPQYREKYLQECWPRVESALKEYGVACKLNLVEGSMTVSTTRKTRDPYIIVKARDLIKLLSRSVPAPQAIKILEDEVQCDIIKIGNLVRNKERFVKRRQRLVGPNSSTLKALEILTNCYILVQGSTVAAMGPFKGLKQLRRIVEDCVQNIMHPVYHIKTLMMKKELEKDPALANESWDRFLPTFRKKNVKQKKPKSKEKKPYTPFPPPQPPSKIDMQLESGEYFMRDKKKSEKKWQEKQEKQSEKSTENKRKRDASFLPPEEPMNNNSNANKSEDGKNDITELTNSLKSKTKELKKQKKTHERVNAEEYIAGPSSSADKSSKKSKKIRD

SEQ ID NO: 5398 - protein, 395 aa, Arabidopsis thaliana
  misc_feature (1)..(395): useful for making plants with modified plant phenotypes as described in USSN 12/139,269
  misc_feature (1)..(395): Public GI no. 31432429
  misc_feature (1)..(395): Utility: Useful for delaying flowering time
  misc_feature (1)..(395): Utility: Useful for increasing chlorophyll and photosynthetic capacity
  misc_feature (1)..(395): Utility: Useful for making ornamental plants with modified flowers
  misc_feature (1)..(395): Utility: Useful for making ornamental plants with modified leaves
  misc_feature (1)..(395): Utility: Useful for making plants sterile and for genetic confinement
  misc_feature (1)..(395): Utility: Useful for making plants with increased biomass and foliage
  misc_feature (1)..(395): Utility: Useful for making smaller plants
  misc_feature (1)..(395): Utility: Useful for modifying plant structure, ie increased branching
MASEEGEEANAASSAEEVGRKKPPRHKGKHDKPKPWDDDPNIDHWKIEKFDPSWNEGGMLEVSSFSTLFPQYREKYLQEAWPIVKGALKEFGVACELNLVEGSMTVSTTRKTRDPYIIVKAKELIKLLSRSVPAPQAIKILNDEMSCDIIKIGSIIRNKERFVKRRERLLGPNLSTLKAIEILTGCYILVQGNTVAAMGSWKGLKQVRRVVEDCIKNIKHPVYHIKELLIKRELAKNPALANESWDRFLPKFKKKNVKQKKPITKEKKPYTPFPPPQQPSKIDLELESGEYFMSDKKKSAKKWQEKLEKQSEKAEENKRKREAAFVPPKEDTATPYESAKSTSNNDEIADMAKSLKKKAKEFRKSEAQENVRLESYVASNEGSRPKKKHKSSKSK

SEQ ID NO: 5399 - protein, 336 aa, Zea mays
  misc_feature (1)..(336): useful for making plants with modified plant phenotypes as described in USSN 12/139,269
  misc_feature (1)..(336): Ceres CLONE ID no. 278965
  misc_feature (1)..(336): Utility: Useful for delaying flowering time
  misc_feature (1)..(336): Utility: Useful for increasing chlorophyll and photosynthetic capacity
  misc_feature (1)..(336): Utility: Useful for making ornamental plants with modified flowers
  misc_feature (1)..(336): Utility: Useful for making ornamental plants with modified leaves
  misc_feature (1)..(336): Utility: Useful for making plants sterile and for genetic confinement
  misc_feature (1)..(336): Utility: Useful for making plants with increased biomass and foliage
  misc_feature (1)..(336): Utility: Useful for making smaller plants
  misc_feature (1)..(336): Utility: Useful for modifying plant structure, ie increased branching
MLEVSSFSTLFPQYREKYLQEAWPVVKGALKEYGISCELNLVEGSMTVSTTRKTRDPFAIIKARELIKLLSRSVPAPQAIKILDDEMNCDIIKIGGLVRNKERFVKRRERLLGPNLSTLKAIEILTGCYILVQGNTVAAMGNYRGRGLKQVRRIVEDCMKNVKHPVYHIKELLIKRELAKNPALANENWDRFLPKFKKKNVKQKKPQTKEKKPYTPFPPPQQPSKIDLELENGEYFMSDKKKSAKKWQEKLDKQSGRAEENKRKREAAFVPPKENTAGPSKSDKNASDNSEIADIAKSLKRKAKEFRKNEAQESVIAESYIASNDELRQKKEKEIN

SEQ ID NO: 5400 - protein, 421 aa, Zea mays
  misc_feature (1)..(421): useful for making plants with modified plant phenotypes as described in USSN 12/139,269
  misc_feature (1)..(421): Public GI no. 56785318
  misc_feature (1)..(421): Utility: Useful for delaying flowering time
  misc_feature (1)..(421): Utility: Useful for increasing chlorophyll and photosynthetic capacity
  misc_feature (1)..(421): Utility: Useful for making ornamental plants with modified flowers
  misc_feature (1)..(421): Utility: Useful for making ornamental plants with modified leaves
  misc_feature (1)..(421): Utility: Useful for making plants sterile and for genetic confinement
  misc_feature (1)..(421): Utility: Useful for making plants with increased biomass and foliage
  misc_feature (1)..(421): Utility: Useful for making smaller plants
  misc_feature (1)..(421): Utility: Useful for modifying plant structure, ie increased branching
MASEGDASALVAAAEGRKPRHKGKHDKPKPWDDDPNIDHWKIEEFDPSWNEGGMLEVTSFSTLFPQYRGKSPHPTPPSALSWFLPRSAIDWFCLVVKKYLQEAWPIVKGALKEFGVACELNLVEGSMTVSTTRKTKDPYIIIKANELIKLLSRSVPAPQAIKILNDEMSCAIIKIGSIIRNKERFVKRRGRLLGPNLSTLKAIEILTGCYILVQGNTAAAMGYWKGLKQVVRVVEDCIKNVKHPVYHIKELLIKRELVKNPALAHESWDKFLPKFKKKNVKQKKPLTKEKKQYTPFPPPQQPSKIDLELESGECFMSDKKKSAKEWQEKLEKQSQKAEENKRKREAAFVHPNEDIATPYESAKSIINNGEIADMAKSLKKKAKELRKNEEQENVRLESYVASNEGSRPKKKHKLSKYSQPE

SEQ ID NO: 5401 - DNA, 631 bp, Arabidopsis thaliana
  misc_feature (1)..(631): useful for making plants with modified plant phenotypes as described in USSN 12/139,269
  misc_feature (1)..(631): Ceres CLONE ID no. 3363
  misc_feature (1)..(631): Also known as  Ceres CDNA ID no. 23358733
aaacagtatcaaatcaaaaccatcacagcaaaaataactcactccctagaaaagtttgaaaatggcgaaggcagataagaaaccagcggagaagaaaccggcagagaaaactccggcagccgaaccagcagcagcggcagagaagaaaccaaaagccggaaagaaactccccaaggaaccagccgtcgccggagacaagaagaagaagagatcaaagaagaacgttgagacatacaagatctacatcttcaaggtgttgaagcaagttcatccagacatcggaatctcaagcaaagccatgggaatcatgaacagtttcatcaacgatatctttgagaagcttgctggtgagtcttcgaagcttgcaaggtacaacaagaagccgacgattacttccagggagattcagactgcggttagacttgtgttgcccggtgagttggcgaaacatgctgtgtctgaagggactaaggcggttacgaagtttacaagttcttagatttggaatgtggttttgtaatggtggagaagtagtagtaaaatgtgaaatagggtttatgcttttgggtatctttgaaggttatgtaatttgggaattagggtttttatttatggcacggctatgaaatcc

SEQ ID NO: 5402 - protein, 145 aa, Arabidopsis thaliana
  misc_feature (1)..(145): useful for making plants with modified plant phenotypes as described in USSN 12/139,269
  misc_feature (52)..(124): Pfam Name: Histone; Pfam Description: Core histone H2A/H2B/H3/H4
  misc_feature (1)..(145): Utility: Useful for delaying flowering time
  misc_feature (1)..(145): Utility: Useful for increasing chlorophyll and photosynthetic capacity
  misc_feature (1)..(145): Utility: Useful for making plants sterile and for genetic confinement
  misc_feature (1)..(145): Utility: Useful for making plants with altered leaf shape eg curled leaves
  misc_feature (1)..(145): Utility: Useful for making plants with increased biomass and foliage
  misc_feature (1)..(145): Utility: Useful for making smaller plants
MAKADKKPAEKKPAEKTPAAEPAAAAEKKPKAGKKLPKEPAVAGDKKKKRSKKNVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 5403 - protein, 140 aa, Triticum aestivum
  misc_feature (1)..(140): useful for making plants with modified plant phenotypes as described in USSN 12/139,269
  misc_feature (1)..(140): Ceres CLONE ID no. 1053095
  misc_feature (1)..(140): Utility: Useful for delaying flowering time
  misc_feature (1)..(140): Utility: Useful for increasing chlorophyll and photosynthetic capacity
  misc_feature (1)..(140): Utility: Useful for making plants sterile and for genetic confinement
  misc_feature (1)..(140): Utility: Useful for making plants with altered leaf shape eg curled leaves
  misc_feature (1)..(140): Utility: Useful for making plants with increased biomass and foliage
  misc_feature (1)..(140): Utility: Useful for making smaller plants
MAPKAAEKKPAEKKPAEKAPAEKKPKAGKKLPKDPSAVAGDKKKKRSKKSVETYKIYIFKVLKQVHPDIGISSKAMGIMNSFINDIFEKLAGESSKLARYNKKPTITSREIQTAVRLVLPGELAKHAVSEGTKAVTKFTS

SEQ ID NO: 5404 - protein, 141 aa, Glycine max
  misc_feature (1)..(141): useful for making plants with modified plant phenotypes as described in USSN 12/139,269
  misc_feature (1)..(141): Ceres CLONE ID no. 1059204
  misc_feature (1)..(141): Utility: Useful for delaying flowering time
  misc_feature (1)..(141): Utility: Useful for increasing chlorophyll and photosynthetic capacity
  misc_feature (1)..(141): Utility: Useful for making plants sterile and for genetic confinement
  misc_feature (1)..(141): Utility: Useful for making plants with altered leaf shape eg curled leaves
  misc_feature (1)..(141): Utility: Useful for making plants with increased biomass and foliage
  misc_feature (1)..(141): Utility: Useful for making smaller plants
MAKADKKPAEKKPAETTTAAAAEKKPKAGKKLPKDPAVAGDKKKKRTKKSVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 5405 - protein, 141 aa, Zea mays
  misc_feature (1)..(141): useful for making plants with modified plant phenotypes as described in USSN 12/139,269
  misc_feature (1)..(141): Ceres CLONE ID no. 1382087
  misc_feature (1)..(141): Utility: Useful for delaying flowering time
  misc_feature (1)..(141): Utility: Useful for increasing chlorophyll and photosynthetic capacity
  misc_feature (1)..(141): Utility: Useful for making plants sterile and for genetic confinement
  misc_feature (1)..(141): Utility: Useful for making plants with altered leaf shape eg curled leaves
  misc_feature (1)..(141): Utility: Useful for making plants with increased biomass and foliage
  misc_feature (1)..(141): Utility: Useful for making smaller plants
MAPKAAEKKPAEKKTAEKAPAEKKPKAGKKLPKDPSAVAGDKKKKRSKKSVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 5406 - protein, 141 aa, Brassica napus
  misc_feature (1)..(141): useful for making plants with modified plant phenotypes as described in USSN 12/139,269
  misc_feature (1)..(141): Ceres CLONE ID no. 952003
  misc_feature (1)..(141): Utility: Useful for delaying flowering time
  misc_feature (1)..(141): Utility: Useful for increasing chlorophyll and photosynthetic capacity
  misc_feature (1)..(141): Utility: Useful for making plants sterile and for genetic confinement
  misc_feature (1)..(141): Utility: Useful for making plants with altered leaf shape eg curled leaves
  misc_feature (1)..(141): Utility: Useful for making plants with increased biomass and foliage
  misc_feature (1)..(141): Utility: Useful for making smaller plants
  misc_feature (107)..(107): Xaa is any aa, unknown or other
MAPKAAEKKPAEKKTAEKAPAEKKPKAGKKLPKDPSAVAGDKKKKRSKKSVETYKIYIFKVLKQVHPDIGISSKAMGIMNSFINDIFEKLAGESSKLARYNKKPTIXSREIQTAVRLVLPGELAKHAVSEGTKAVTKFTSS

SEQ ID NO: 5407 - protein, 141 aa, Triticum aestivum
  misc_feature (1)..(141): useful for making plants with modified plant phenotypes as described in USSN 12/139,269
  misc_feature (1)..(141): Ceres CLONE ID no. 1032859
  misc_feature (1)..(141): Utility: Useful for delaying flowering time
  misc_feature (1)..(141): Utility: Useful for increasing chlorophyll and photosynthetic capacity
  misc_feature (1)..(141): Utility: Useful for making plants sterile and for genetic confinement
  misc_feature (1)..(141): Utility: Useful for making plants with altered leaf shape eg curled leaves
  misc_feature (1)..(141): Utility: Useful for making plants with increased biomass and foliage
  misc_feature (1)..(141): Utility: Useful for making smaller plants
  misc_feature (15)..(15): Xaa is any aa, unknown or other
  misc_feature (131)..(131): Xaa is any aa, unknown or other
MAPKAAEKKPAEKKXAEKAPAEKKPKAGKKLPKDPSAVAGDKKKKRSKKSVETYKIYIFKVLKQVHPDIGISSKAMGIMNSFINDIFEKLAGESSKLARYNKKPTITSREIQTAVRLVLPGELAKHAVSEXTKAVTKFTSS

SEQ ID NO: 5408 - protein, 144 aa, Brassica napus
  misc_feature (1)..(144): useful for making plants with modified plant phenotypes as described in USSN 12/139,269
  misc_feature (1)..(144): Ceres CLONE ID no. 1123883
  misc_feature (1)..(144): Utility: Useful for delaying flowering time
  misc_feature (1)..(144): Utility: Useful for increasing chlorophyll and photosynthetic capacity
  misc_feature (1)..(144): Utility: Useful for making plants sterile and for genetic confinement
  misc_feature (1)..(144): Utility: Useful for making plants with altered leaf shape eg curled leaves
  misc_feature (1)..(144): Utility: Useful for making plants with increased biomass and foliage
  misc_feature (1)..(144): Utility: Useful for making smaller plants
MAKADKKPAEKKPAAETTTAAAAAEKKPKAGKKLPKDPSAVAGDKKKKRSKKSVETYKIYIFKVLKQVHPDVGISSKAMGIMNSFINDIFEKLAGESSKLARYNKKPTITSREIQTAVRLVLPGELAKHAVSEGTKAVTKFTSS

SEQ ID NO: 5409 - protein, 141 aa, Zea mays
  misc_feature (1)..(141): useful for making plants with modified plant phenotypes as described in USSN 12/139,269
  misc_feature (1)..(141): Ceres CLONE ID no. 1379029
  misc_feature (1)..(141): Utility: Useful for delaying flowering time
  misc_feature (1)..(141): Utility: Useful for increasing chlorophyll and photosynthetic capacity
  misc_feature (1)..(141): Utility: Useful for making plants sterile and for genetic confinement
  misc_feature (1)..(141): Utility: Useful for making plants with altered leaf shape eg curled leaves
  misc_feature (1)..(141): Utility: Useful for making plants with increased biomass and foliage
  misc_feature (1)..(141): Utility: Useful for making smaller plants
  misc_feature (7)..(7): Xaa is any aa, unknown or other
  misc_feature (48)..(48): Xaa is any aa, unknown or other
  misc_feature (52)..(52): Xaa is any aa, unknown or other
  misc_feature (60)..(60): Xaa is any aa, unknown or other
  misc_feature (81)..(81): Xaa is any aa, unknown or other
  misc_feature (115)..(115): Xaa is any aa, unknown or other
MAPKAAXKKPAEKKPAEKAPAEKKPKAGKKLPKDPSAVAGDKKKKRSXKSVXTYKIYIFXVLKQVHPDIGISSKAMGIMNXFINDIFEKLAGESSKLARYNKKPTITSREIQTAXRLVLPGELAKHAVSEGTKAVTKFTSS

SEQ ID NO: 5410 - protein, 142 aa, Glycine max
  misc_feature (1)..(142): useful for making plants with modified plant phenotypes as described in USSN 12/139,269
  misc_feature (1)..(142): Ceres CLONE ID no. 1101282
  misc_feature (1)..(142): Utility: Useful for delaying flowering time
  misc_feature (1)..(142): Utility: Useful for increasing chlorophyll and photosynthetic capacity
  misc_feature (1)..(142): Utility: Useful for making plants sterile and for genetic confinement
  misc_feature (1)..(142): Utility: Useful for making plants with altered leaf shape eg curled leaves
  misc_feature (1)..(142): Utility: Useful for making plants with increased biomass and foliage
  misc_feature (1)..(142): Utility: Useful for making smaller plants
MAPKAEKKPAEEKSKAEKAPAEKKPKAGKKLPKEAGAGAGGDKKKKTKKKSVETYKIYIFKVLKQVHPDIGISSKAMGIMNSFINDIFEKLAGEASKLARYNKKPTITSREIQTAVRLVLPGELAKHAVSEGTKAVTKFTSS

SEQ ID NO: 5411 - protein, 142 aa, Zea mays; identical to SEQ ID NO: 5410
  misc_feature (1)..(142): useful for making plants with modified plant phenotypes as described in USSN 12/139,269
  misc_feature (1)..(142): Ceres CLONE ID no. 1463543
  misc_feature (1)..(142): Utility: Useful for delaying flowering time
  misc_feature (1)..(142): Utility: Useful for increasing chlorophyll and photosynthetic capacity
  misc_feature (1)..(142): Utility: Useful for making plants sterile and for genetic confinement
  misc_feature (1)..(142): Utility: Useful for making plants with altered leaf shape eg curled leaves
  misc_feature (1)..(142): Utility: Useful for making plants with increased biomass and foliage
  misc_feature (1)..(142): Utility: Useful for making smaller plants

SEQ ID NO: 5412 - protein, 151 aa, Arabidopsis thaliana
  misc_feature (1)..(151): useful for making plants with modified plant phenotypes as described in USSN 12/139,269
  misc_feature (1)..(151): Ceres CLONE ID no. 38506
  misc_feature (1)..(151): Utility: Useful for delaying flowering time
  misc_feature (1)..(151): Utility: Useful for increasing chlorophyll and photosynthetic capacity
  misc_feature (1)..(151): Utility: Useful for making plants sterile and for genetic confinement
  misc_feature (1)..(151): Utility: Useful for making plants with altered leaf shape eg curled leaves
  misc_feature (1)..(151): Utility: Useful for making plants with increased biomass and foliage
  misc_feature (1)..(151): Utility: Useful for making smaller plants
MAPKAGKKPAEKKPAEKAPAEEEKVAEKAPAEKKPKAGKKLPKEAVTGGVEKKKKRVKKSTETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 5413 - protein, 150 aa, Arabidopsis thaliana
  misc_feature (1)..(150): useful for making plants with modified plant phenotypes as described in USSN 12/139,269
  misc_feature (1)..(150): Ceres CLONE ID no. 20822
  misc_feature (1)..(150): Utility: Useful for delaying flowering time
  misc_feature (1)..(150): Utility: Useful for increasing chlorophyll and photosynthetic capacity
  misc_feature (1)..(150): Utility: Useful for making plants sterile and for genetic confinement
  misc_feature (1)..(150): Utility: Useful for making plants with altered leaf shape eg curled leaves
  misc_feature (1)..(150): Utility: Useful for making plants with increased biomass and foliage
  misc_feature (1)..(150): Utility: Useful for making smaller plants
MAPKAEKKPAEKKPASEKPVEEKSKAEKAPAEKKPKAGKKLPKEAGAGGDKKKKMKKKSVETYKIYIFKVLKQVHPDIGISSKAMGIMNSFINDIFEKLAQEASKLARYNKKPTITSREIQTAVRLVLPGELAKHAVSEGTKAVTKFTSS

SEQ ID NO: 5414 - protein, 149 aa, Zea mays
  misc_feature (1)..(149): useful for making plants with modified plant phenotypes as described in USSN 12/139,269
  misc_feature (1)..(149): Ceres CLONE ID no. 1438404
  misc_feature (1)..(149): Utility: Useful for delaying flowering time
  misc_feature (1)..(149): Utility: Useful for increasing chlorophyll and photosynthetic capacity
  misc_feature (1)..(149): Utility: Useful for making plants sterile and for genetic confinement
  misc_feature (1)..(149): Utility: Useful for making plants with altered leaf shape eg curled leaves
  misc_feature (1)..(149): Utility: Useful for making plants with increased biomass and foliage
  misc_feature (1)..(149): Utility: Useful for making smaller plants
MAPKAEKKPAEKKPAEEKKSTVGDKAPAEKKPKAGKKLPKEGGAGGEGGKKKKRNKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 5415 - protein, 149 aa, Glycine max
  misc_feature (1)..(149): useful for making plants with modified plant phenotypes as described in USSN 12/139,269
  misc_feature (1)..(149): Ceres CLONE ID no. 652242
  misc_feature (1)..(149): Utility: Useful for delaying flowering time
  misc_feature (1)..(149): Utility: Useful for increasing chlorophyll and photosynthetic capacity
  misc_feature (1)..(149): Utility: Useful for making plants sterile and for genetic confinement
  misc_feature (1)..(149): Utility: Useful for making plants with altered leaf shape eg curled leaves
  misc_feature (1)..(149): Utility: Useful for making plants with increased biomass and foliage
  misc_feature (1)..(149): Utility: Useful for making smaller plants
  misc_feature (55)..(55): Xaa is any aa, unknown or other
MAPKAEKKPAEKKPAEEKKSTVGDKAPAEKKPKAGKKLPKEGGAGGEGGKKKKRXKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 5416 - protein, 149 aa, Triticum aestivum
  misc_feature (1)..(149): useful for making plants with modified plant phenotypes as described in USSN 12/139,269
  misc_feature (1)..(149): Ceres CLONE ID no. 632635
  misc_feature (1)..(149): Utility: Useful for delaying flowering time
  misc_feature (1)..(149): Utility: Useful for increasing chlorophyll and photosynthetic capacity
  misc_feature (1)..(149): Utility: Useful for making plants sterile and for genetic confinement
  misc_feature (1)..(149): Utility: Useful for making plants with altered leaf shape eg curled leaves
  misc_feature (1)..(149): Utility: Useful for making plants with increased biomass and foliage
  misc_feature (1)..(149): Utility: Useful for making smaller plants
MAPKAEKKPAAKKPAEEEPAAEKAPAAKKPKAEKRLPAGKSAAGKDGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 5417 - protein, 152 aa, Triticum aestivum
  misc_feature (1)..(152): useful for making plants with modified plant phenotypes as described in USSN 12/139,269
  misc_feature (1)..(152): Ceres CLONE ID no. 570063
  misc_feature (1)..(152): Utility: Useful for delaying flowering time
  misc_feature (1)..(152): Utility: Useful for increasing chlorophyll and photosynthetic capacity
  misc_feature (1)..(152): Utility: Useful for making plants sterile and for genetic confinement
  misc_feature (1)..(152): Utility: Useful for making plants with altered leaf shape eg curled leaves
  misc_feature (1)..(152): Utility: Useful for making plants with increased biomass and foliage
  misc_feature (1)..(152): Utility: Useful for making smaller plants
MAPKAEKKPAAKKPAEEEPAAEKAEKTPAGKKPKAEKRLPAGKSAAKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 5418 - protein, 152 aa, Zea mays; identical to SEQ ID NO: 5417
  misc_feature (1)..(152): useful for making plants with modified plant phenotypes as described in USSN 12/139,269
  misc_feature (1)..(152): Ceres CLONE ID no. 1453911
  misc_feature (1)..(152): Utility: Useful for delaying flowering time
  misc_feature (1)..(152): Utility: Useful for increasing chlorophyll and photosynthetic capacity
  misc_feature (1)..(152): Utility: Useful for making plants sterile and for genetic confinement
  misc_feature (1)..(152): Utility: Useful for making plants with altered leaf shape eg curled leaves
  misc_feature (1)..(152): Utility: Useful for making plants with increased biomass and foliage
  misc_feature (1)..(152): Utility: Useful for making smaller plants

SEQ ID NO: 5419 - protein, 150 aa, Zea mays
  misc_feature (1)..(150): useful for making plants with modified plant phenotypes as described in USSN 12/139,269
  misc_feature (1)..(150): Ceres CLONE ID no. 302748
  misc_feature (1)..(150): Utility: Useful for delaying flowering time
  misc_feature (1)..(150): Utility: Useful for increasing chlorophyll and photosynthetic capacity
  misc_feature (1)..(150): Utility: Useful for making plants sterile and for genetic confinement
  misc_feature (1)..(150): Utility: Useful for making plants with altered leaf shape eg curled leaves
  misc_feature (1)..(150): Utility: Useful for making plants with increased biomass and foliage
  misc_feature (1)..(150): Utility: Useful for making smaller plants
MAPKAEKKPAAKKPAEEEPATEKAEKAPAGKKPKAEKRLPAGKSGAGEGKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 5420 - DNA, 366 bp, Arabidopsis thaliana
  misc_feature (1)..(366): useful for making plants with modified plant phenotypes as described in USSN 12/139,269
  misc_feature (1)..(366): Ceres CLONE ID no. 3510
  misc_feature (1)..(366): Also known as  Ceres CDNA ID no. 13496297
aatactcgtatcttgtagcagccactaaagcaaaattctgagatcgaaaaagctataaaaaaaaaaaactgcttccgtttcatcgattttgtccagatcttccccttcttccggtaatcgaagcttacgagatagttgagtgaagatgatctatgatgtgaactctggtctattcagatccttcctgagccagaagggtagctcgtccgacaaaaggaaaatggaagataagccaagagaacagaagcccaaagccagcgacaacaaacctgttatgaatgaatgagaacagattacatcttcttgtaatttctctttacctatttcagttgtaagcatcattttaatgaattaagtttctttcct

SEQ ID NO: 5421 - protein, 46 aa, Arabidopsis thaliana
  misc_feature (1)..(46): useful for making plants with modified plant phenotypes as described in USSN 12/139,269
  misc_feature (1)..(46): Pfam Name: Wound_ind; Pfam Description: Wound-inducible basic protein family
  misc_feature (1)..(46): Pfam Name: Wound_ind; Pfam Description: Wound-inducible basic protein family
  misc_feature (1)..(46): Utility: Useful for delaying flowering time
  misc_feature (1)..(46): Utility: Useful for making smaller plants
MIYDVNSGLFRSFLSQKGSSSDKRKMEDKPREQKPKASDNKPVMNE

SEQ ID NO: 5422 - protein, 45 aa, Brassica napus
  misc_feature (1)..(45): useful for making plants with modified plant phenotypes as described in USSN 12/139,269
  misc_feature (1)..(45): Ceres CLONE ID no. 1070119
  misc_feature (1)..(45): Utility: Useful for delaying flowering time
  misc_feature (1)..(45): Utility: Useful for making smaller plants
MIYDVNSVLFKSFLSSKFSTDKRRGEDKPREQKPKASDNKPVMNE

SEQ ID NO: 5423 - protein, 47 aa, Glycine max
  misc_feature (1)..(47): useful for making plants with modified plant phenotypes as described in USSN 12/139,269
  misc_feature (1)..(47): Ceres CLONE ID no. 553538
  misc_feature (1)..(47): Utility: Useful for delaying flowering time
  misc_feature (1)..(47): Utility: Useful for making smaller plants
MIYDVNSPLFRSFLSQKGGSSDKRKTDEQKPKEQKPKASENKPIMTE

SEQ ID NO: 5424 - protein, 47 aa, Glycine max
  misc_feature (1)..(47): useful for making plants with modified plant phenotypes as described in USSN 12/139,269
  misc_feature (1)..(47): Ceres CLONE ID no. 857804
  misc_feature (1)..(47): Utility: Useful for delaying flowering time
  misc_feature (1)..(47): Utility: Useful for making smaller plants
MIYDVNSPLFRSFLSQKGGSSDKRKSDEQKPKEQKPKASENKPIMTE

SEQ ID NO: 5425 - protein, 46 aa, Zea mays
  misc_feature (1)..(46): useful for making plants with modified plant phenotypes as described in USSN 12/139,269
  misc_feature (1)..(46): Ceres CLONE ID no. 644900
  misc_feature (1)..(46): Utility: Useful for delaying flowering time
  misc_feature (1)..(46): Utility: Useful for making smaller plants
MIYDVNSPLFRSFLSQKGGADKRKMEEHKPKEQRPKANENKPVMNE

SEQ ID NO: 5426 - protein, 46 aa, Zea mays; identical to SEQ ID NO: 5425
  misc_feature (1)..(46): useful for making plants with modified plant phenotypes as described in USSN 12/139,269
  misc_feature (1)..(46): Ceres CLONE ID no. 300291
  misc_feature (1)..(46): Utility: Useful for delaying flowering time
  misc_feature (1)..(46): Utility: Useful for making smaller plants

SEQ ID NO: 5427 - protein, 46 aa, Zea mays; identical to SEQ ID NO: 5425
  misc_feature (1)..(46): useful for making plants with modified plant phenotypes as described in USSN 12/139,269
  misc_feature (1)..(46): Ceres CLONE ID no. 421214
  misc_feature (1)..(46): Utility: Useful for delaying flowering time
  misc_feature (1)..(46): Utility: Useful for making smaller plants

SEQ ID NO: 5428 - protein, 48 aa, Triticum aestivum
  misc_feature (1)..(48): useful for making plants with modified plant phenotypes as described in USSN 12/139,269
  misc_feature (1)..(48): Ceres CLONE ID no. 678746
  misc_feature (1)..(48): Utility: Useful for delaying flowering time
  misc_feature (1)..(48): Utility: Useful for making smaller plants
MIYDVNSPLFRSFLSQKGGASSDKRKMEEQKPKDQRFKANENKPVMNE

SEQ ID NO: 5429 - protein, 48 aa, Triticum aestivum; identical to SEQ ID NO: 5428
  misc_feature (1)..(48): useful for making plants with modified plant phenotypes as described in USSN 12/139,269
  misc_feature (1)..(48): Ceres CLONE ID no. 753703
  misc_feature (1)..(48): Utility: Useful for delaying flowering time
  misc_feature (1)..(48): Utility: Useful for making smaller plants

SEQ ID NO: 5430 - protein, 48 aa, Triticum aestivum; identical to SEQ ID NO: 5428
  misc_feature (1)..(48): useful for making plants with modified plant phenotypes as described in USSN 12/139,269
  misc_feature (1)..(48): Ceres CLONE ID no. 927400
  misc_feature (1)..(48): Utility: Useful for delaying flowering time
  misc_feature (1)..(48): Utility: Useful for making smaller plants

SEQ ID NO: 5431 - protein, 48 aa, Triticum aestivum; identical to SEQ ID NO: 5428
  misc_feature (1)..(48): useful for making plants with modified plant phenotypes as described in USSN 12/139,269
  misc_feature (1)..(48): Ceres CLONE ID no. 1316352
  misc_feature (1)..(48): Utility: Useful for delaying flowering time
  misc_feature (1)..(48): Utility: Useful for making smaller plants

SEQ ID NO: 5432 - protein, 47 aa, Glycine max
  misc_feature (1)..(47): useful for making plants with modified plant phenotypes as described in USSN 12/139,269
  misc_feature (1)..(47): Ceres CLONE ID no. 810742
  misc_feature (1)..(47): Utility: Useful for delaying flowering time
  misc_feature (1)..(47): Utility: Useful for making smaller plants
  misc_feature (6)..(6): Xaa is any aa, unknown or other
MIYDVXSPLFRSFLSQKGGSSDKRKTDEQKPKEQKPKASENKPIMTE

SEQ ID NO: 5433 - protein, 47 aa, Glycine max
  misc_feature (1)..(47): useful for making plants with modified plant phenotypes as described in USSN 12/139,269
  misc_feature (1)..(47): Public GI no. 81888
  misc_feature (1)..(47): Utility: Useful for delaying flowering time
  misc_feature (1)..(47): Utility: Useful for making smaller plants
MIYDVNSPLFRSFLSQKGGSSDKRKTEEQKPKEHRPKASENKPIMTE

SEQ ID NO: 5434 - DNA, 1660 bp, Arabidopsis thaliana
  misc_feature (1)..(1660): useful for making plants with modified plant phenotypes as described in USSN 12/139,269
  misc_feature (1)..(1660): Ceres CLONE ID no. 3699
  misc_feature (1)..(1660): Also known as  Ceres CDNA ID no. 23431464
acccacttcgattaccaactccgaccgccagaggcagcgagtttcagatcaaagatgtcggcgacgcttacaggatcgggaactgctttggggttttcgtgttcctcgaagatctcgaaaagagtttcttcttcaccagcttctaaccgatgctgcatcaagatgtctgtttccgtcgacgagaagaagaaaagtttcagtcttcagaaatctgaggaagctttcaatgctgcttaagaatctaatgcctggaggtgtgaattcccctgttcgagcattcaaatccgttggtggacaacctgttttgattgattcagttaaaggctcaaaaatgtgggacattgatggaaatgagtatattgactacgttggctcttggggaccagctattattggccatgctgatgacgaggttcttgcggctctagctgagacgatgaagaaaggaacaagctttggtgctccttgtctcttagagaatgttttagctgagatggttatatcagctgttcccagcattgaaatggttcggtttgttaattctggtactgaaacgtgtatgggtgtgcttcgtcttgccagagctttcactaacaaagagaagttcattaagtttgaagggtgctatcacggtcatgctaacgccttccttgttaaagctggtagtggtgttgccactttggggctaccggactctccaggtgtccctaaagcagctacttcagatactttaacagctccgtacaatgatcttgaagctgttgagaagctctttgctgcgcataaaggggagatttctgcggtaattctcgaacctgttgttggtaactccggattcattcctcctactccggaattcatcaacggtttacgccagcttactaaagacaatggtgttcttctcatcttcgatgaagtcatgacgggatttcgtctagcctatggtggagcccaagaatactttggaatcacccctgatctaacaactcttggtaaaattattggtgggggtcttcccgtgggagcatacggtggcagacgcgatattatggagatggttgcgcccgctggaccaatgtaccaagccgggactctaagtggtaatccgctggcaatgactgcagggattcacacgctgaagcggctaaagcaggcaggaacatatgagtatttagacaagatcacgaaggaactaaccaacggaatcttagaagccggaaagaaaacagggcatccaatgtgcggcggttacataagcggtatgtttggattctttttcacagaaggaccggtttacaactttgcagatgcaaagaagagcgacacagagaagtttggtaggtttttcaggggaatgttggaagaaggtgtttactttgcaccgtctcagtttgaggccgggtttacgagcttggctcacactcccgaggatatacagttaacaattgctgcggctgagagggtactgagtaggatctagaatgttcccaaccctgagtctagtttcacaatcttcatgttttggggacgatgtgtatggtttgatgagcggatggaataattcttgtgtagtgagttgaattttgtttcatcagtagagcttgagattttttgtattttaagatcatctgttaatgtaatggttttatgttatctcctc

SEQ ID NO: 5435 - protein, 492 aa, Arabidopsis thaliana
  misc_feature (1)..(492): useful for making plants with modified plant phenotypes as described in USSN 12/139,269
  misc_feature (102)..(405): Pfam Name: Aminotran_3; Pfam Description: Aminotransferase class-III
  misc_feature (1)..(492): Utility: Useful for delaying flowering time
  misc_feature (1)..(492): Utility: Useful for making lethal plants for genetic confinement systems
PTSITNSDRQRQRVSDQRCRRRLQDRELLWGFRVPRRSRKEFLLHQLLTDAASRCLFPSTRRRKVSVFRNLRKLSMLLKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTETCMGVLRLARAFTNKEKFIKFEGCYHGHANAFLVKAGSGVATLGLPDSPGVPKAATSDTLTAPYNDLEAVEKLFAAHKGEISAVILEPVVGNSGFIPPTPEFINGLRQLTKDNGVLLIFDEVMTGFRLAYGGAQEYFGITPDLTTLGKIIGGGLPVGAYGGRRDIMEMVAPAGPMYQAGTLSGNPLAMTAGIHTLKRLKQAGTYEYLDKITKELTNGILEAGKKTGHPMCGGYISGMFGFFFTEGPVYNFADAKKSDTEKFGRFFRGMLEEGVYFAPSQFEAGFTSLAHTPEDIQLTIAAAERVLSRI

SEQ ID NO: 5436 - protein, 473 aa, Arabidopsis thaliana
  misc_feature (1)..(473): useful for making plants with modified plant phenotypes as described in USSN 12/139,269
  misc_feature (1)..(473): Public GI no. 28972461
  misc_feature (1)..(473): Utility: Useful for delaying flowering time
  misc_feature (1)..(473): Utility: Useful for making lethal plants for genetic confinement systems
MSATLTGSGTALGFSCSSKISKRVSSSPSTRCSIKMSVSVDEKKKSFTLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTPEFINGLRQLTKDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHPMCGGYISGMFGFFFAEGPVYNFADAKKSDTEKFGKFFRGMLEEGVYFAPSQFEAGFTSLAHTSEDIQFTISAAERVLGRI

SEQ ID NO: 5437 - protein, 473 aa, Brassica napus
  misc_feature (1)..(473): useful for making plants with modified plant phenotypes as described in USSN 12/139,269
  misc_feature (1)..(473): Ceres CLONE ID no. 1039319
  misc_feature (1)..(473): Utility: Useful for delaying flowering time
  misc_feature (1)..(473): Utility: Useful for making lethal plants for genetic confinement systems
MSATLTGSGTALGFSCSSKIPKRVSPSSSNRCSIKMSVSVDEKKKSFTLQKSEEAFNAAKDLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDIEAVAKLFEAHKGEISAVILEPVVGNSGFITPTLEFINGLRQLSRDNGALLIFDEVMTGFRLAYGGAQEYFGITPDLTTLGKIIGGGLPVGAYGGRRDIMEMVAPAGPMYQAGTLSGNPLAMTAGIHTLKRLKQPGTYEYLDKITKELTNGILEAGKKTGHAMCGGYISGMFGFFFTEGPVYNFADAKKSDTEKFGRFFRGMLEEGVYFAPSQFEAGFTSLAHTTEDVQFTIAAAERVLGRI

SEQ ID NO: 5438 - protein, 473 aa, Brassica napus; identical to SEQ ID NO: 5437
  misc_feature (1)..(473): useful for making plants with modified plant phenotypes as described in USSN 12/139,269
  misc_feature (1)..(473): Public GI no. 28972463
  misc_feature (1)..(473): Utility: Useful for delaying flowering time
  misc_feature (1)..(473): Utility: Useful for making lethal plants for genetic confinement systems

SEQ ID NO: 5439 - protein, 438 aa, Arabidopsis thaliana
  misc_feature (1)..(438): useful for making plants with modified plant phenotypes as described in USSN 12/139,269
  misc_feature (1)..(438): Ceres CLONE ID no. 1354315
  misc_feature (1)..(438): Utility: Useful for delaying flowering time
  misc_feature (1)..(438): Utility: Useful for making lethal plants for genetic confinement systems
MSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 5440 - protein, 472 aa, Arabidopsis thaliana
  misc_feature (1)..(472): useful for making plants with modified plant phenotypes as described in USSN 12/139,269
  misc_feature (1)..(472): Public GI no. 6523104
  misc_feature (1)..(472): Utility: Useful for delaying flowering time
  misc_feature (1)..(472): Utility: Useful for making lethal plants for genetic confinement systems
MAATLTGSGIALGFSCSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 5441 - protein, 472 aa, Arabidopsis thaliana
  misc_feature (1)..(472): useful for making plants with modified plant phenotypes as described in USSN 12/139,269
  misc_feature (1)..(472): Public GI no. 498914
  misc_feature (1)..(472): Utility: Useful for delaying flowering time
  misc_feature (1)..(472): Utility: Useful for making lethal plants for genetic confinement systems
MAATLTGSGIALGFSSSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHAKSFLVKAGSGVATLGLPDSPGVPKAATSDTLTAPYNDIAAVEKLFEANKGEIAAIILEPVVGNSGFITPKPEFIEGIRRITKDNGALLILDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 5442 - protein, 481 aa, Arabidopsis thaliana
  misc_feature (1)..(481): useful for making plants with modified plant phenotypes as described in USSN 12/139,269
  misc_feature (1)..(481): Public GI no. 642911
  misc_feature (1)..(481): Utility: Useful for delaying flowering time
  misc_feature (1)..(481): Utility: Useful for making lethal plants for genetic confinement systems
MAAVNGVGLSWPSKLTKNQTPKWGFSPSHRRCNPSSSSSATIRMTASVDEKKKTFTLEKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTCRPKIIKFEGCYHGHADPFLVKAGSGVATLGLPDSPGVPKAATIDTLTAPYNDISAVESLFEEHKGEIAAVILEPVVGNAGFIPPKLEFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGQGTYEHLDKITAELTQGILDAGKKTGHAMCGGSIRGMFGFFFADGPIYNFSDAKKSDTEKFGRFYRGMLEEGVYFAPSQFEAGFTSLAHTPEDIQRTVAAAEKVLKQI

SEQ ID NO: 5443 - protein, 478 aa, Arabidopsis thaliana
  misc_feature (1)..(478): useful for making plants with modified plant phenotypes as described in USSN 12/139,269
  misc_feature (1)..(478): Public GI no. 19875
  misc_feature (1)..(478): Utility: Useful for delaying flowering time
  misc_feature (1)..(478): Utility: Useful for making lethal plants for genetic confinement systems
MAAVNGVGISWPSKLTQSQRPKLVFSPSPRRCTPSSSTIKMTASVDEKKKTFTLQKSEEAFSKAKELMPGGVNSPVRAFKSVGGQPIIIDSVKGSRMRDIDGNDYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGVPKAATTDTLTAPYNDISAVESLFKEHKGEVAAIILEPVVGNAGFIQPNPDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYDYLDKITGELTQGILDAGKKTGHAMCGGYIRGMFGFFFVEGPVNNFSDAKKSDTEKFGRFYRGMLEEGVYFAPSQFEAGFTSLAHTSEDIQRTVAAAEKVLKQI

SEQ ID NO: 5444 - protein, 478 aa, Arabidopsis thaliana
  misc_feature (1)..(478): useful for making plants with modified plant phenotypes as described in USSN 12/139,269
  misc_feature (1)..(478): Public GI no. 19873
  misc_feature (1)..(478): Utility: Useful for delaying flowering time
  misc_feature (1)..(478): Utility: Useful for making lethal plants for genetic confinement systems
MAAVNGVGISWPSKLTQGQRPKLVFSPSPRRCTPSSSTIKMTASVDEKKKTFTLQKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGGPKAATSDTLTAPYNDISAVESLFEEHKGEVAAIILEPVVGNAGFIQPNLDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYEYLDKITGELTQGILDAGKKTGHAMCGGYIRGMFGFLFAEGPVNNFSDAKKSDTEKFGRFYRGMLEEGVYFAPSQFEAGFTSLAHTSEDIQKTVAAAEKVLKQI

SEQ ID NO: 5445 - protein, 473 aa, Zea mays
  misc_feature (1)..(473): useful for making plants with modified plant phenotypes as described in USSN 12/139,269
  misc_feature (1)..(473): Ceres CLONE ID no. 297802
  misc_feature (1)..(473): Utility: Useful for delaying flowering time
  misc_feature (1)..(473): Utility: Useful for making lethal plants for genetic confinement systems
MAGAAAAAVASGVSARPAAPMRASAGRRARLSVVRAAISLEKGEKAYTVQKSEEIFNAAKELMPGGVNSPVRAFKSVGGQPVVFDSVKGSRMWDVDGNEYIDYVGSWGPAIIGHADDKVNAALIETLKKGTSFGAPCLLENVLAEMVISAVPSIEMVRFVNSGTEACMGALRLVRAFTGREKIIKFEGCYHGHADSFLVKAGSGVATLGLPDSPGVPKGATYETLTAPYNDVEAVKKLFEDNAGEIAAVFLEPVVGNAGFIPPQPGFLNALRDLTKQDGALLVFDEVMTGFRLSYGGAQEYFGITPDVTTLGKIIGGGLPVGAYGGRRDIMEMVAPAGPMYQAGTLSGNPLAMTAGIHTLKRLTEPGTYEYLDKITGELVRGILDVGAKAGHDMCGGHIRGMFGFFFTGGPVHNFGDAKKSDTEKFGRFYRGMLEEGVYFAPSQFEAGFTSLAHTSQDIEKTVEAAEKVLKRI

SEQ ID NO: 5446 - protein, 452 aa, Glycine max
  misc_feature (1)..(452): useful for making plants with modified plant phenotypes as described in USSN 12/139,269
  misc_feature (1)..(452): Ceres CLONE ID no. 523191
  misc_feature (1)..(452): Utility: Useful for delaying flowering time
  misc_feature (1)..(452): Utility: Useful for making lethal plants for genetic confinement systems
MSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTEAIEKLFEANKGEIAAVFLEPVVGNAGFIVPKPDFHSFLRKITKENNTLLVFDEVMTGFRLSYGGAQEYFGITPDITTLGKIIGGGLPVGAYGGRRDIMEKVAPAGPMYQAGTLSGNPLAMTAGIETLQRIKEPGTYEYLDKITGELVEGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 5447 - DNA, 528 bp, Arabidopsis thaliana
  misc_feature (1)..(528): useful for making plants with modified plant phenotypes as described in USSN 12/139,269
  misc_feature (1)..(528): Ceres CLONE ID no. 3817
  misc_feature (1)..(528): Also known as  Ceres CDNA ID no. 23366332
  misc_feature (434)..(434): k is g or t/u
  misc_feature (504)..(504): d is a or g or t/u
  misc_feature (518)..(518): k is g or t/u
  misc_feature (523)..(523): w is a or t/u
attcatgttcatcttcgtcgtcttcttctccttcttctttctctgcacctaccaagtcccatacccaagaagaagacatcaacacacaaaccaaagatcaagaatcccaagaaaaagaagatgaagtagttgattcttatcatcatcaagattttaagattagggtttaccttatctctctctactttttcatttagatcggttcttgatcatcatcatcaacatcatcatatgtttgtatcttcatccacgtgtgcgtacgagatccaaaaggggaatcaagcgtctcggtccgatccttcgctgcatcaaagcgatcttcatcttgaaaattaccaaatcaagtgtgtgtgtttttactctttcttttctttttgtgtttctttttcttttgactaccctttgtatttctatttgcttctttttttcttctkccgaatatctcctttttccgatcggtgttttggtctgactgatttagacttatgaatctacatgtatgadcactatatatccckatgtwcttcc

SEQ ID NO: 5448 - protein, 85 aa, Arabidopsis thaliana
  misc_feature (1)..(85): useful for making plants with modified plant phenotypes as described in USSN 12/139,269
  misc_feature (1)..(85): Utility: Useful for delaying flowering time
  misc_feature (1)..(85): Utility: Useful for making larger plants
  misc_feature (1)..(85): Utility: Useful for making ornamental plants with modified leaves
  misc_feature (1)..(85): Utility: Useful for making plants sterile and for genetic confinement
  misc_feature (1)..(85): Utility: Useful for making plants that grow better in shade
  misc_feature (1)..(85): Utility: Useful for making plants with altered leaf shape eg curled leaves
  misc_feature (1)..(85): Utility: Useful for making smaller plants
MFVSSSTCAYEIQKGNQASRSDPSLHQSDLHLENYQIKCVCFYSFFSFCVSFSFDYPLYFYLLLFFFFRISPFSDRCFGLTDLDL

SEQ ID NO: 5449 - DNA, 688 bp, Arabidopsis thaliana
  misc_feature (1)..(688): useful for making plants with modified plant phenotypes as described in USSN 12/139,269
  misc_feature (1)..(688): Ceres CLONE ID no. 3858
  misc_feature (1)..(688): Also known as  Ceres CDNA ID no. 23360607
atcagaaaacaggaataaaagcactcaaaagtcaaagcgcgcgcgcgcacacacacaaaaaaaaacaatccaaagctaattgattcatcaatggcgatgtcgggaacatacgtgacggatgtgcctcttaagggatcggcggagaaacactataagaggtggaggagcgagaaccacctcgtccctgaagctatcggccacctcatccaaggtgtcaccgtccatgacggcgattgggactctcacggcaccatcaaaatctggaactacactcgtgatgggaaagaggaagtattgaaggagaggatagagatggacgacgagaatatggcggtgacgatcaatggactcgatggtcacgtcatggaggtcctcaaggtttatgtcacgacgttacatttcatccccgagtccaaagatggctgcgtctgcaaaattactatggtctgggagaaacgcaccgaagactccccagagcccatcgaattcatgaagttcgtggaacagatgattgctcacatggacgaccacatcctccaaaaccaggaatgatggatcgatgcttaatcatcatcacatcctccttttatttatcttaattaatgtgtgtccatctcgtacatgatattaatatcatcatggtgttgtatatccaacgtttatttataaaagtattgttgttcgtttc

SEQ ID NO: 5450 - protein, 153 aa, Arabidopsis thaliana
  misc_feature (1)..(153): useful for making plants with modified plant phenotypes as described in USSN 12/139,269
  misc_feature (2)..(151): Pfam Name: Bet_v_I; Pfam Description: Pathogenesis-related protein Bet v I family
  misc_feature (1)..(153): Utility: Useful for delaying flowering time
  misc_feature (1)..(153): Utility: Useful for increasing chlorophyll and photosynthetic capacity
  misc_feature (1)..(153): Utility: Useful for making plants with increased biomass
  misc_feature (1)..(153): Utility: Useful for making plants with increased biomass and foliage
  misc_feature (1)..(153): Utility: Useful for making smaller plants
MAMSGTYVTDVPLKGSAEKHYKRWRSENHLVPEAIGHLIQGVTVHDGDWDSHGTIKIWNYTRDGKEEVLKERIEMDDENMAVTINGLDGHVMEVLKVYVTTLHFIPESKDGCVCKITMVWEKRTEDSPEPIEFMKFVEQMIAHMDDHILQNQE

SEQ ID NO: 5451 - protein, 155 aa, Arabidopsis thaliana
  misc_feature (1)..(155): useful for making plants with modified plant phenotypes as described in USSN 12/139,269
  misc_feature (1)..(155): Public GI no. 16191591
  misc_feature (1)..(155): Utility: Useful for delaying flowering time
  misc_feature (1)..(155): Utility: Useful for increasing chlorophyll and photosynthetic capacity
  misc_feature (1)..(155): Utility: Useful for making plants with increased biomass
  misc_feature (1)..(155): Utility: Useful for making plants with increased biomass and foliage
  misc_feature (1)..(155): Utility: Useful for making smaller plants
MAMSGKYVAEVPLKGSAEKHYRRWRSQNNLFPDAIGHHVQGVTVHDGDWDSHGSIKSWNYTLDGKPEVIKEKREIDDEKMALTFRGLEGHVMEKYKKYEVILQFIPKSNEGCVCKVTLIWENRNEDSPEPINYMKFVKSLVADMDDHILKGQNKA

SEQ ID NO: 5452 - protein, 159 aa, Brassica napus
  misc_feature (1)..(159): useful for making plants with modified plant phenotypes as described in USSN 12/139,269
  misc_feature (1)..(159): Ceres CLONE ID no. 1115030
  misc_feature (1)..(159): Utility: Useful for delaying flowering time
  misc_feature (1)..(159): Utility: Useful for increasing chlorophyll and photosynthetic capacity
  misc_feature (1)..(159): Utility: Useful for making plants with increased biomass
  misc_feature (1)..(159): Utility: Useful for making plants with increased biomass and foliage
  misc_feature (1)..(159): Utility: Useful for making smaller plants
  misc_feature (32)..(32): Xaa is any aa, unknown or other
STITTQNKQVEALKQREGEREMATSGTYVTEXPLKGTAEKHYKRWKSENHVFPDAIGHHIQNVTVHEGEHDSHGSIRSWNYTWDGKEEMFKEKREVDDENLTLTLRGLEGHVMEQLKVYDVIYQFIPKTEDTCACKITIVWEKRNDDSPEPSTYMKFVK

SEQ ID NO: 5453 - protein, 151 aa, Brassica napus
  misc_feature (1)..(151): useful for making plants with modified plant phenotypes as described in USSN 12/139,269
  misc_feature (1)..(151): Ceres CLONE ID no. 1079413
  misc_feature (1)..(151): Utility: Useful for delaying flowering time
  misc_feature (1)..(151): Utility: Useful for increasing chlorophyll and photosynthetic capacity
  misc_feature (1)..(151): Utility: Useful for making plants with increased biomass
  misc_feature (1)..(151): Utility: Useful for making plants with increased biomass and foliage
  misc_feature (1)..(151): Utility: Useful for making smaller plants
MATSGTYVTEVPLKGTAEKHYKRWKSENHVFPDAIGHHIQNVTVHEGEHDSHGSIRSWNYTWDGKEEMFKEKREVDDENLTLTLRGLEGHVMEQLKVYDVIYQFIPKTEDTCACKITMIWEKRNDEVPEPSSYMKLVKSMVSEMQEHVHKA

SEQ ID NO: 5454 - protein, 141 aa, Brassica napus
  misc_feature (1)..(141): useful for making plants with modified plant phenotypes as described in USSN 12/139,269
  misc_feature (1)..(141): Public GI no. 31559433
  misc_feature (1)..(141): Utility: Useful for delaying flowering time
  misc_feature (1)..(141): Utility: Useful for increasing chlorophyll and photosynthetic capacity
  misc_feature (1)..(141): Utility: Useful for making plants with increased biomass
  misc_feature (1)..(141): Utility: Useful for making plants with increased biomass and foliage
  misc_feature (1)..(141): Utility: Useful for making smaller plants
MVLAGKLEAEIDINAPADKYYRIFKGQAHHVPNISPGIIQEVNVHEGDWDTHGSIKIWNYTVDGKTEVFKERVEFDDEKRAATLTGVEGSTVLNHSKTFKGTYQVTPKGNGSLAKLTLVYEKVKEDVPDPVKYLALDDWYY

SEQ ID NO: 5455 - protein, 152 aa, Brassica napus
  misc_feature (1)..(152): useful for making plants with modified plant phenotypes as described in USSN 12/139,269
  misc_feature (1)..(152): Public GI no. 33323059
  misc_feature (1)..(152): Utility: Useful for delaying flowering time
  misc_feature (1)..(152): Utility: Useful for increasing chlorophyll and photosynthetic capacity
  misc_feature (1)..(152): Utility: Useful for making plants with increased biomass
  misc_feature (1)..(152): Utility: Useful for making plants with increased biomass and foliage
  misc_feature (1)..(152): Utility: Useful for making smaller plants
MSNLKGKAETVIEIEASPEQYYNIWKQAHHIPNVAGDHIQGVDVHEGDWHSHGGVKSWKYTVDGISGVFKEKVEFDDENKAVILNGLEGDVFKEYKSYKPVYHVLPNPKGKGSLVKLSIEYEKLHEGVSPPDIYVKLMVNISKDLDVHLNKA

SEQ ID NO: 5456 - protein, 170 aa, Glycine max
  misc_feature (1)..(170): useful for making plants with modified plant phenotypes as described in USSN 12/139,269
  misc_feature (1)..(170): Ceres CLONE ID no. 464464
  misc_feature (1)..(170): Utility: Useful for delaying flowering time
  misc_feature (1)..(170): Utility: Useful for increasing chlorophyll and photosynthetic capacity
  misc_feature (1)..(170): Utility: Useful for making plants with increased biomass
  misc_feature (1)..(170): Utility: Useful for making plants with increased biomass and foliage
  misc_feature (1)..(170): Utility: Useful for making smaller plants
LSSLLISLFHFLLLNFLIMSLAGKISIEIGVHASAAKWFNLFATQLHHVQNLTERVHETKLHHGDDWHHNESIKHWTCTIDGKVTTYHESIESVDEPNKTITYKIFGEDIDHQYKVFKVIFQAIHKDHGGAFIKWTIEYERVGEEVDLPFGFIEYLNKGSRDVDGHLLKA

SEQ ID NO: 5457 - protein, 161 aa, Glycine max
  misc_feature (1)..(161): useful for making plants with modified plant phenotypes as described in USSN 12/139,269
  misc_feature (1)..(161): Public GI no. 32165478
  misc_feature (1)..(161): Utility: Useful for delaying flowering time
  misc_feature (1)..(161): Utility: Useful for increasing chlorophyll and photosynthetic capacity
  misc_feature (1)..(161): Utility: Useful for making plants with increased biomass
  misc_feature (1)..(161): Utility: Useful for making plants with increased biomass and foliage
  misc_feature (1)..(161): Utility: Useful for making smaller plants
MVSGTSSTEEVVQVEARRLWNATAKDSHNFLPKVLPEVFTSVTLLQGDGGVGTVKQLNFTPGKKDFSFIKERVDELDEENFVYKYTAIEGGPLGKKLSSACFEVKLVPRKEGGCVAKWTCNYETLPGVQPDEGKFKEIKEDSFGMLKKVEQYLLSNPNLYC

SEQ ID NO: 5458 - protein, 161 aa, Glycine max
  misc_feature (1)..(161): useful for making plants with modified plant phenotypes as described in USSN 12/139,269
  misc_feature (1)..(161): Public GI no. 32165470
  misc_feature (1)..(161): Utility: Useful for delaying flowering time
  misc_feature (1)..(161): Utility: Useful for increasing chlorophyll and photosynthetic capacity
  misc_feature (1)..(161): Utility: Useful for making plants with increased biomass
  misc_feature (1)..(161): Utility: Useful for making plants with increased biomass and foliage
  misc_feature (1)..(161): Utility: Useful for making smaller plants
MVSGTSSTEEVVQVEARRLWNATTKDSHNFLPKVLPEAFTSVTLLQGDGGVGTVKQLNFTPGKKDFSFIKERVDELDEENFVYKYTAIEGGPLGKKLSSACFEVKLVPRKEGGCVAKWTCNYETLPGVQPDEGKFKEIKEDSFGMLKKVEQYLLSNPNLYF

SEQ ID NO: 5459 - protein, 161 aa, Glycine max
  misc_feature (1)..(161): useful for making plants with modified plant phenotypes as described in USSN 12/139,269
  misc_feature (1)..(161): Public GI no. 32165466
  misc_feature (1)..(161): Utility: Useful for delaying flowering time
  misc_feature (1)..(161): Utility: Useful for increasing chlorophyll and photosynthetic capacity
  misc_feature (1)..(161): Utility: Useful for making plants with increased biomass
  misc_feature (1)..(161): Utility: Useful for making plants with increased biomass and foliage
  misc_feature (1)..(161): Utility: Useful for making smaller plants
MVSGTSSTEEVVQVEARRLWNATTKDSHNFLPKVLPGVFTSVTLLQGDGGVGTVKQLNFTPGKKDFSFIKERVDELDEENFVYKYTAIEGGPLGKKLSSACFEVKLVPRKEGGCVAKWTCNYETLPGVQPDEGKFKEIKEDSFGMLKKVEQYLLSNPNLYC

SEQ ID NO: 5460 - protein, 161 aa, Glycine max
  misc_feature (1)..(161): useful for making plants with modified plant phenotypes as described in USSN 12/139,269
  misc_feature (1)..(161): Public GI no. 32165476
  misc_feature (1)..(161): Utility: Useful for delaying flowering time
  misc_feature (1)..(161): Utility: Useful for increasing chlorophyll and photosynthetic capacity
  misc_feature (1)..(161): Utility: Useful for making plants with increased biomass
  misc_feature (1)..(161): Utility: Useful for making plants with increased biomass and foliage
  misc_feature (1)..(161): Utility: Useful for making smaller plants
MVSGTSSTEEVVQVEARRLWNATTKDSHNFLPKVLPEVFTSVTLLQGDGGVGTVKQLNFTPGKKDFSFIKERVDELDEENFVYKYTAIEGGPLGKKLSSACFEVKLVPRKEGGCVAKWTCNYETLPGVQPDEGKFKEIKEDSFGMLKKVEQYLLSNPNLYC

SEQ ID NO: 5461 - protein, 173 aa, Glycine max
  misc_feature (1)..(173): useful for making plants with modified plant phenotypes as described in USSN 12/139,269
  misc_feature (1)..(173): Ceres CLONE ID no. 476943
  misc_feature (1)..(173): Utility: Useful for delaying flowering time
  misc_feature (1)..(173): Utility: Useful for increasing chlorophyll and photosynthetic capacity
  misc_feature (1)..(173): Utility: Useful for making plants with increased biomass
  misc_feature (1)..(173): Utility: Useful for making plants with increased biomass and foliage
  misc_feature (1)..(173): Utility: Useful for making smaller plants
SPIFVCSISCFLLLLLASFFTMSLAGKITTEIGVHATAAKWFNLFATQLHHVQNLTDRVHGTKLHQGEDWHHNETVKHWTYTIDGKATTCLESIESIDEQNKTITYKLFSGDIDHKYKKFKFTFQAIDKDQGGAFIKWTVEYERLAEEVDPPYGYIEYLHKCTKDIDVHLLKA

SEQ ID NO: 5462 - protein, 153 aa, Glycine max
  misc_feature (1)..(153): useful for making plants with modified plant phenotypes as described in USSN 12/139,269
  misc_feature (1)..(153): Ceres CLONE ID no. 641520
  misc_feature (1)..(153): Utility: Useful for delaying flowering time
  misc_feature (1)..(153): Utility: Useful for increasing chlorophyll and photosynthetic capacity
  misc_feature (1)..(153): Utility: Useful for making plants with increased biomass
  misc_feature (1)..(153): Utility: Useful for making plants with increased biomass and foliage
  misc_feature (1)..(153): Utility: Useful for making smaller plants
MSLAGKITTEIGVHATATKWFNLFATQLHHVQNLTDRVHGTKLHQGEDWHHNETVKHWTYTIDGKVTTCLESIESIDEQSKTITYKLFSGDIDHNYKNFKFIFQAIDDNDHGGTIIKWTVEYERLREEVDPPYGHIEYLHKCTKDIDGHLLKA

SEQ ID NO: 5463 - protein, 146 aa, Glycine max
  misc_feature (1)..(146): useful for making plants with modified plant phenotypes as described in USSN 12/139,269
  misc_feature (1)..(146): Public GI no. 256141
  misc_feature (1)..(146): Utility: Useful for delaying flowering time
  misc_feature (1)..(146): Utility: Useful for increasing chlorophyll and photosynthetic capacity
  misc_feature (1)..(146): Utility: Useful for making plants with increased biomass
  misc_feature (1)..(146): Utility: Useful for making plants with increased biomass and foliage
  misc_feature (1)..(146): Utility: Useful for making smaller plants
MGLKGKLIAQIEMKCAGDLLHEHFKSNPHQTSTMSPNKITNFTLHEGQLGSTGSVVSWKFVLGGKERHAKQVLHIDDAKKSITFNFVEGDMNELYKSMTATLTAEGNWMTWTFVYEKLNENIPEPLDIFELAICLLKDLEPHHVGK

SEQ ID NO: 5464 - DNA, 606 bp, Arabidopsis thaliana
  misc_feature (1)..(606): useful for making plants with modified plant phenotypes as described in USSN 12/139,269
  misc_feature (1)..(606): Ceres CLONE ID no. 5597
  misc_feature (1)..(606): Also known as  Ceres CDNA ID no. 23384094
atcttcaccaaattctctcaatcactcaatggcgatttctcaagctcagcctctgcttcttctcctcttatcagtcttcttcttacctgctttgcacgccacttctttcacctactgcgataagaggctcgatcccgttaaggtcacgggtgtgaagatctcccctgaccctgttgtgagtggtgcagccgcaacatttaagatttttggttctactggcgaagacatctctggaggaaaagtagtgatcagggttttatacgttgggattcctgtccataccgaaactcatgacctctgcgatgagacggcatgtccggttgcacctggcagctttgtgctttctcattctcaaacactcccttcaattacaccacctggtacttacacgctaaagatgacaatcaacgacaagaatggcggaagactaacgtgtatcagcttcaaattcaagatcacagtaggttctgcggtctttgctagttaagttttatggtgtaaattgtgtctttgtgaatctctctctcgtttacttttgtggtgtccaaataaagaatgctctttagagacttgagttgatctacatgaaacaaagagtcacaaacc

SEQ ID NO: 5465 - protein, 152 aa, Arabidopsis thaliana
  misc_feature (1)..(152): useful for making plants with modified plant phenotypes as described in USSN 12/139,269
  misc_feature (23)..(143): Pfam Name: E1_DerP2_DerF2; Pfam Description: ML domain
  misc_feature (1)..(152): Utility: Useful for delaying flowering time
  misc_feature (1)..(152): Utility: Useful for increasing chlorophyll and photosynthetic capacity
  misc_feature (1)..(152): Utility: Useful for making larger plants
  misc_feature (1)..(152): Utility: Useful for making plants sterile and for genetic confinement
  misc_feature (1)..(152): Utility: Useful for making stronger plants
  misc_feature (1)..(152): Utility: Useful for making taller plants and plants with longer inflorescences
MAISQAQPLLLLLLSVFFLPALHATSFTYCDKRLDPVKVTGVKISPDPVVSGAAATFKIFGSTGEDISGGKVVIRVLYVGIPVHTETHDLCDETACPVAPGSFVLSHSQTLPSITPPGTYTLKMTINDKNGGRLTCISFKFKITVGSAVFAS

SEQ ID NO: 5466 - protein, 152 aa, Brassica napus
  misc_feature (1)..(152): useful for making plants with modified plant phenotypes as described in USSN 12/139,269
  misc_feature (1)..(152): Ceres CLONE ID no. 970267
  misc_feature (1)..(152): Utility: Useful for delaying flowering time
  misc_feature (1)..(152): Utility: Useful for increasing chlorophyll and photosynthetic capacity
  misc_feature (1)..(152): Utility: Useful for making larger plants
  misc_feature (1)..(152): Utility: Useful for making plants sterile and for genetic confinement
  misc_feature (1)..(152): Utility: Useful for making stronger plants
  misc_feature (1)..(152): Utility: Useful for making taller plants and plants with longer inflorescences
  misc_feature (148)..(148): Xaa is any aa, unknown or other
MAISHAQPLLLLLFSLFLLPSLRATSFHNCDKRLDPVKVTGVEISPDPVVSGKAATFKITGSTDEDISGGEVVISVSLYGVHIHTETHDLCDESSCPIAPGTFVLSHSQTLPSITPPGTYTLKMTINDKNGGRLTCISFKFKITLFSXVSAS

SEQ ID NO: 5467 - protein, 157 aa, Glycine max
  misc_feature (1)..(157): useful for making plants with modified plant phenotypes as described in USSN 12/139,269
  misc_feature (1)..(157): Ceres CLONE ID no. 619936
  misc_feature (1)..(157): Utility: Useful for delaying flowering time
  misc_feature (1)..(157): Utility: Useful for increasing chlorophyll and photosynthetic capacity
  misc_feature (1)..(157): Utility: Useful for making larger plants
  misc_feature (1)..(157): Utility: Useful for making plants sterile and for genetic confinement
  misc_feature (1)..(157): Utility: Useful for making stronger plants
  misc_feature (1)..(157): Utility: Useful for making taller plants and plants with longer inflorescences
MEFQSLSGFYLLLSLTILFLAPFHAQAKIKVTYCDKKADYPVKVSGVEISPDPVESGKPATFKISATSSKAIYGGEVVIGVSYVGVPVHTERIDLCHEVSCPVANGNFLISHTQTLPSITPPGPYSLKMTLKNDRDEVLTCIKFNFKIVFGSFVSDM

SEQ ID NO: 5468 - protein, 156 aa, Glycine max
  misc_feature (1)..(156): useful for making plants with modified plant phenotypes as described in USSN 12/139,269
  misc_feature (1)..(156): Public GI no. 50355738
  misc_feature (1)..(156): Utility: Useful for delaying flowering time
  misc_feature (1)..(156): Utility: Useful for increasing chlorophyll and photosynthetic capacity
  misc_feature (1)..(156): Utility: Useful for making larger plants
  misc_feature (1)..(156): Utility: Useful for making plants sterile and for genetic confinement
  misc_feature (1)..(156): Utility: Useful for making stronger plants
  misc_feature (1)..(156): Utility: Useful for making taller plants and plants with longer inflorescences
MATDHRRFPVFLAAALLTLLLLPASAAATDVEYCRQGRDYPVKVSGVEIVPDPVVSGQPATFKISASTDKSITKGKLVIDVKYFFFHVHSESHNLCEETSCPVTGEFVLAHEQTLPSITPPGSYTLTMRLLDDGNKELTCISFGFSIGFISPLALI

SEQ ID NO: 5469 - protein, 152 aa, Zea mays
  misc_feature (1)..(152): useful for making plants with modified plant phenotypes as described in USSN 12/139,269
  misc_feature (1)..(152): Ceres CLONE ID no. 504766
  misc_feature (1)..(152): Utility: Useful for delaying flowering time
  misc_feature (1)..(152): Utility: Useful for increasing chlorophyll and photosynthetic capacity
  misc_feature (1)..(152): Utility: Useful for making larger plants
  misc_feature (1)..(152): Utility: Useful for making plants sterile and for genetic confinement
  misc_feature (1)..(152): Utility: Useful for making stronger plants
  misc_feature (1)..(152): Utility: Useful for making taller plants and plants with longer inflorescences
MAAKHLNLFAAALLLLLLPSGSSATAVEYCKKGWDYPVKVSSVEVVPDPVVRGQPATFKISASTDKNITKGKLTIDVAYFIFHVHSETHNLCDETSCPVTGEFVLASQQTLPSFTPPGSYTLTMKLLGDSNEELTCISFGFSIGFVAPNPVI

SEQ ID NO: 5470 - protein, 155 aa, Triticum aestivum
  misc_feature (1)..(155): useful for making plants with modified plant phenotypes as described in USSN 12/139,269
  misc_feature (1)..(155): Ceres CLONE ID no. 618484
  misc_feature (1)..(155): Utility: Useful for delaying flowering time
  misc_feature (1)..(155): Utility: Useful for increasing chlorophyll and photosynthetic capacity
  misc_feature (1)..(155): Utility: Useful for making larger plants
  misc_feature (1)..(155): Utility: Useful for making plants sterile and for genetic confinement
  misc_feature (1)..(155): Utility: Useful for making stronger plants
  misc_feature (1)..(155): Utility: Useful for making taller plants and plants with longer inflorescences
MATKQSLLAAAAVCLLLLLPLPAAYAVTDVEYCNKGKNYPVKVSGVEIVPDPVERGVPATFKISATTDKNITEGKLVIDVKYWIFNVYSETDDICTKTQCPATSDFELSHSQTLPSITPPGSYTIQMKMLGKHDEELSCISFGFNIGFLAPVALS

SEQ ID NO: 5471 - protein, 157 aa, Parthenium argentatum
  misc_feature (1)..(157): useful for making plants with modified plant phenotypes as described in USSN 12/139,269
  misc_feature (1)..(157): Ceres CLONE ID no. 1610116
  misc_feature (1)..(157): Utility: Useful for delaying flowering time
  misc_feature (1)..(157): Utility: Useful for increasing chlorophyll and photosynthetic capacity
  misc_feature (1)..(157): Utility: Useful for making larger plants
  misc_feature (1)..(157): Utility: Useful for making plants sterile and for genetic confinement
  misc_feature (1)..(157): Utility: Useful for making stronger plants
  misc_feature (1)..(157): Utility: Useful for making taller plants and plants with longer inflorescences
  misc_feature (64)..(64): Xaa is any aa, unknown or other
  misc_feature (65)..(65): Xaa is any aa, unknown or other
  misc_feature (110)..(110): Xaa is any aa, unknown or other
  misc_feature (111)..(111): Xaa is any aa, unknown or other
MAGFQSKLLVVFLCSLHLIAPLTHAIDVKYCNKKNNYDVKVSGVDITPYPIERGTETTFTISAXXETPISGGNLVIDVSYYWFGVYSETSDLCTKTTCPVATGDFAISHXXSLPSVTPPGSYTLTMKLQDSNKNELTCITFDFSIGWYSSEEAVASS

SEQ ID NO: 5472 - DNA, 590 bp, Arabidopsis thaliana
  misc_feature (1)..(590): useful for making plants with modified plant phenotypes as described in USSN 12/139,269
  misc_feature (1)..(590): Ceres CLONE ID no. 5605
  misc_feature (1)..(590): Also known as  Ceres CDNA ID no. 23448926
atctctcgctctttcgattttggagatatttacaggtacgcttgcttttcccttcacaacatcttcttcttcctgctcctctgtttcaaattccgaaaatcagataaaaaatgggagcttcgaaactttccgggatgcaaaagcaagtcttgagtctctacagaggatttctaagagcagctcgttcaagaccaatagaagacaggaagagaatagagatgattgtgtcaacagagttccgccacaactctaaggaggtcgaccgtaagaattttcagtacatcgagtatttgcttcggttaggtactaaacagcttgatcaactcaaaagccctgccatagttagcctctcctcgatcaaggtcgttacatctaaaacctgataccttattttatagcttgttgctctagtgaccatagataacaaagctgaggaaattgattcgttttcctctttttacattgagttatgtatgtatgatgatggatgttcaaggtccattataaaataaagagaattgtgatcacaattgaatatatatatacactttcacacaattatgtgcatctgctaatagtctagagattgc

SEQ ID NO: 5473 - protein, 90 aa, Arabidopsis thaliana
  misc_feature (1)..(90): useful for making plants with modified plant phenotypes as described in USSN 12/139,269
  misc_feature (8)..(74): Pfam Name: Complex1_LYR; Pfam Description: Complex 1 protein (LYR family)
  misc_feature (1)..(90): Utility: Useful for delaying flowering time
  misc_feature (1)..(90): Utility: Useful for making larger plants
  misc_feature (1)..(90): Utility: Useful for making smaller plants
MGASKLSGMQKQVLSLYRGFLRAARSRPIEDRKRIEMIVSTEFRHNSKEVDRKNFQYIEYLLRLGTKQLDQLKSPAIVSLSSIKVVTSKT

SEQ ID NO: 5474 - protein, 76 aa, Brassica napus
  misc_feature (1)..(76): useful for making plants with modified plant phenotypes as described in USSN 12/139,269
  misc_feature (1)..(76): Ceres CLONE ID no. 1040415
  misc_feature (1)..(76): Utility: Useful for delaying flowering time
  misc_feature (1)..(76): Utility: Useful for making larger plants
  misc_feature (1)..(76): Utility: Useful for making smaller plants
MQKQVLSLYRGFLRAARSTEDRKRIQTIVSTEFRKNSKEVDRKNFQYIEYLLRLAHKQLDQLKSPDMVSISSVKIN

SEQ ID NO: 5475 - protein, 79 aa, Brassica napus
  misc_feature (1)..(79): useful for making plants with modified plant phenotypes as described in USSN 12/139,269
  misc_feature (1)..(79): Ceres CLONE ID no. 970237
  misc_feature (1)..(79): Utility: Useful for delaying flowering time
  misc_feature (1)..(79): Utility: Useful for making larger plants
  misc_feature (1)..(79): Utility: Useful for making smaller plants
  misc_feature (71)..(71): Xaa is any aa, unknown or other
MQKQVLSLYRGFLRAARSKPTTEDRKRIETVVSTEFRKNSKEVDRKNFQYIEYLLRLAHKQLDQLKSPDMXSISSVKIN

SEQ ID NO: 5476 - protein, 86 aa, Glycine max
  misc_feature (1)..(86): useful for making plants with modified plant phenotypes as described in USSN 12/139,269
  misc_feature (1)..(86): Ceres CLONE ID no. 599624
  misc_feature (1)..(86): Utility: Useful for delaying flowering time
  misc_feature (1)..(86): Utility: Useful for making larger plants
  misc_feature (1)..(86): Utility: Useful for making smaller plants
MQKQVLSLYRGFLRAARSKSEEERCKIESIISQEFRRNAEDVDRKNFLYIEYLLRRGNKQLDQLKNPGTTGLSSLQLHYSHPSSKG

SEQ ID NO: 5477 - protein, 96 aa, Glycine max
  misc_feature (1)..(96): useful for making plants with modified plant phenotypes as described in USSN 12/139,269
  misc_feature (1)..(96): Public GI no. 50943407
  misc_feature (1)..(96): Utility: Useful for delaying flowering time
  misc_feature (1)..(96): Utility: Useful for making larger plants
  misc_feature (1)..(96): Utility: Useful for making smaller plants
MASRSKLSGIQRQVLALYRGFLRTARLKSPEERHRIESVVSAEFRENARNIDRKNFVYIEYLLRRGKKQLEQLKDPDITGLSTLEINKVYKPLNLK

SEQ ID NO: 5478 - protein, 93 aa, Glycine max
  misc_feature (1)..(93): useful for making plants with modified plant phenotypes as described in USSN 12/139,269
  misc_feature (1)..(93): Public GI no. 50943405
  misc_feature (1)..(93): Utility: Useful for delaying flowering time
  misc_feature (1)..(93): Utility: Useful for making larger plants
  misc_feature (1)..(93): Utility: Useful for making smaller plants
MASRSKLSGIQRQVLALYRGFLRTARLKSPEERHRIESVVSAEFRENARNIDRKNFVYIEYLLRRGKKQLEQLKDPDITGLSTLEINKASSLH

SEQ ID NO: 5479 - protein, 88 aa, Zea mays
  misc_feature (1)..(88): useful for making plants with modified plant phenotypes as described in USSN 12/139,269
  misc_feature (1)..(88): Ceres CLONE ID no. 993322
  misc_feature (1)..(88): Utility: Useful for delaying flowering time
  misc_feature (1)..(88): Utility: Useful for making larger plants
  misc_feature (1)..(88): Utility: Useful for making smaller plants
MASRPKLSGIQKQVLALYRGFLRTARLKAPEERRRIESVVFAEFRDNARSVDRRNFVHIEYLLRRGKKQLEQLKNPDITGLATLVVKK

SEQ ID NO: 5480 - protein, 88 aa, Zea mays; identical to SEQ ID NO: 5479
  misc_feature (1)..(88): useful for making plants with modified plant phenotypes as described in USSN 12/139,269
  misc_feature (1)..(88): Ceres CLONE ID no. 1466290
  misc_feature (1)..(88): Utility: Useful for delaying flowering time
  misc_feature (1)..(88): Utility: Useful for making larger plants
  misc_feature (1)..(88): Utility: Useful for making smaller plants

SEQ ID NO: 5481 - protein, 88 aa, Zea mays
  misc_feature (1)..(88): useful for making plants with modified plant phenotypes as described in USSN 12/139,269
  misc_feature (1)..(88): Ceres CLONE ID no. 229182
  misc_feature (1)..(88): Utility: Useful for delaying flowering time
  misc_feature (1)..(88): Utility: Useful for making larger plants
  misc_feature (1)..(88): Utility: Useful for making smaller plants
MASRPKLSGIQKQVLALYRGFLRTARLKAPEERHRIESVVLAEFRDKAKSVDRRNFIHIEYLLRSGKKQLEQLKNPDITGLATLVVKK

SEQ ID NO: 5482 - protein, 88 aa, Zea mays
  misc_feature (1)..(88): useful for making plants with modified plant phenotypes as described in USSN 12/139,269
  misc_feature (1)..(88): Ceres CLONE ID no. 1398876
  misc_feature (1)..(88): Utility: Useful for delaying flowering time
  misc_feature (1)..(88): Utility: Useful for making larger plants
  misc_feature (1)..(88): Utility: Useful for making smaller plants
MASRPKLSGIQKQVLALYRGFLRTARLKAPEERHRIESVVLAEFRDKARRVDRRNFIHIEYLLRSGKKQLEQLKNPGITGLATLVVKK

SEQ ID NO: 5483 - DNA, 1208 bp, Arabidopsis thaliana
  misc_feature (1)..(1208): useful for making plants with modified plant phenotypes as described in USSN 12/139,269
  misc_feature (1)..(1208): Ceres CLONE ID no. 6685
  misc_feature (1)..(1208): Also known as  Ceres CDNA ID no. 23374073
ataacgaagcggttggaagaagatgaaactgttcgacgcgcactgtcaccttcaagacccgaggattatcaccaaagctcctcagataatcacctccgccgttgcttccggcgtctctgctttcgccgtcaatggagtctccgagaaagattggagtttggtcaaagagatgggagctaaatacccttctgttgttccttgctttgggatccatccatggtatgtagcagagaggagtcctcaatggtttgagacataagagtttctttgagaccactcctactgctgctgttggagaaattggtttggacaaagggtctaagggaagggagattgatttctcagaacaggttaccgtctttcgtcaacagcttgaacttgcaaaggaattgaagaaacctgcgtcagttcattgtgttcgtgcatttggggatctactcgagatattaaaatctgtagggccttttccttctggggtcatgcttcactcgtatttgggttctgctgagatggttcctgaatttgctaagctcggtgcatatttctccttctccggtttccttatgtccatgagtgagaaaaaagccaagaagatgttgaaagcagttccatctgataggatcttattggagacggattcaccagatgcactaccaaaggcagagtcaggttgtctctactttgtagacggagatccttctctacccgaagaaggaaattcagctcaggatcttgattctgcttcatatgataagcctaatgtgtctagtgactcgatgaagttaacaaaggaaacacttaatcacccggctaatattcatatcgtactcggatatgtagcgcagttgttggatatgaagaatgaagaactcgcggaactaagttatcaaaatgctgttcggttattctcttacgaaggttcaaagatacttcttgacagaggtactggtgatgtctctggtcacactcaaaaccagtcaacaacacatgtatcatgagttcttacttcttaagaaatcgtagtgtttctcatcactctattacgagtctttgaatttggactctctcttttttttttctttttttttgaatgtttgaatttggaattattgtactagtgttatagacaatcacacttttctttgtacaaactacaaaggttctgattttgtgtgaaaattaattcagttaatgatgtgattagagcc

SEQ ID NO: 5484 - protein, 172 aa, Arabidopsis thaliana
  misc_feature (1)..(172): useful for making plants with modified plant phenotypes as described in USSN 12/139,269
  misc_feature (1)..(144): Pfam Name: TatD_DNase; Pfam Description: TatD related DNase
  misc_feature (1)..(172): Utility: Useful for delaying flowering time
  misc_feature (1)..(172): Utility: Useful for making plants with increased biomass
  misc_feature (1)..(172): Utility: Useful for making plants with increased biomass and foliage
  misc_feature (1)..(172): Utility: Useful for making smaller plants
MLHSYLGSAEMVPEFAKLGAYFSFSGFLMSMSEKKAKKMLKAVPSDRILLETDSPDALPKAESGCLYFVDGDPSLPEEGNSAQDLDSASYDKPNVSSDSMKLTKETLNHPANIHIVLGYVAQLLDMKNEELAELSYQNAVRLFSYEGSKILLDRGTGDVSGHTQNQSTTHVS

SEQ ID NO: 5485 - protein, 147 aa, Glycine max
  misc_feature (1)..(147): useful for making plants with modified plant phenotypes as described in USSN 12/139,269
  misc_feature (1)..(147): Ceres CLONE ID no. 463486
  misc_feature (1)..(147): Utility: Useful for delaying flowering time
  misc_feature (1)..(147): Utility: Useful for making plants with increased biomass
  misc_feature (1)..(147): Utility: Useful for making plants with increased biomass and foliage
  misc_feature (1)..(147): Utility: Useful for making smaller plants
  misc_feature (141)..(141): Xaa is any aa, unknown or other
MVHEFSKLGAYFSFSGFLMSLKASKAKKMLKMVPPDRILLETDAPDALPMSNIDSLYFVEGDTSLTEELLAQTTTSSTSGSSLGNSSHVLADASMLPKETLNHPANIHNVLDYVASMLEITKEELAELSYQNAVRLLSYEXSKVLQK

SEQ ID NO: 5486 - DNA, 1014 bp, Arabidopsis thaliana; identical to SEQ ID NO: 1683
  misc_feature (1)..(1014): useful for making plants with modified plant phenotypes as described in USSN 12/139,269
  misc_feature (1)..(1014): Ceres CLONE ID no. 8161
  misc_feature (1)..(1014): Also known as  Ceres CDNA ID no. 23356714

SEQ ID NO: 5487 - protein, 218 aa, Arabidopsis thaliana; identical to SEQ ID NO: 1685
  misc_feature (1)..(218): useful for making plants with modified plant phenotypes as described in USSN 12/139,269
  misc_feature (1)..(218): Utility: Useful for delaying flowering time
  misc_feature (1)..(218): Utility: Useful for making larger plants
  misc_feature (1)..(218): Utility: Useful for making ornamental plants with modified flowers
  misc_feature (1)..(218): Utility: Useful for making ornamental plants with modified leaves
  misc_feature (1)..(218): Utility: Useful for making plants sterile and for genetic confinement
  misc_feature (1)..(218): Utility: Useful for making plants with increased biomass
  misc_feature (1)..(218): Utility: Useful for making plants with increased size and biomass
  misc_feature (1)..(218): Utility: Useful for making shorter plants and plants with modified flowers
  misc_feature (1)..(218): Utility: Useful for making smaller plants
  misc_feature (1)..(218): Utility: Useful for making taller plants and plants with longer inflorescences

SEQ ID NO: 5488 - DNA, 914 bp, Arabidopsis thaliana
  misc_feature (1)..(914): useful for making plants with modified plant phenotypes as described in USSN 12/139,269
  misc_feature (1)..(914): Ceres CLONE ID no. 8265
  misc_feature (1)..(914): Also known as  Ceres CDNA ID no. 23383100
tcgcatcactctttcaaagcctcgtgtcttgatttctttcaccaaactcatataatcacatatctctccaagttcatcaagaaaataatataaacacacacatacaagaactgaagaatgagcagacccggagattggaactgcaggtcatgcagccatctcaacttccagcgccgtgactcttgccagcgatgcggtgactctcgttccggccccggtggagttggtggcttagactttggtaatttcggtggcagagccatgtctgttttcggattcaccaccggctccgacgttcgtcccggtgattggtactgcaccgtgggaaactgcgggacacacaacttcgccagtcgctccacctgcttcaaatgcggcactttcaaggacgagaccggcgctggaggcggaggtggtggcatcggcggtccggccatgtttgacgccgacattatgcggtctagagtccccggtaacggtggtcgctctagctggaaatccggcgactggatttgcactaggattggttgcaatgagcataactttgcaagcagaatggaatgcttcaggtgcaatgcaccaagggacttcagcaacagaacctctttctaagttatacaaactgcttttgaagtagccttgtctccaatttcttaggcaccgtttcgatcaatggaaaggagaagcaggagcaaaagagagaattaaaagatgataattttgttagatgttgcaatgagagccaatattgtaactttagctgtcgtgcttttggatgtattatccatttttattaagatttcttttcattttctccttaattcgtaatttttcttttgcagtttctttttaagagttttattattctaatcattgtacgctgcatgtctttcttaaaagaagattctcttcgc

SEQ ID NO: 5489 - protein, 164 aa, Arabidopsis thaliana
  misc_feature (1)..(164): useful for making plants with modified plant phenotypes as described in USSN 12/139,269
  misc_feature (3)..(32): Pfam Name: zf-RanBP; Pfam Description: Zn-finger in Ran binding protein and others
  misc_feature (1)..(164): Utility: Useful for delaying flowering time
  misc_feature (1)..(164): Utility: Useful for increasing chlorophyll and photosynthetic capacity
  misc_feature (1)..(164): Utility: Useful for making larger plants
  misc_feature (1)..(164): Utility: Useful for making ornamental plants with modified flowers
  misc_feature (1)..(164): Utility: Useful for making ornamental plants with modified leaves
  misc_feature (1)..(164): Utility: Useful for making plants sterile and for genetic confinement
  misc_feature (1)..(164): Utility: Useful for making plants with increased biomass and foliage
  misc_feature (1)..(164): Utility: Useful for making smaller plants
  misc_feature (1)..(164): Utility: Useful for making stronger plants
MSRPGDWNCRSCSHLNFQRRDSCQRCGDSRSGPGGVGGLDFGNFGGRAMSVFGFTTGSDVRPGDWYCTVGNCGTHNFASRSTCFKCGTFKDETGAGGGGGGIGGPAMFDADIMRSRVPGNGGRSSWKSGDWICTRIGCNEHNFASRMECFRCNAPRDFSNRTSF

SEQ ID NO: 5490 - protein, 146 aa, Glycine max
  misc_feature (1)..(146): useful for making plants with modified plant phenotypes as described in USSN 12/139,269
  misc_feature (1)..(146): Ceres CLONE ID no. 540561
  misc_feature (1)..(146): Utility: Useful for delaying flowering time
  misc_feature (1)..(146): Utility: Useful for increasing chlorophyll and photosynthetic capacity
  misc_feature (1)..(146): Utility: Useful for making larger plants
  misc_feature (1)..(146): Utility: Useful for making ornamental plants with modified flowers
  misc_feature (1)..(146): Utility: Useful for making ornamental plants with modified leaves
  misc_feature (1)..(146): Utility: Useful for making plants sterile and for genetic confinement
  misc_feature (1)..(146): Utility: Useful for making plants with increased biomass and foliage
  misc_feature (1)..(146): Utility: Useful for making smaller plants
  misc_feature (1)..(146): Utility: Useful for making stronger plants
MSRPGDWNCRSCQHLNFQRRDSCQRCGDSKYGDRVVDFGGFGGRGGSSFGLTGSDVRPGDWYCAAANCGAHNFASRSSCFKCGAFKDDLAGGGYNSSDILRSRAFGGSGRPGWKSGDWICSRSGCNEHNFASRMECFKCSAPRDTY

SEQ ID NO: 5491 - protein, 166 aa, Glycine max
  misc_feature (1)..(166): useful for making plants with modified plant phenotypes as described in USSN 12/139,269
  misc_feature (1)..(166): Public GI no. 50906111
  misc_feature (1)..(166): Utility: Useful for delaying flowering time
  misc_feature (1)..(166): Utility: Useful for increasing chlorophyll and photosynthetic capacity
  misc_feature (1)..(166): Utility: Useful for making larger plants
  misc_feature (1)..(166): Utility: Useful for making ornamental plants with modified flowers
  misc_feature (1)..(166): Utility: Useful for making ornamental plants with modified leaves
  misc_feature (1)..(166): Utility: Useful for making plants sterile and for genetic confinement
  misc_feature (1)..(166): Utility: Useful for making plants with increased biomass and foliage
  misc_feature (1)..(166): Utility: Useful for making smaller plants
  misc_feature (1)..(166): Utility: Useful for making stronger plants
MNRKPGDWDCRACQHLNFSRRDLCQRCGEPRGAADRGSGGGGDYANFGGRGGSSFGGGFGTGSDVRPGDWYCNCGAHNFASRSSCFKCAAFKDDAAVNSGGAGAFDGGDMSRSRGYGFGSGAVRASRPGWKSGDWICTRSGCNEHNFASRMECFRCNAPRDSGTEV

SEQ ID NO: 5492 - protein, 182 aa, Zea mays
  misc_feature (1)..(182): useful for making plants with modified plant phenotypes as described in USSN 12/139,269
  misc_feature (1)..(182): Ceres CLONE ID no. 1560255
  misc_feature (1)..(182): Utility: Useful for delaying flowering time
  misc_feature (1)..(182): Utility: Useful for increasing chlorophyll and photosynthetic capacity
  misc_feature (1)..(182): Utility: Useful for making larger plants
  misc_feature (1)..(182): Utility: Useful for making ornamental plants with modified flowers
  misc_feature (1)..(182): Utility: Useful for making ornamental plants with modified leaves
  misc_feature (1)..(182): Utility: Useful for making plants sterile and for genetic confinement
  misc_feature (1)..(182): Utility: Useful for making plants with increased biomass and foliage
  misc_feature (1)..(182): Utility: Useful for making smaller plants
  misc_feature (1)..(182): Utility: Useful for making stronger plants
MNRKPGDWDCRACQHLNFSRRDICQRCSEPRGVADRGGGGGGGDYASFGGRGGSSFGGGFGAAGSDVRPGDWYCSCGAHNFASRSSCFKCSAYKEEAAVNSGAGGFDGDMSRSRGYGFGSGAAGAGAGAARTTNRPGWKSGDWICTRSGCNEHNFASRMECFRCNAPRDSGSAAMTYENYLH

SEQ ID NO: 5493 - protein, 145 aa, Zea mays
  misc_feature (1)..(145): useful for making plants with modified plant phenotypes as described in USSN 12/139,269
  misc_feature (1)..(145): Public GI no. 5679336
  misc_feature (1)..(145): Utility: Useful for delaying flowering time
  misc_feature (1)..(145): Utility: Useful for increasing chlorophyll and photosynthetic capacity
  misc_feature (1)..(145): Utility: Useful for making larger plants
  misc_feature (1)..(145): Utility: Useful for making ornamental plants with modified flowers
  misc_feature (1)..(145): Utility: Useful for making ornamental plants with modified leaves
  misc_feature (1)..(145): Utility: Useful for making plants sterile and for genetic confinement
  misc_feature (1)..(145): Utility: Useful for making plants with increased biomass and foliage
  misc_feature (1)..(145): Utility: Useful for making smaller plants
  misc_feature (1)..(145): Utility: Useful for making stronger plants
MNIQRKPGDWNCKSCQHLNFSRRDYCQRCHTPRQDLPLGDGYVPGGVLSSLDIRPGDWYCNCGYHNFASRASCFKCGAIVKDLPAGQGGGVANGDFARALDSSAVRAGWKAGDWICTRPGCNVHNFASRIECYRCNAPREAGNVK

SEQ ID NO: 5494 - DNA, 960 bp, Arabidopsis thaliana; identical to SEQ ID NO: 2889
  misc_feature (1)..(960): useful for making plants with modified plant phenotypes as described in USSN 12/139,269
  misc_feature (1)..(960): Ceres CLONE ID no. 8490
  misc_feature (1)..(960): Also known as  Ceres CDNA ID no. 23371594

SEQ ID NO: 5495 - protein, 246 aa, Arabidopsis thaliana; identical to SEQ ID NO: 1690
  misc_feature (1)..(246): useful for making plants with modified plant phenotypes as described in USSN 12/139,269
  misc_feature (1)..(246): Utility: Useful for delaying flowering time
  misc_feature (1)..(246): Utility: Useful for making plants with increased size and biomass
  misc_feature (1)..(246): Utility: Useful for making taller plants and plants with longer inflorescences

SEQ ID NO: 5496 - protein, 163 aa, Zea mays; identical to SEQ ID NO: 1659
  misc_feature (1)..(163): useful for making plants with modified plant phenotypes as described in USSN 12/139,269
  misc_feature (1)..(163): Ceres CLONE ID no. 305463
  misc_feature (1)..(163): Utility: Useful for delaying flowering time
  misc_feature (1)..(163): Utility: Useful for making plants with increased size and biomass
  misc_feature (1)..(163): Utility: Useful for making taller plants and plants with longer inflorescences

SEQ ID NO: 5497 - protein, 167 aa, Zea mays; identical to SEQ ID NO: 1666
  misc_feature (1)..(167): useful for making plants with modified plant phenotypes as described in USSN 12/139,269
  misc_feature (1)..(167): Ceres CLONE ID no. 258437
  misc_feature (1)..(167): Utility: Useful for delaying flowering time
  misc_feature (1)..(167): Utility: Useful for making plants with increased size and biomass
  misc_feature (1)..(167): Utility: Useful for making taller plants and plants with longer inflorescences

SEQ ID NO: 5498 - protein, 167 aa, Zea mays; identical to SEQ ID NO: 1666
  misc_feature (1)..(167): useful for making plants with modified plant phenotypes as described in USSN 12/139,269
  misc_feature (1)..(167): Ceres CLONE ID no. 219341
  misc_feature (1)..(167): Utility: Useful for delaying flowering time
  misc_feature (1)..(167): Utility: Useful for making plants with increased size and biomass
  misc_feature (1)..(167): Utility: Useful for making taller plants and plants with longer inflorescences

SEQ ID NO: 5499 - protein, 209 aa, Triticum aestivum
  misc_feature (1)..(209): useful for making plants with modified plant phenotypes as described in USSN 12/139,269
  misc_feature (1)..(209): Ceres CLONE ID no. 929917
  misc_feature (1)..(209): Utility: Useful for delaying flowering time
  misc_feature (1)..(209): Utility: Useful for making plants with increased size and biomass
  misc_feature (1)..(209): Utility: Useful for making taller plants and plants with longer inflorescences
MGEVYLGLDRSARPEPEPADVGIAQGNQVTNLVSAGWTDERHTDYISSMEASFINRLFNHGNNANRKDSGTNGFKVLQGGAGVWKKVEFARPGACAQVGAKQSLPANPWIQHFRSRDCSSSSSSARGDGAQTLVGDHESGIRTTPGGTPLSHGRELGACKGENLLDQNSEVSDQNFADDDEAEVGAESSRTCKKRRLSSSSTYCAQTIQ

SEQ ID NO: 5500 - protein, 202 aa, Triticum aestivum
  misc_feature (1)..(202): useful for making plants with modified plant phenotypes as described in USSN 12/139,269
  misc_feature (1)..(202): Ceres CLONE ID no. 923677
  misc_feature (1)..(202): Utility: Useful for delaying flowering time
  misc_feature (1)..(202): Utility: Useful for making plants with increased size and biomass
  misc_feature (1)..(202): Utility: Useful for making taller plants and plants with longer inflorescences
MGEVYLDRSVKPEPADVGIAQGNQVTTLMSAGWTDERHTDYISSMEASFIKRLYNHGNNVNKKDPGTTGFKVLQGGAGVWKKVEFERPNACAQVGAKQNLPANPWIQHFRSRDCSSSARGVGAQTSVGDHESGIRTVPGSTPLSHGRELGACKGENLLDENTEVSDQNFADDDEAEVGAESSKACKKRRLSSSSTYFTQMIQ

SEQ ID NO: 5501 - DNA, 1063 bp, Arabidopsis thaliana
  misc_feature (1)..(1063): useful for making plants with modified plant phenotypes as described in USSN 12/139,269
  misc_feature (1)..(1063): Ceres CLONE ID no. 8500
  misc_feature (1)..(1063): Also known as  Ceres CDNA ID no. 23357152
atttttcttcagaatctctcaattctcttttgtcgatttcgcagtagaagagtcctttcgccgtctccgagaaactcgttgcagcgtcacgaccagttggagaaaatgtcttctagaggaaaaaggaaagacgaagatgtcagagcatcagatgacgaatctgaaacccacgcgccggctaagaaagtcgcaaagccagcagacgattccgaccagtctgacgatatcgtcgtctgcaacatatctaagaataggagagtctctgtaaggaattggaacgggaagatttggattgacattcgtgagttctatgtcaaggacggaaagactttgcctggcaagaaaggtaactttattttgtaatttaaaccaatgccccttggctctcataattcattatttctagtaatgtgtttcctcatctcttagttttatatttcgttactgttttgctttgttaagtttctgcatttagtcaggtttatagaattgcatatcttagggttttataataggcaattctgcttattgagactgtttatggacttgtaagtatgagcggagatggtgcagagtgtttgcttttgtacaacaacgttttgtttattttggtgctattgctccttcatgtctttctctagagacagctatattagtttatctctacataattaatcatgttgacaagattatctctatgtttgttatacgttgcaggtatctctctaagcgtggatcaggtactcacatctctttctatctctctccactgttttatgtctcctagaagtgtttctgttttcttgttatttgcttattacacagcttttccttaatgcagtggaacactcttcggaaccacgcagaggatatcgagaaggccctctctgacctttcttaggttttaaaacttgtatcattggttgtacgtctattagaatatggctcagttgttttggttgtttttgtagaacaacaccatgttctgctagtgtaagctgcttcaaattagttggtgtatggaatctttcacttttggttcagacaagctttggttggtatt

SEQ ID NO: 5502 - protein, 85 aa, Arabidopsis thaliana
  misc_feature (1)..(85): useful for making plants with modified plant phenotypes as described in USSN 12/139,269
  misc_feature (13)..(81): Pfam Name: PC4; Pfam Description: Transcriptional Coactivator p15 (PC4)
  misc_feature (1)..(85): Utility: Useful for delaying flowering time
  misc_feature (1)..(85): Utility: Useful for making lethal plants for genetic confinement systems
  misc_feature (1)..(85): Utility: Useful for making ornamental plants with modified flowers
  misc_feature (1)..(85): Utility: Useful for making plants sterile and for genetic confinement
  misc_feature (1)..(85): Utility: Useful for making plants with increased biomass and foliage
  misc_feature (1)..(85): Utility: Useful for making smaller plants
  misc_feature (1)..(85): Utility: Useful for making taller plants and plants with longer inflorescences
MSSRGKRKDEDVRASDDESETHAPAKKVAKPADDSDQSDDIVVCNISKNRRVSVRNWNGKIWIDIREFYVKDGKTLPGKKGNFIL

SEQ ID NO: 5503 - DNA, 1002 bp, Arabidopsis thaliana
  misc_feature (1)..(1002): useful for making plants with modified plant phenotypes as described in USSN 12/139,269
  misc_feature (1)..(1002): Ceres CLONE ID no. 9683
  misc_feature (1)..(1002): Also known as  Ceres CDNA ID no. 23387890
attcaatttttggtggtcttttcaaaagtggaaatacaacaaaacaatgtcgggacttagaagattggatggcaagatcgcaattataacaggcggagctagtgggattggagctgaagcggttaggttgttcacggaccatggagctaaagtggtcatcgtggacatacaagaagagcttggccaaaacctcgccgtttcgatagggctagacaaagcaagtttttaccgttgtaatgtaaccgacgagacggatgtcgagaacgccgttaagttcaccgttgaaaaacacggaaagcttgacgttctgtttagtaacgccggggtcttggaagcgtttggaagcgttcttgatttggatcttgaggcgtttgatcgaacgatggcggttaacgttcgcggtgcggctgcgtttatcaaacacgcggcacgttcgatggtggctagtggtactcgtggctccattgtatgtacgacgagtattgcggcagagataggtggtccgggacctcatagttacacggcttctaagcacgcgcttctcgggctgatccgatcagcgtgtgctggactggggcagtacggtattagagtcaacggtgttgcaccgtatggggttgccactgggatgactagcgcctacaatgaggaagcggtgaagatgcttgaagaatatggtgaagccctagggaatctcaaaggtgtggtgcttaaagctcgccacatcgcagaagcagctttgtttttggcttctgatgattcggtttatattagcggtcagaatctggtggttgatggtggttttagcgtcgttaagctcatgagcacgtgagaaacaactaaaaaatgagggcatagactctcttgacactttcattttatttcttgaataaaaattgaatttataagtactttcgatcattgtgttgtatgttaggctcttgagtttatataaaccttgagtttaataatttactttttcttttagtttctcaattctat

SEQ ID NO: 5504 - protein, 261 aa, Arabidopsis thaliana
  misc_feature (1)..(261): useful for making plants with modified plant phenotypes as described in USSN 12/139,269
  misc_feature (10)..(177): Pfam Name: adh_short; Pfam Description: short chain dehydrogenase
  misc_feature (1)..(261): Utility: Useful for delaying flowering time
  misc_feature (1)..(261): Utility: Useful for increasing chlorophyll and photosynthetic capacity
  misc_feature (1)..(261): Utility: Useful for making larger plants
  misc_feature (1)..(261): Utility: Useful for making plants sterile and for genetic confinement
  misc_feature (1)..(261): Utility: Useful for making plants with increased biomass and foliage
  misc_feature (1)..(261): Utility: Useful for making smaller plants
MSGLRRLDGKIAIITGGASGIGAEAVRLFTDHGAKVVIVDIQEELGQNLAVSIGLDKASFYRCNVTDETDVENAVKFTVEKHGKLDVLFSNAGVLEAFGSVLDLDLEAFDRTMAVNVRGAAAFIKHAARSMVASGTRGSIVCTTSIAAEIGGPGPHSYTASKHALLGLIRSACAGLGQYGIRVNGVAPYGVATGMTSAYNEEAVKMLEEYGEALGNLKGVVLKARHIAEAALFLASDDSVYISGQNLVVDGGFSVVKLMST

SEQ ID NO: 5505 - protein, 257 aa, Arabidopsis thaliana
  misc_feature (1)..(257): useful for making plants with modified plant phenotypes as described in USSN 12/139,269
  misc_feature (1)..(257): Public GI no. 17104783
  misc_feature (1)..(257): Utility: Useful for delaying flowering time
  misc_feature (1)..(257): Utility: Useful for increasing chlorophyll and photosynthetic capacity
  misc_feature (1)..(257): Utility: Useful for making larger plants
  misc_feature (1)..(257): Utility: Useful for making plants sterile and for genetic confinement
  misc_feature (1)..(257): Utility: Useful for making plants with increased biomass and foliage
  misc_feature (1)..(257): Utility: Useful for making smaller plants
MSGKRLDGKIVIITGGASGIGAESVRLFTEHGARVVIVDVQDELGQNVAVSIGEDKASYYHCDVTNETEVENAVKFTVEKYGKLDVLFSNAGVIEPFVSILDLNLNELDRTIAINLRGTAAFIKHAARAMVEKGIRGSIVCTTSVAAEIAGTAPHGYTTSKHGLLGLIKSASGGLGKYGIRVNGVAPFGVATPLVCNGFKMEPNVVEQNTSASANLKGIVLKARHVAEAALFLASDESAYVSGQNLAVDGGYSVVKP

SEQ ID NO: 5506 - protein, 275 aa, Glycine max
  misc_feature (1)..(275): useful for making plants with modified plant phenotypes as described in USSN 12/139,269
  misc_feature (1)..(275): Ceres CLONE ID no. 605144
  misc_feature (1)..(275): Utility: Useful for delaying flowering time
  misc_feature (1)..(275): Utility: Useful for increasing chlorophyll and photosynthetic capacity
  misc_feature (1)..(275): Utility: Useful for making larger plants
  misc_feature (1)..(275): Utility: Useful for making plants sterile and for genetic confinement
  misc_feature (1)..(275): Utility: Useful for making plants with increased biomass and foliage
  misc_feature (1)..(275): Utility: Useful for making smaller plants
  misc_feature (227)..(227): Xaa is any aa, unknown or other
MATSTSALNKRLEGKVALITGGASGIGKRTAEVFAQQGAKVVIADIQDELGHSVAQSIGPSTCCYVHCDVTDENQIKNAVQKAVDAYGKLDIMFNNAGIVDPNKNRIIDNDKADFERVLSVNVTGVFLGMKHAAQAMIPARSGSIISTASISSYVGGAASHAYCCAKHAVVGLTKNAAVELGQFGIRVNCLSPYALATPLATKFVGANDEELETIMNSLANLKGVTXKAEDVANAALYFASDDSRYVSGQNLLIDGGFSIVNPSFHMFQYPDSES

SEQ ID NO: 5507 - DNA, 600 bp, Arabidopsis thaliana
  misc_feature (1)..(600): useful for making plants with modified plant phenotypes as described in USSN 12/139,269
  misc_feature (1)..(600): Ceres CLONE ID no. 9897
  misc_feature (1)..(600): Also known as  Ceres CDNA ID no. 23386145
atataaaccctctcggcgctgccattgaaactctttcaaggagagagctgctactctgcaaccatgtcgaagcgaggaagaggaggaacctctggtaacaagttcaggatgtcactgggtcttccagtggcagccactgtgaactgtgctgacaacaccggagctaagaacctttacatcatttcggttaaaggaatcaagggtcgtcttaaccgtttgccatcagcttgtgttggtgatatggttatggctactgttaagaaaggtaagcctgatctccgtaagaaggtgcttcctgctgtcattgttaggcagaggaagccttggcgccgaaaggacggtgtcttcatgtatttcgaagataatgctggtgtcattgtcaatcccaagggtgatatgaaaggatctgctatcactggaccaatcggaaaggagtgtgctgatctgtggccaagaatcgcaagtgctgcgaacgccatcgtttaagcaagcttgagatctctatgttttgtgttgaacgtttagcattatctctatttgggattgttttttgtttttgtcttagacttttgttatgccttaaagctgattctagttctc

SEQ ID NO: 5508 - protein, 140 aa, Arabidopsis thaliana
  misc_feature (1)..(140): useful for making plants with modified plant phenotypes as described in USSN 12/139,269
  misc_feature (19)..(140): Pfam Name: Ribosomal_L14; Pfam Description: Ribosomal protein L14p/L23e
  misc_feature (1)..(140): Utility: Useful for delaying flowering time
  misc_feature (1)..(140): Utility: Useful for increasing chlorophyll and photosynthetic capacity
  misc_feature (1)..(140): Utility: Useful for increasing seed/fruit yield or modifying fruit content
  misc_feature (1)..(140): Utility: Useful for making ornamental plants with modified leaves
  misc_feature (1)..(140): Utility: Useful for making plants sterile and for genetic confinement
  misc_feature (1)..(140): Utility: Useful for making plants with increased biomass and foliage
  misc_feature (1)..(140): Utility: Useful for making smaller plants
MSKRGRGGTSGNKFRMSLGLPVAATVNCADNTGAKNLYIISVKGIKGRLNRLPSACVGDMVMATVKKGKPDLRKKVLPAVIVRQRKPWRRKDGVFMYFEDNAGVIVNPKGDMKGSAITGPIGKECADLWPRIASAANAIV

SEQ ID NO: 5509 - protein, 140 aa, Brassica napus
  misc_feature (1)..(140): useful for making plants with modified plant phenotypes as described in USSN 12/139,269
  misc_feature (1)..(140): Ceres CLONE ID no. 1083013
  misc_feature (1)..(140): Utility: Useful for delaying flowering time
  misc_feature (1)..(140): Utility: Useful for increasing chlorophyll and photosynthetic capacity
  misc_feature (1)..(140): Utility: Useful for increasing seed/fruit yield or modifying fruit content
  misc_feature (1)..(140): Utility: Useful for making ornamental plants with modified leaves
  misc_feature (1)..(140): Utility: Useful for making plants sterile and for genetic confinement
  misc_feature (1)..(140): Utility: Useful for making plants with increased biomass and foliage
  misc_feature (1)..(140): Utility: Useful for making smaller plants
MSKRGRGGTSGNKFRMSLGLPVAATVNCADNTGAKNLYIISVKGIKGRLNRLPSACVGDMVMATVKKGKPDLRKKVMPAVIVRQRKPWRRKDGVFMYFEDNAGVIVNPKGEMKGSAITGPIGKECADLWPRIASAANAIV

SEQ ID NO: 5510 - protein, 140 aa, Brassica napus
  misc_feature (1)..(140): useful for making plants with modified plant phenotypes as described in USSN 12/139,269
  misc_feature (1)..(140): Public GI no. 13430182
  misc_feature (1)..(140): Utility: Useful for delaying flowering time
  misc_feature (1)..(140): Utility: Useful for increasing chlorophyll and photosynthetic capacity
  misc_feature (1)..(140): Utility: Useful for increasing seed/fruit yield or modifying fruit content
  misc_feature (1)..(140): Utility: Useful for making ornamental plants with modified leaves
  misc_feature (1)..(140): Utility: Useful for making plants sterile and for genetic confinement
  misc_feature (1)..(140): Utility: Useful for making plants with increased biomass and foliage
  misc_feature (1)..(140): Utility: Useful for making smaller plants
MSKRGRGGSAGNKFRMSLGLPVAATVNCADNTGAKNLYIISVKGIKGRLNRLPSACVGDMVMATVKKGKPDLRKKVLPAVIVRQRKPWRRKDGVFMYFEDNAGVIVNPKGEMKGSAITGPIGKECADLWPRIASAANAIV

SEQ ID NO: 5511 - protein, 140 aa, Triticum aestivum
  misc_feature (1)..(140): useful for making plants with modified plant phenotypes as described in USSN 12/139,269
  misc_feature (1)..(140): Ceres CLONE ID no. 568627
  misc_feature (1)..(140): Utility: Useful for delaying flowering time
  misc_feature (1)..(140): Utility: Useful for increasing chlorophyll and photosynthetic capacity
  misc_feature (1)..(140): Utility: Useful for increasing seed/fruit yield or modifying fruit content
  misc_feature (1)..(140): Utility: Useful for making ornamental plants with modified leaves
  misc_feature (1)..(140): Utility: Useful for making plants sterile and for genetic confinement
  misc_feature (1)..(140): Utility: Useful for making plants with increased biomass and foliage
  misc_feature (1)..(140): Utility: Useful for making smaller plants
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVFMYFEDNAGVIVNPKGEMKGSAITGPIGKECADLWPRIASAANAIV

SEQ ID NO: 5512 - protein, 140 aa, Glycine max; identical to SEQ ID NO: 5511
  misc_feature (1)..(140): useful for making plants with modified plant phenotypes as described in USSN 12/139,269
  misc_feature (1)..(140): Ceres CLONE ID no. 1073644
  misc_feature (1)..(140): Utility: Useful for delaying flowering time
  misc_feature (1)..(140): Utility: Useful for increasing chlorophyll and photosynthetic capacity
  misc_feature (1)..(140): Utility: Useful for increasing seed/fruit yield or modifying fruit content
  misc_feature (1)..(140): Utility: Useful for making ornamental plants with modified leaves
  misc_feature (1)..(140): Utility: Useful for making plants sterile and for genetic confinement
  misc_feature (1)..(140): Utility: Useful for making plants with increased biomass and foliage
  misc_feature (1)..(140): Utility: Useful for making smaller plants

SEQ ID NO: 5513 - protein, 140 aa, Zea mays; identical to SEQ ID NO: 5511
  misc_feature (1)..(140): useful for making plants with modified plant phenotypes as described in USSN 12/139,269
  misc_feature (1)..(140): Ceres CLONE ID no. 1447299
  misc_feature (1)..(140): Utility: Useful for delaying flowering time
  misc_feature (1)..(140): Utility: Useful for increasing chlorophyll and photosynthetic capacity
  misc_feature (1)..(140): Utility: Useful for increasing seed/fruit yield or modifying fruit content
  misc_feature (1)..(140): Utility: Useful for making ornamental plants with modified leaves
  misc_feature (1)..(140): Utility: Useful for making plants sterile and for genetic confinement
  misc_feature (1)..(140): Utility: Useful for making plants with increased biomass and foliage
  misc_feature (1)..(140): Utility: Useful for making smaller plants

SEQ ID NO: 5514 - protein, 140 aa, Parthenium argentatum; identical to SEQ ID NO: 5511
  misc_feature (1)..(140): useful for making plants with modified plant phenotypes as described in USSN 12/139,269
  misc_feature (1)..(140): Ceres CLONE ID no. 1605872
  misc_feature (1)..(140): Utility: Useful for delaying flowering time
  misc_feature (1)..(140): Utility: Useful for increasing chlorophyll and photosynthetic capacity
  misc_feature (1)..(140): Utility: Useful for increasing seed/fruit yield or modifying fruit content
  misc_feature (1)..(140): Utility: Useful for making ornamental plants with modified leaves
  misc_feature (1)..(140): Utility: Useful for making plants sterile and for genetic confinement
  misc_feature (1)..(140): Utility: Useful for making plants with increased biomass and foliage
  misc_feature (1)..(140): Utility: Useful for making smaller plants

SEQ ID NO: 5515 - DNA, 1533 bp, Arabidopsis thaliana
  misc_feature (1)..(1533): useful for making plants with modified plant phenotypes as described in USSN 12/139,269
  misc_feature (1)..(1533): Ceres CLONE ID no. 12272
  misc_feature (1)..(1533): Also known as  Ceres CDNA ID no. 23359650
aaaaaaagctttgaaattctctctcgacaatggtgtcggaccaggatctagcgaaaggagtcgagactttgcttcgacaatccgaccctagctctctcacatcgttaagcagtattgttcagcagcttgaagctaagttagggttagacctcacggagaagacgactttcatcagagatcagatcaatatcctcctccgtgctcaccaaaacccttctgcctccgtcgcctccgcttcatccgtacaacaatctcaccctcctcctccgccgtcttctcaccagcagcagaatttgcattccggcgtcaatgttcctccgatggcgaaagggcatttcacacttagccatccttcgcaattctctgtttcttctcaatcacaacaatatccttcacatttcgctcttcagcctccttatcactcttatgacctaaatttccggcagccttatccggtttacatgccgccgcaacagcaccagcatcagcagcagtctccgcgacaacaacaatcctctgtgatgctctcacatggcgggaatgcttctctatctgttaatcaagccccaaaagaaagtgctccggctggaactaaaagaaagggtggtcctggaggactaaacaaagtctgtagggtttctccagaacttgaagtagttgttggtgaacctgctcttcctagaactgagattgtgaggcaattgtgggcttatataaggaagaataaccttcaagacccgagtaacaagcggaagatcatctgtgatgatgcgttgcgtgtggtttttgagactgattgcactgacatgttcaagatgaataagttgcttgctaagcatattctcccgcttgatccatcaaaggactctggtcaagcaaaaaaggcaaaaactgaggtggagactaagactgagaccaccgagcctgttagttcaactgctattagttcaactgttacattatctgagccacttggtaagttctttggcactggtgagacggagatggcagacgaagagattattcgccgtgtttgggaatacataaaactcaacaatttagaggacccagtaaatccaatggctattcagtgtgatgaaaagctccgagatcttcttggatgtgaaagcatttcagctgtggggataaatgagatgctgaggcgccatatgtacaagcagtcgtgatatcttctggtctgacttaattaactaggaactactagtgtgtgtatctagggaacctacttatgactccttgctgtagaactctgatagggaagaaaagatcctttttcacttttaacttcctttaatgctattttaatcttccgttgggttctttgttttagttggttgtgtatcgacatgcttaggttgatgttgtatttagtattgtaccgaaactctagtgttaagggtgaaacggcgcagatgttttgtattaaacgccattcacccatgaatgtcttaggaaaaaaaaactcatgtgtttaactatgttttccctgttggaaatatttgcatcctactg

SEQ ID NO: 5516 - protein, 385 aa, Arabidopsis thaliana
  misc_feature (1)..(385): useful for making plants with modified plant phenotypes as described in USSN 12/139,269
  misc_feature (197)..(272): Pfam Name: SWIB; Pfam Description: SWIB/MDM2 domain
  misc_feature (1)..(385): Utility: Useful for delaying flowering time
  misc_feature (1)..(385): Utility: Useful for making larger plants
  misc_feature (1)..(385): Utility: Useful for making ornamental plants with modified leaves
  misc_feature (1)..(385): Utility: Useful for making plants with altered leaf shape eg curled leaves
  misc_feature (1)..(385): Utility: Useful for making plants with enhanced abiotic stress tolerance
  misc_feature (1)..(385): Utility: Useful for making plants with increased biomass
  misc_feature (1)..(385): Utility: Useful for making plants with increased biomass and foliage
  misc_feature (1)..(385): Utility: Useful for making smaller plants
MVSDQDLAKGVETLLRQSDPSSLTSLSSIVQQLEAKLGLDLTEKTTFIRDQINILLRAHQNPSASVASASSVQQSHPPPPPSSHQQQNLHSGVNVPPMAKGHFTLSHPSQFSVSSQSQQYPSHFALQPPYHSYDLNFRQPYPVYMPPQQHQHQQQSPRQQQSSVMLSHGGNASLSVNQAPKESAPAGTKRKGGPGGLNKVCRVSPELEVVVGEPALPRTEIVRQLWAYIRKNNLQDPSNKRKIICDDALRVVFETDCTDMFKMNKLLAKHILPLDPSKDSGQAKKAKTEVETKTETTEPVSSTAISSTVTLSEPLGKFFGTGETEMADEEIIRRVWEYIKLNNLEDPVNPMAIQCDEKLRDLLGCESISAVGINEMLRRHMYKQS

SEQ ID NO: 5517 - protein, 329 aa, Glycine max
  misc_feature (1)..(329): useful for making plants with modified plant phenotypes as described in USSN 12/139,269
  misc_feature (1)..(329): Ceres CLONE ID no. 541471
  misc_feature (1)..(329): Utility: Useful for delaying flowering time
  misc_feature (1)..(329): Utility: Useful for making larger plants
  misc_feature (1)..(329): Utility: Useful for making ornamental plants with modified leaves
  misc_feature (1)..(329): Utility: Useful for making plants with altered leaf shape eg curled leaves
  misc_feature (1)..(329): Utility: Useful for making plants with enhanced abiotic stress tolerance
  misc_feature (1)..(329): Utility: Useful for making plants with increased biomass
  misc_feature (1)..(329): Utility: Useful for making plants with increased biomass and foliage
  misc_feature (1)..(329): Utility: Useful for making smaller plants
MVTDQDIAKGVESLLRHSDPNSITTVNGVVQQLEAKLGLDLSHKASFIRDQIDHLLRSQPQTFAPHPPPLHKDYFAPHTQLHFPTTHFAPHFALHDEINFLQHPHPPPPRKVETFPPQNVAPPQVPKESVQTGSKRRGGAGGLNKVCGVSPELQAVVGEPAMPRTEIVRQLWAYIKKNNLQDPGNKRKIICDDALRLVFETDCTDMFKMNQLLAKHIIPLGPTKESQAKRVKVDTEIKTESAEPAPSTVAISEALAKFLGTEGREMQQSEAIRLVWEYIKLHHLEDPLNSMVILCDAKLQELLGCESISALGIPEMLARHHLFKQSDTR

SEQ ID NO: 5518 - protein, 329 aa, Glycine max; identical to SEQ ID NO: 5517
  misc_feature (1)..(329): useful for making plants with modified plant phenotypes as described in USSN 12/139,269
  misc_feature (1)..(329): Ceres CLONE ID no. 528932
  misc_feature (1)..(329): Utility: Useful for delaying flowering time
  misc_feature (1)..(329): Utility: Useful for making larger plants
  misc_feature (1)..(329): Utility: Useful for making ornamental plants with modified leaves
  misc_feature (1)..(329): Utility: Useful for making plants with altered leaf shape eg curled leaves
  misc_feature (1)..(329): Utility: Useful for making plants with enhanced abiotic stress tolerance
  misc_feature (1)..(329): Utility: Useful for making plants with increased biomass
  misc_feature (1)..(329): Utility: Useful for making plants with increased biomass and foliage
  misc_feature (1)..(329): Utility: Useful for making smaller plants

SEQ ID NO: 5519 - protein, 128 aa, Glycine max
  misc_feature (1)..(128): useful for making plants with modified plant phenotypes as described in USSN 12/139,269
  misc_feature (1)..(128): Ceres CLONE ID no. 855912
  misc_feature (1)..(128): Utility: Useful for delaying flowering time
  misc_feature (1)..(128): Utility: Useful for making larger plants
  misc_feature (1)..(128): Utility: Useful for making ornamental plants with modified leaves
  misc_feature (1)..(128): Utility: Useful for making plants with altered leaf shape eg curled leaves
  misc_feature (1)..(128): Utility: Useful for making plants with enhanced abiotic stress tolerance
  misc_feature (1)..(128): Utility: Useful for making plants with increased biomass
  misc_feature (1)..(128): Utility: Useful for making plants with increased biomass and foliage
  misc_feature (1)..(128): Utility: Useful for making smaller plants
MVTDQDIAKGVESLLRHSDPNSITTVNGVVQQLEAKLGLDLSHKASFIRDQIDHLLRSQPQAFVPHPPPLHKDYFAPHPQPHFPTTHFPSHFALHDEINFQQHPRAPPPCKVETFPPQNAHTVAPPQV

SEQ ID NO: 5520 - protein, 330 aa, Glycine max
  misc_feature (1)..(330): useful for making plants with modified plant phenotypes as described in USSN 12/139,269
  misc_feature (1)..(330): Ceres CLONE ID no. 563093
  misc_feature (1)..(330): Utility: Useful for delaying flowering time
  misc_feature (1)..(330): Utility: Useful for making larger plants
  misc_feature (1)..(330): Utility: Useful for making ornamental plants with modified leaves
  misc_feature (1)..(330): Utility: Useful for making plants with altered leaf shape eg curled leaves
  misc_feature (1)..(330): Utility: Useful for making plants with enhanced abiotic stress tolerance
  misc_feature (1)..(330): Utility: Useful for making plants with increased biomass
  misc_feature (1)..(330): Utility: Useful for making plants with increased biomass and foliage
  misc_feature (1)..(330): Utility: Useful for making smaller plants
MVTEEEISEAVQSLLRESNPSRFTTLNQVVEELQAKLGHDLTHKIDFITAQINLLFGSRQPPQNPHRQLQQPKDHFAPPPNPNFHSAPVSVGFQLQNFSSSNAVVAAATAADASRIEAPSAPVVVEGNQVPKESTQTKVKRRGGPGGLTKICGVSPELQVIVGQPALSRTEIVKQLWAYIRKNNLQDPSNKRKIICNDELRVVFETDCTDMFKMNKLLSKHIIPLEPTKKPVPKKQKVDVESGTRSAEPTPSVIISDALANFFGITGREMLQSEVLRRIWEYIKVNQLEDPANPMAIVCDGKLQEIFGCESISALGIPEVLGRHHIFRSS

SEQ ID NO: 5521 - protein, 387 aa, Zea mays
  misc_feature (1)..(387): useful for making plants with modified plant phenotypes as described in USSN 12/139,269
  misc_feature (1)..(387): Ceres CLONE ID no. 246369
  misc_feature (1)..(387): Utility: Useful for delaying flowering time
  misc_feature (1)..(387): Utility: Useful for making larger plants
  misc_feature (1)..(387): Utility: Useful for making ornamental plants with modified leaves
  misc_feature (1)..(387): Utility: Useful for making plants with altered leaf shape eg curled leaves
  misc_feature (1)..(387): Utility: Useful for making plants with enhanced abiotic stress tolerance
  misc_feature (1)..(387): Utility: Useful for making plants with increased biomass
  misc_feature (1)..(387): Utility: Useful for making plants with increased biomass and foliage
  misc_feature (1)..(387): Utility: Useful for making smaller plants
MVSDQEIASCVESVLRGSAGGPGEVSLTAVLQQAEATLGVDLSHKAGFIRDQMDLFFGPRLQPQPLTTPQLAPPPPQAVVAPADAVPQPQPQHQVLPQAPPSAQQMQPQQLAPLQPQLMFQTIHQLPAISPVPVVSAPPAMAFYPPPPLAFRYTTGLAGAATGGTVSFQQPAPGAGGTASPTAAPQVAGDNKESSSKRKRGGPGGLNKVCAISPELQTIVGETAMSRTQIVKQLWAYIRQNNLQDPDDKRKIICNDELRVVFETDTTDMFKMNKLLAKHITPLDPKSQLHEVKRMKAPTMSPQPGRPIDQPSIVISDALAKFIGTDGTFPQDDALKYLWDYIKANQLEDVINESILCDSKLQELFGCESIPMSGLSEMLGHHFIKKT

SEQ ID NO: 5522 - DNA, 851 bp, Arabidopsis thaliana
  misc_feature (1)..(851): useful for making plants with modified plant phenotypes as described in USSN 12/139,269
  misc_feature (1)..(851): Ceres CLONE ID no. 12514
  misc_feature (1)..(851): Also known as  Ceres CDNA ID no. 23383342
ataagatcttctttaaaatccaaaatcgtaggccactatttcattatacttatgtaatatatgtgatacagatacatctatatacaaattaaacacgaaaccatacatgcacggtgtgatcacacacgcacacacatagaaacataaacacgcaataatttctatacagtttaatttcatttttaacttacttctttttttttggtgaagattcttgagagaaaagaaatcgaagatggcaacaaaatccaccggaggtaccgagaaaaccaagtcgatagaagtgaagaagaaactaatcaacgtgttgatcgtcgatgatgatccattaaaccgtagactccacgagatgatcatcaaaacgatcggaggaatttctcagactgcaaagaatggcgaggaggcagtgatcctccaccgtgacggcgaagcatctttcgaccttattctaatggataaggaaatgcctgagagggatggagtttcgacaactaagaagctaagagaaatgaaagtgacgtcaatgatcgttggggtaacgtcattagctgaccaagaagaagagcgtaaggcttttatggaagctgggctcaaccattgcttggaaaaacccttaaccaaggccaagatcttcccgctcattagccacctcttcgatgcttgatggatgaaggctcattaatgtatctatattttcaatcatgaaatcacctacacgtgtatttgacacaaaaatctgcatttgttgtgatatagggtttctcatatctatgtttgatttattttcttatcgtccgaggtaaaatcatgcaagtcatttcttttggctaataaaatattaaaataagggc

SEQ ID NO: 5523 - protein, 71 aa, Arabidopsis thaliana
  misc_feature (1)..(71): useful for making plants with modified plant phenotypes as described in USSN 12/139,269
  misc_feature (22)..(36): Pfam Name: Response_reg; Pfam Description: Response regulator receiver domain
  misc_feature (1)..(71): Utility: Useful for delaying flowering time
  misc_feature (1)..(71): Utility: Useful for increasing chlorophyll and photosynthetic capacity
  misc_feature (1)..(71): Utility: Useful for making plants with enhanced abiotic stress tolerance
  misc_feature (1)..(71): Utility: Useful for making plants with increased biomass and foliage
  misc_feature (1)..(71): Utility: Useful for making smaller plants
MATKSTGGTEKTKSIEVKKKLINVLIVDDDPLNRRLHEMIIKTIGGISQTAKNGEEAVILHRDGEHLSTLF

SEQ ID NO: 5524 - DNA, 472 bp, Arabidopsis thaliana
  misc_feature (1)..(472): useful for making plants with modified plant phenotypes as described in USSN 12/139,269
  misc_feature (1)..(472): Ceres CLONE ID no. 12935
  misc_feature (1)..(472): Also known as  Ceres CDNA ID no. 23356753
aaccaccattcaattttctataaagagataacaaacttcagaaacttctagggccatttttattccggtgcatcctaatcatgatatctgttgtaatcatcactgagttacttttggagtacacgacggctcttgctaaactcaccgccggggttcttccgagacggcaaggcgacagaaatgttatacgtattggcggtttctctctgccttgtcctcctagatcctcacctgttccagatttttcttctcatcttgtcgatttctgaactctgcgctacgccttaatctcaattttggtttttcaccggagattatgactgccaagacttttttcccggcgtctgatctctccgtctgtagaataccttttttgtattttcttaaattttttttttgttcctgaattttgaatggctcagagttgtaaaagatgtatcgaattataatagagactatgatttaactcttc

SEQ ID NO: 5525 - protein, 62 aa, Arabidopsis thaliana
  misc_feature (1)..(62): useful for making plants with modified plant phenotypes as described in USSN 12/139,269
  misc_feature (1)..(62): Utility: Useful for delaying flowering time
  misc_feature (1)..(62): Utility: Useful for making ornamental plants with modified flowers
  misc_feature (1)..(62): Utility: Useful for making ornamental plants with modified leaves
  misc_feature (1)..(62): Utility: Useful for making plants with increased biomass
  misc_feature (1)..(62): Utility: Useful for making plants with increased biomass and foliage
  misc_feature (1)..(62): Utility: Useful for making smaller plants
  misc_feature (1)..(62): Utility: Useful for modifying plant architecture, ie amount of branching
MISVVIITELLLEYTTALAKLTAGVLPRRQGDRNVIRIGGFSLPCPPRSSPVPDFSSHLVDF

SEQ ID NO: 5526 - protein, 70 aa, Arabidopsis thaliana
  misc_feature (1)..(70): useful for making plants with modified plant phenotypes as described in USSN 12/139,269
  misc_feature (1)..(70): Ceres CLONE ID no. 1025550
  misc_feature (1)..(70): Utility: Useful for delaying flowering time
  misc_feature (1)..(70): Utility: Useful for making ornamental plants with modified flowers
  misc_feature (1)..(70): Utility: Useful for making ornamental plants with modified leaves
  misc_feature (1)..(70): Utility: Useful for making plants with increased biomass
  misc_feature (1)..(70): Utility: Useful for making plants with increased biomass and foliage
  misc_feature (1)..(70): Utility: Useful for making smaller plants
  misc_feature (1)..(70): Utility: Useful for modifying plant architecture, ie amount of branching
MISVVIIAELLVEYTTALAKLTAGILPSRRRGDSNVVRIGGFSLPCPSPSSSSTSRSSAIPDFSSHLVDF

SEQ ID NO: 5527 - protein, 70 aa, Arabidopsis thaliana; identical to SEQ ID NO: 5526
  misc_feature (1)..(70): useful for making plants with modified plant phenotypes as described in USSN 12/139,269
  misc_feature (1)..(70): Public GI no. 21593750
  misc_feature (1)..(70): Utility: Useful for delaying flowering time
  misc_feature (1)..(70): Utility: Useful for making ornamental plants with modified flowers
  misc_feature (1)..(70): Utility: Useful for making ornamental plants with modified leaves
  misc_feature (1)..(70): Utility: Useful for making plants with increased biomass
  misc_feature (1)..(70): Utility: Useful for making plants with increased biomass and foliage
  misc_feature (1)..(70): Utility: Useful for making smaller plants
  misc_feature (1)..(70): Utility: Useful for modifying plant architecture, ie amount of branching

SEQ ID NO: 5528 - protein, 62 aa, Arabidopsis thaliana
  misc_feature (1)..(62): useful for making plants with modified plant phenotypes as described in USSN 12/139,269
  misc_feature (1)..(62): Ceres CLONE ID no. 8827
  misc_feature (1)..(62): Utility: Useful for delaying flowering time
  misc_feature (1)..(62): Utility: Useful for making ornamental plants with modified flowers
  misc_feature (1)..(62): Utility: Useful for making ornamental plants with modified leaves
  misc_feature (1)..(62): Utility: Useful for making plants with increased biomass
  misc_feature (1)..(62): Utility: Useful for making plants with increased biomass and foliage
  misc_feature (1)..(62): Utility: Useful for making smaller plants
  misc_feature (1)..(62): Utility: Useful for modifying plant architecture, ie amount of branching
MISIVIITELLVEYTTALAKLTAGILPRRQGDGDVVRIGGFSLYCPPRSSPIPDFSSHLVNF

SEQ ID NO: 5529 - protein, 62 aa, Arabidopsis thaliana; identical to SEQ ID NO: 5528
  misc_feature (1)..(62): useful for making plants with modified plant phenotypes as described in USSN 12/139,269
  misc_feature (1)..(62): Public GI no. 21617917
  misc_feature (1)..(62): Utility: Useful for delaying flowering time
  misc_feature (1)..(62): Utility: Useful for making ornamental plants with modified flowers
  misc_feature (1)..(62): Utility: Useful for making ornamental plants with modified leaves
  misc_feature (1)..(62): Utility: Useful for making plants with increased biomass
  misc_feature (1)..(62): Utility: Useful for making plants with increased biomass and foliage
  misc_feature (1)..(62): Utility: Useful for making smaller plants
  misc_feature (1)..(62): Utility: Useful for modifying plant architecture, ie amount of branching

SEQ ID NO: 5530 - protein, 62 aa, Brassica napus
  misc_feature (1)..(62): useful for making plants with modified plant phenotypes as described in USSN 12/139,269
  misc_feature (1)..(62): Ceres CLONE ID no. 951883
  misc_feature (1)..(62): Utility: Useful for delaying flowering time
  misc_feature (1)..(62): Utility: Useful for making ornamental plants with modified flowers
  misc_feature (1)..(62): Utility: Useful for making ornamental plants with modified leaves
  misc_feature (1)..(62): Utility: Useful for making plants with increased biomass
  misc_feature (1)..(62): Utility: Useful for making plants with increased biomass and foliage
  misc_feature (1)..(62): Utility: Useful for making smaller plants
  misc_feature (1)..(62): Utility: Useful for modifying plant architecture, ie amount of branching
MISVVIITELLVEYTTALAKLAAGILPRRRGDGDVIRIGGFSLRFPSRSTPVPDFSSHLVDF

SEQ ID NO: 5531 - protein, 68 aa, Brassica napus
  misc_feature (1)..(68): useful for making plants with modified plant phenotypes as described in USSN 12/139,269
  misc_feature (1)..(68): Ceres CLONE ID no. 1126078
  misc_feature (1)..(68): Utility: Useful for delaying flowering time
  misc_feature (1)..(68): Utility: Useful for making ornamental plants with modified flowers
  misc_feature (1)..(68): Utility: Useful for making ornamental plants with modified leaves
  misc_feature (1)..(68): Utility: Useful for making plants with increased biomass
  misc_feature (1)..(68): Utility: Useful for making plants with increased biomass and foliage
  misc_feature (1)..(68): Utility: Useful for making smaller plants
  misc_feature (1)..(68): Utility: Useful for modifying plant architecture, ie amount of branching
MISVVILAELLVEYTSAIAKLTVGMLPRRQSGDSNVVRVGGFILPCPSPTSTNRSSPFPDFSSHLVDF

SEQ ID NO: 5532 - protein, 62 aa, Brassica napus
  misc_feature (1)..(62): useful for making plants with modified plant phenotypes as described in USSN 12/139,269
  misc_feature (1)..(62): Ceres CLONE ID no. 1070103
  misc_feature (1)..(62): Utility: Useful for delaying flowering time
  misc_feature (1)..(62): Utility: Useful for making ornamental plants with modified flowers
  misc_feature (1)..(62): Utility: Useful for making ornamental plants with modified leaves
  misc_feature (1)..(62): Utility: Useful for making plants with increased biomass
  misc_feature (1)..(62): Utility: Useful for making plants with increased biomass and foliage
  misc_feature (1)..(62): Utility: Useful for making smaller plants
  misc_feature (1)..(62): Utility: Useful for modifying plant architecture, ie amount of branching
  misc_feature (33)..(33): Xaa is any aa, unknown or other
  misc_feature (35)..(35): Xaa is any aa, unknown or other
  misc_feature (50)..(50): Xaa is any aa, unknown or other
  misc_feature (52)..(52): Xaa is any aa, unknown or other
  misc_feature (61)..(61): Xaa is any aa, unknown or other
MISVVIITELLVEYTTALAKLTAGILPRRRGDXDXIRIGGFSLRFPSRSXPXPDFSSHLVXF

SEQ ID NO: 5533 - protein, 63 aa, Zea mays
  misc_feature (1)..(63): useful for making plants with modified plant phenotypes as described in USSN 12/139,269
  misc_feature (1)..(63): Ceres CLONE ID no. 1461734
  misc_feature (1)..(63): Utility: Useful for delaying flowering time
  misc_feature (1)..(63): Utility: Useful for making ornamental plants with modified flowers
  misc_feature (1)..(63): Utility: Useful for making ornamental plants with modified leaves
  misc_feature (1)..(63): Utility: Useful for making plants with increased biomass
  misc_feature (1)..(63): Utility: Useful for making plants with increased biomass and foliage
  misc_feature (1)..(63): Utility: Useful for making smaller plants
  misc_feature (1)..(63): Utility: Useful for modifying plant architecture, ie amount of branching
MISVVIITEYLVEYTTALAKLTAGILPRRTGDRNVLRIGGFLLPSPSSAVSRIPDFSAHLVDF

SEQ ID NO: 5534 - protein, 62 aa, Brassica napus
  misc_feature (1)..(62): useful for making plants with modified plant phenotypes as described in USSN 12/139,269
  misc_feature (1)..(62): Ceres CLONE ID no. 1127491
  misc_feature (1)..(62): Utility: Useful for delaying flowering time
  misc_feature (1)..(62): Utility: Useful for making ornamental plants with modified flowers
  misc_feature (1)..(62): Utility: Useful for making ornamental plants with modified leaves
  misc_feature (1)..(62): Utility: Useful for making plants with increased biomass
  misc_feature (1)..(62): Utility: Useful for making plants with increased biomass and foliage
  misc_feature (1)..(62): Utility: Useful for making smaller plants
  misc_feature (1)..(62): Utility: Useful for modifying plant architecture, ie amount of branching
  misc_feature (8)..(8): Xaa is any aa, unknown or other
  misc_feature (10)..(10): Xaa is any aa, unknown or other
  misc_feature (22)..(22): Xaa is any aa, unknown or other
  misc_feature (26)..(26): Xaa is any aa, unknown or other
  misc_feature (28)..(28): Xaa is any aa, unknown or other
  misc_feature (30)..(30): Xaa is any aa, unknown or other
  misc_feature (34)..(34): Xaa is any aa, unknown or other
  misc_feature (44)..(44): Xaa is any aa, unknown or other
  misc_feature (62)..(62): Xaa is any aa, unknown or other
MISVVIIXEXLLEYTAALAKLXAGIXPXRXGDGXVVRIGGFSLXCPPRSSPIPDFSSHLVDX

SEQ ID NO: 5535 - DNA, 736 bp, Arabidopsis thaliana
  misc_feature (1)..(736): useful for making plants with modified plant phenotypes as described in USSN 12/139,269
  misc_feature (1)..(736): Ceres CLONE ID no. 13092
  misc_feature (1)..(736): Also known as  Ceres CDNA ID no. 23383122
aaataattttaattagtttcttctgtgcgatagagatcgatcgagagatgggtgcttcatcatcatcatctgtgtcggagaaatcaatccatcaattcaccgtcaaggatagctccggcaaggaggttgacctaagcgtgtatcaagggaaagtgctgctcgtcgtcaacgtcgcttctaaatgcggattcacggagtccaattacacccagctgacggaactttaccggaaatataaagatcaaggttttgtggtattggcgtttccttgcaaccagtttctgtcccaagagcctggcaccagcgaagaggctcatcaatttgcttgtactcgctttaaggctgaataccctgttttccaaaaggtgcgtgtaaatggacaaaacgctgcaccagtctacaaattcctcaaatctaagaaaccctcttttcttggaagtcgtatcaaatggaacttcaccaagttcttggtcggcaaagatggtcaagtaattgatcgttatggcacaactgtttcacctctatccatccagaaagacatcgagaaagcccttgcacaagaattgtgaacacgcacagagatatttgactcctttggaagaaacttctctcatactctcggtcatgcagtcaagtttctacatttcccattgcaccttccatatgggccttgtattcatcttatgtgtaactctactagccatttcttttgtgaaatttgatcaaaggtgattcc

SEQ ID NO: 5536 - protein, 173 aa, Arabidopsis thaliana
  misc_feature (1)..(173): useful for making plants with modified plant phenotypes as described in USSN 12/139,269
  misc_feature (13)..(122): Pfam Name: GSHPx; Pfam Description: Glutathione peroxidase
  misc_feature (1)..(173): Utility: Useful for delaying flowering time
  misc_feature (1)..(173): Utility: Useful for increasing seed/fruit yield or modifying fruit content
  misc_feature (1)..(173): Utility: Useful for making plants sterile and for genetic confinement
  misc_feature (1)..(173): Utility: Useful for making smaller plants
MGASSSSSVSEKSIHQFTVKDSSGKEVDLSVYQGKVLLVVNVASKCGFTESNYTQLTELYRKYKDQGFVVLAFPCNQFLSQEPGTSEEAHQFACTRFKAEYPVFQKVRVNGQNAAPVYKFLKSKKPSFLGSRIKWNFTKFLVGKDGQVIDRYGTTVSPLSIQKDIEKALAQEL

SEQ ID NO: 5537 - protein, 171 aa, Arabidopsis thaliana
  misc_feature (1)..(171): useful for making plants with modified plant phenotypes as described in USSN 12/139,269
  misc_feature (1)..(171): Public GI no. 25285637
  misc_feature (1)..(171): Utility: Useful for delaying flowering time
  misc_feature (1)..(171): Utility: Useful for increasing seed/fruit yield or modifying fruit content
  misc_feature (1)..(171): Utility: Useful for making plants sterile and for genetic confinement
  misc_feature (1)..(171): Utility: Useful for making smaller plants
MGASASVPERSVHQFTVKDSSGKDLNMSIYQGKVLLIVNVASKCGFTETNYTQLTELYRKYKDQDFEILAFPCNQFLYQEPGTSQEAHEFACERFKAEYPVFQKVRVNGQNAAPIYKFLKASKPTFLGSRIKWNFTKFLVGKDGLVIDRYGTMVTPLSIEVSVLYISKVPM

SEQ ID NO: 5538 - protein, 170 aa, Zea mays
  misc_feature (1)..(170): useful for making plants with modified plant phenotypes as described in USSN 12/139,269
  misc_feature (1)..(170): Ceres CLONE ID no. 288261
  misc_feature (1)..(170): Utility: Useful for delaying flowering time
  misc_feature (1)..(170): Utility: Useful for increasing seed/fruit yield or modifying fruit content
  misc_feature (1)..(170): Utility: Useful for making plants sterile and for genetic confinement
  misc_feature (1)..(170): Utility: Useful for making smaller plants
MGAAESVPETSIHEFTVKDCNGKEVSLETYKGKVLLVVNVASKCGFTETNYTQLTELYQKYRDKDFEILAFPCNQFLRQEPGTDQQIQDFACTRFKAEYPVFQKVRVNGPDAAPVYKFLKASKPGLFGSSRIKWNFTKFLVDKDGKVIERYGTSTAPMAIEKDIQKALEE

SEQ ID NO: 5539 - protein, 169 aa, Zea mays
  misc_feature (1)..(169): useful for making plants with modified plant phenotypes as described in USSN 12/139,269
  misc_feature (1)..(169): Public GI no. 27544804
  misc_feature (1)..(169): Utility: Useful for delaying flowering time
  misc_feature (1)..(169): Utility: Useful for increasing seed/fruit yield or modifying fruit content
  misc_feature (1)..(169): Utility: Useful for making plants sterile and for genetic confinement
  misc_feature (1)..(169): Utility: Useful for making smaller plants
MAAAASSASSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGDNVAPVYKFLKSSKGSLFGDNIKWNFSKFLVDKDGNVVDRYAPTTSPLSIEKDIKKLLASS

SEQ ID NO: 5540 - protein, 169 aa, Zea mays
  misc_feature (1)..(169): useful for making plants with modified plant phenotypes as described in USSN 12/139,269
  misc_feature (1)..(169): Public GI no. 11544696
  misc_feature (1)..(169): Utility: Useful for delaying flowering time
  misc_feature (1)..(169): Utility: Useful for increasing seed/fruit yield or modifying fruit content
  misc_feature (1)..(169): Utility: Useful for making plants sterile and for genetic confinement
  misc_feature (1)..(169): Utility: Useful for making smaller plants
MGAAESVPETSIHEFTVKDCNGKEVSLEMYKGKVLIVVNVASKCGFTETNYTQLTELYQKHRDKDFEILAFPCNQFLRQEPGSDQQIKDFACTRFKAEYPVFQKVRVNGPDAAPLYKFLKASKPGLFGSRIKWNFTKFLIDKNGKVINRYSTATSPLSFEKDILKALED

SEQ ID NO: 5541 - protein, 187 aa, Glycine max
  misc_feature (1)..(187): useful for making plants with modified plant phenotypes as described in USSN 12/139,269
  misc_feature (1)..(187): Ceres CLONE ID no. 1059504
  misc_feature (1)..(187): Utility: Useful for delaying flowering time
  misc_feature (1)..(187): Utility: Useful for increasing seed/fruit yield or modifying fruit content
  misc_feature (1)..(187): Utility: Useful for making plants sterile and for genetic confinement
  misc_feature (1)..(187): Utility: Useful for making smaller plants
MGASESVPETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKASKPGLFGSRIKWNFTKFLVDKNGKVINRYATATTPFSFEKDIQKALEEEPSDSQTKKEEESSDSQK

SEQ ID NO: 5542 - protein, 187 aa, Triticum aestivum
  misc_feature (1)..(187): useful for making plants with modified plant phenotypes as described in USSN 12/139,269
  misc_feature (1)..(187): Ceres CLONE ID no. 639745
  misc_feature (1)..(187): Utility: Useful for delaying flowering time
  misc_feature (1)..(187): Utility: Useful for increasing seed/fruit yield or modifying fruit content
  misc_feature (1)..(187): Utility: Useful for making plants sterile and for genetic confinement
  misc_feature (1)..(187): Utility: Useful for making smaller plants
MGASESVLETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKANKPGLFGSRIKWNFTKFLVDKNGKVINRYATATTPFSFEKDIQKALEEEPSDSQTKKEEESSDSQK

SEQ ID NO: 5543 - DNA, 1199 bp, Arabidopsis thaliana
  misc_feature (1)..(1199): useful for making plants with modified plant phenotypes as described in USSN 12/139,269
  misc_feature (1)..(1199): Ceres CLONE ID no. 13263
  misc_feature (1)..(1199): Also known as  Ceres CDNA ID no. 23368972
agtgtctcttcatatttacataaatagatatctctctctctctctctctaaaccacatcttcctctccaccgttctttctcttccttctctctctggacttcaacttctggagaagtacaagacatttataaagtactgctcatcacccaacactaaacacaattgtcaaaagggtgtggtggaaggagaatctacttctatctgaacatcgatcagtcatatcttttcaatcaaatcaaagccctcctctctctcttactccttttttgttttaaatcaagaaaaagactccatgtcgagcatgtccatgtcgtcctcctcagctccagcttttccaccggaccacttctcatctacggaccagctctgttacgtccattgcagcttctgcgacactgtccttgctgtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagacccccagagaagcgacaaagagtaccatctgcatacaaccgattcatcaaagaggagatccaacgtataaaggcaggcaaccctgatatcagccacagagaagccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagctacgaagactttcccaatcttttgtaatcttcaaaatgtggttactttcagctcaaacttaactttcttattactattttatgatatttgataatctatcaggagaccttttttttttttcttaaagaaattttcggaactactagaattttctcttggaattgaaaatatattgttttccc

SEQ ID NO: 5544 - protein, 240 aa, Arabidopsis thaliana
  misc_feature (1)..(240): useful for making plants with modified plant phenotypes as described in USSN 12/139,269
  misc_feature (16)..(201): Pfam Name: YABBY; Pfam Description: YABBY protein
  misc_feature (1)..(240): Utility: Useful for delaying flowering time
  misc_feature (1)..(240): Utility: Useful for delaying senescence
  misc_feature (1)..(240): Utility: Useful for increasing chlorophyll and photosynthetic capacity
  misc_feature (1)..(240): Utility: Useful for increasing increasing anthocyanin content
  misc_feature (1)..(240): Utility: Useful for increasing seed/fruit yield or modifying fruit content
  misc_feature (1)..(240): Utility: Useful for making ornamental plants with modified leaves
  misc_feature (1)..(240): Utility: Useful for making plants sterile and for genetic confinement
  misc_feature (1)..(240): Utility: Useful for making plants with altered leaf shape eg curled leaves
  misc_feature (1)..(240): Utility: Useful for making plants with increased biomass and foliage
  misc_feature (1)..(240): Utility: Useful for making smaller plants
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 5545 - protein, 260 aa, Zea mays
  misc_feature (1)..(260): useful for making plants with modified plant phenotypes as described in USSN 12/139,269
  misc_feature (1)..(260): Ceres CLONE ID no. 227877
  misc_feature (1)..(260): Utility: Useful for delaying flowering time
  misc_feature (1)..(260): Utility: Useful for delaying senescence
  misc_feature (1)..(260): Utility: Useful for increasing chlorophyll and photosynthetic capacity
  misc_feature (1)..(260): Utility: Useful for increasing increasing anthocyanin content
  misc_feature (1)..(260): Utility: Useful for increasing seed/fruit yield or modifying fruit content
  misc_feature (1)..(260): Utility: Useful for making ornamental plants with modified leaves
  misc_feature (1)..(260): Utility: Useful for making plants sterile and for genetic confinement
  misc_feature (1)..(260): Utility: Useful for making plants with altered leaf shape eg curled leaves
  misc_feature (1)..(260): Utility: Useful for making plants with increased biomass and foliage
  misc_feature (1)..(260): Utility: Useful for making smaller plants
MSSSSSSSSSAACCFPLDHLAPSPTEQLCYVHCNCCDTILAVGVPCSSLFKTVTVRCGHCANLLSVNLRGLLLPPAAPAPPNHLNFAHSLLSPTSPHGLLDELALQQAPSFLMEQASANLSSTMTGRSSNSSCASNLPPPAPMPAAQPVQQEAELPKTAPSVNRPPEKRQRVPSAYNRFIKDEIQRIKAGNPDITHREAFSAAAKNWAHFPHIHFGLMPDQGLKKTFKTHQDGAEDMLLKDDLYAAAAAAAAANMGITPF

SEQ ID NO: 5546 - protein, 258 aa, Zea mays
  misc_feature (1)..(258): useful for making plants with modified plant phenotypes as described in USSN 12/139,269
  misc_feature (1)..(258): Ceres CLONE ID no. 228481
  misc_feature (1)..(258): Utility: Useful for delaying flowering time
  misc_feature (1)..(258): Utility: Useful for delaying senescence
  misc_feature (1)..(258): Utility: Useful for increasing chlorophyll and photosynthetic capacity
  misc_feature (1)..(258): Utility: Useful for increasing increasing anthocyanin content
  misc_feature (1)..(258): Utility: Useful for increasing seed/fruit yield or modifying fruit content
  misc_feature (1)..(258): Utility: Useful for making ornamental plants with modified leaves
  misc_feature (1)..(258): Utility: Useful for making plants sterile and for genetic confinement
  misc_feature (1)..(258): Utility: Useful for making plants with altered leaf shape eg curled leaves
  misc_feature (1)..(258): Utility: Useful for making plants with increased biomass and foliage
  misc_feature (1)..(258): Utility: Useful for making smaller plants
MMSSSSSSSAACCFPLDHLAPSPTEQLCYVHCNCCDTILAVGVPCSSLFKTVTVRCGHCANLLSVNLRGLLLPPAAPAPPNHLNFAHSLLSPTSPHGLLDELALQQAPSFLMEQASANLSSTMTGRSSNSSCASNLPPPAPMPAAQPVQQEAELPKTAPSVNRPPEKRQRVPSAYNRFIKDEIQRIKAGNPDITHREAFSAAAKNWAHFPHIHFGLMPDQGLKKTFKTQDGAEDMLLKDDLYAAAAAAAAANMGITPF

SEQ ID NO: 5547 - DNA, 1126 bp, Arabidopsis thaliana
  misc_feature (1)..(1126): useful for making plants with modified plant phenotypes as described in USSN 12/139,269
  misc_feature (1)..(1126): Ceres CLONE ID no. 13757
  misc_feature (1)..(1126): Also known as  Ceres CDNA ID no. 23357445
aattctcttccttctgaaattagggttttttttatcccttcctctctctttcttgtctaccaaaaaaggttttatcgaattactctcaaatcgtatggtgaggaagtcaaaatcttgagagatctgagattgtaagaagatgaatcaagaagataaagagaagcctatcgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcagttcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgataatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggaagtatgccacgtggcagagtttctatggttggtgctggttctctcctccagttgaggttagtgagcagtgatgatgagtctttagtagcaatggaagctgcaagtcttgaggatcatcacttctttacaaagaaaggaaaatcttctttgtcttttgatttggataggtgatgattatcatgagatgaatcactatttaaaaatgcatatatatgataatttataccatatataatatatgacacaaagatgtctttc

SEQ ID NO: 5548 - protein, 299 aa, Arabidopsis thaliana
  misc_feature (1)..(299): useful for making plants with modified plant phenotypes as described in USSN 12/139,269
  misc_feature (22)..(131): Pfam Name: B3; Pfam Description: B3 DNA binding domain
  misc_feature (1)..(299): Utility: Useful for delaying flowering time
  misc_feature (1)..(299): Utility: Useful for delaying senescence
  misc_feature (1)..(299): Utility: Useful for increasing chlorophyll and photosynthetic capacity
  misc_feature (1)..(299): Utility: Useful for increasing increasing anthocyanin content
  misc_feature (1)..(299): Utility: Useful for increasing seed/fruit yield or modifying fruit content
  misc_feature (1)..(299): Utility: Useful for making larger plants
  misc_feature (1)..(299): Utility: Useful for making ornamental plants with modified flowers
  misc_feature (1)..(299): Utility: Useful for making ornamental plants with modified leaves
  misc_feature (1)..(299): Utility: Useful for making plants sterile and for genetic confinement
  misc_feature (1)..(299): Utility: Useful for making plants that grow better in shade
  misc_feature (1)..(299): Utility: Useful for making plants with altered leaf shape eg curled leaves
  misc_feature (1)..(299): Utility: Useful for making plants with increased biomass
  misc_feature (1)..(299): Utility: Useful for making plants with increased biomass and foliage
  misc_feature (1)..(299): Utility: Useful for making shorter plants and plants with modified flowers
  misc_feature (1)..(299): Utility: Useful for making smaller plants
  misc_feature (1)..(299): Utility: Useful for modifying plant architecture, ie amount of branching
  misc_feature (1)..(299): Utility: Useful for modifying plant structure, ie increased branching
MNQEDKEKPIEEASSSMEREHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQRDSCNKDKLYIDWRRRPKIPDHHHQQFAGAMFPRFYTFPHPQMPTNYETHNLYHRFHQRDLGIGYYVRSMERSHPTAVIESVPVIMQRRAQVASMASRGEKRLRLFGVDMECGGGGGSVNSTEEESSSSGGSMPRGRVSMVGAGSLLQLRLVSSDDESLVAMEAASLEDHHFFTKKGKSSLSFDLDR

SEQ ID NO: 5549 - DNA, 552 bp, Arabidopsis thaliana
  misc_feature (1)..(552): useful for making plants with modified plant phenotypes as described in USSN 12/139,269
  misc_feature (1)..(552): Ceres CLONE ID no. 14583
  misc_feature (1)..(552): Also known as  Ceres CDNA ID no. 23416892
tcgttttcataaagagtctttcgtaagaccaaagagccattttcgattccagggctaaaactagggtttcacagttcatgatgaagaagagacagatggtaatcaagcagagatcaagaaactccaacacatcttcctcttggactactacttcgtcttcttcttcttcctccgagatcagtaacgtccgttacgtggagtgtcagaagaatcacgctgctaacatcggaggctacgccgtcgacggttgccgtgagttcatggccgccggagttgaaggaaccgttgatgctttgagatgcgcggcttgtggttgtcaccggaattttcaccggaaggaagttgatactgaggttgtttgtgagtattctccacctaacgcttgatttttagaggattttacttttttcttcttttggtttggatttatcgattgatttttaaagatgaatttgttagaggatatttgtatatgaatattgatgtgtatatcaaaaacagcataccgcccatctatatctataggtatatataaaattgcttgttggtttg

SEQ ID NO: 5550 - protein, 102 aa, Arabidopsis thaliana
  misc_feature (1)..(102): useful for making plants with modified plant phenotypes as described in USSN 12/139,269
  misc_feature (34)..(93): Pfam Name: ZF-HD_dimer; Pfam Description: ZF-HD protein dimerisation region
  misc_feature (34)..(93): Pfam Name: ZF-HD_dimer; Pfam Description: ZF-HD protein dimerisation region
  misc_feature (1)..(102): Utility: Useful for delaying flowering time
  misc_feature (1)..(102): Utility: Useful for increasing chlorophyll and photosynthetic capacity
  misc_feature (1)..(102): Utility: Useful for increasing seed/fruit yield or modifying fruit content
  misc_feature (1)..(102): Utility: Useful for making ornamental plants with modified flowers
  misc_feature (1)..(102): Utility: Useful for making plants sterile and for genetic confinement
  misc_feature (1)..(102): Utility: Useful for making plants with enhanced abiotic stress tolerance
  misc_feature (1)..(102): Utility: Useful for making shorter plants and plants with modified flowers
  misc_feature (1)..(102): Utility: Useful for making smaller plants
MMKKRQMVIKQRSRNSNTSSSWTTTSSSSSSSEISNVRYVECQKNHAANIGGYAVDGCREFMAAGVEGTVDALRCAACGCHRNFHRKEVDTEVVCEYSPPNA

SEQ ID NO: 5551 - protein, 97 aa, Brassica napus
  misc_feature (1)..(97): useful for making plants with modified plant phenotypes as described in USSN 12/139,269
  misc_feature (1)..(97): Ceres CLONE ID no. 1119033
  misc_feature (1)..(97): Utility: Useful for delaying flowering time
  misc_feature (1)..(97): Utility: Useful for increasing chlorophyll and photosynthetic capacity
  misc_feature (1)..(97): Utility: Useful for increasing seed/fruit yield or modifying fruit content
  misc_feature (1)..(97): Utility: Useful for making ornamental plants with modified flowers
  misc_feature (1)..(97): Utility: Useful for making plants sterile and for genetic confinement
  misc_feature (1)..(97): Utility: Useful for making plants with enhanced abiotic stress tolerance
  misc_feature (1)..(97): Utility: Useful for making shorter plants and plants with modified flowers
  misc_feature (1)..(97): Utility: Useful for making smaller plants
MKKRQVVIKQRSRNSNTSSSWTTTSSSATSSIRYVECQKNHAANIGGYAVDGCREFMAAGVEGTDDSLRCAACGCHRNFHRKEVNTEVVCEYSPPNA

SEQ ID NO: 5552 - protein, 71 aa, Glycine max
  misc_feature (1)..(71): useful for making plants with modified plant phenotypes as described in USSN 12/139,269
  misc_feature (1)..(71): Ceres CLONE ID no. 649770
  misc_feature (1)..(71): Utility: Useful for delaying flowering time
  misc_feature (1)..(71): Utility: Useful for increasing chlorophyll and photosynthetic capacity
  misc_feature (1)..(71): Utility: Useful for increasing seed/fruit yield or modifying fruit content
  misc_feature (1)..(71): Utility: Useful for making ornamental plants with modified flowers
  misc_feature (1)..(71): Utility: Useful for making plants sterile and for genetic confinement
  misc_feature (1)..(71): Utility: Useful for making plants with enhanced abiotic stress tolerance
  misc_feature (1)..(71): Utility: Useful for making shorter plants and plants with modified flowers
  misc_feature (1)..(71): Utility: Useful for making smaller plants
MRNIRYGECQKNHAANIGGYAVDGCREFMASTGEGAGGALTCAACGCHRNFHRREVNTEVVCEYSPPNSGR

SEQ ID NO: 5553 - protein, 100 aa, Arabidopsis thaliana
  misc_feature (1)..(100): useful for making plants with modified plant phenotypes as described in USSN 12/139,269
  misc_feature (1)..(100): Ceres CLONE ID no. 29087
  misc_feature (1)..(100): Utility: Useful for delaying flowering time
  misc_feature (1)..(100): Utility: Useful for increasing chlorophyll and photosynthetic capacity
  misc_feature (1)..(100): Utility: Useful for increasing seed/fruit yield or modifying fruit content
  misc_feature (1)..(100): Utility: Useful for making ornamental plants with modified flowers
  misc_feature (1)..(100): Utility: Useful for making plants sterile and for genetic confinement
  misc_feature (1)..(100): Utility: Useful for making plants with enhanced abiotic stress tolerance
  misc_feature (1)..(100): Utility: Useful for making shorter plants and plants with modified flowers
  misc_feature (1)..(100): Utility: Useful for making smaller plants
MRKRQVVLRRASPEEPSRSSSTASSLTVRTVRYGECQKNHAAAVGGYAVDGCREFMASRGEEGTVAALTCAACGCHRSFHRREIETEVVCDCNSPPSTGN

SEQ ID NO: 5554 - protein, 100 aa, Brassica napus
  misc_feature (1)..(100): useful for making plants with modified plant phenotypes as described in USSN 12/139,269
  misc_feature (1)..(100): Ceres CLONE ID no. 1100582
  misc_feature (1)..(100): Utility: Useful for delaying flowering time
  misc_feature (1)..(100): Utility: Useful for increasing chlorophyll and photosynthetic capacity
  misc_feature (1)..(100): Utility: Useful for increasing seed/fruit yield or modifying fruit content
  misc_feature (1)..(100): Utility: Useful for making ornamental plants with modified flowers
  misc_feature (1)..(100): Utility: Useful for making plants sterile and for genetic confinement
  misc_feature (1)..(100): Utility: Useful for making plants with enhanced abiotic stress tolerance
  misc_feature (1)..(100): Utility: Useful for making shorter plants and plants with modified flowers
  misc_feature (1)..(100): Utility: Useful for making smaller plants
MRKRQVVLRRASPEEPSRSSSTASSLTVRGVRYGECQKNHAAAVGGYAVDGCREFMASNGEEGSVAALTCAACGCHRSFHRREIETEVVCDCNSPPSTGN

SEQ ID NO: 5555 - protein, 97 aa, Glycine max
  misc_feature (1)..(97): useful for making plants with modified plant phenotypes as described in USSN 12/139,269
  misc_feature (1)..(97): Ceres CLONE ID no. 1042725
  misc_feature (1)..(97): Utility: Useful for delaying flowering time
  misc_feature (1)..(97): Utility: Useful for increasing chlorophyll and photosynthetic capacity
  misc_feature (1)..(97): Utility: Useful for increasing seed/fruit yield or modifying fruit content
  misc_feature (1)..(97): Utility: Useful for making ornamental plants with modified flowers
  misc_feature (1)..(97): Utility: Useful for making plants sterile and for genetic confinement
  misc_feature (1)..(97): Utility: Useful for making plants with enhanced abiotic stress tolerance
  misc_feature (1)..(97): Utility: Useful for making shorter plants and plants with modified flowers
  misc_feature (1)..(97): Utility: Useful for making smaller plants
MRRVILRRDGSRRCSNNSPVTIVRQVKYGKCCRNLACRIGGHVVDGCTEFVASGAEGTREAMTCATCGCHRNFHMKEEITQVLCACSSHPTTRTVGD

SEQ ID NO: 5556 - DNA, 850 bp, Arabidopsis thaliana
  misc_feature (1)..(850): useful for making plants with modified plant phenotypes as described in USSN 12/139,269
  misc_feature (1)..(850): Ceres CLONE ID no. 14909
  misc_feature (1)..(850): Also known as  Ceres CDNA ID no. 23383636
cctctcacgttcgaagaccatttcttgttctttggacgaccatcggcgacagtgttaagtctagagtcttcttcttcttcggcgtagttttttccccggcttgaaaaatgggtctatccttcggaaagttgttcagcaagctctttgcaaagaaagagatgcgtatcctcatggtgggtctcgatgcagctggtaagactacgatcttgtacaagctcaagcttggagagatcgtgactacgattccaaccattggtttcaatgtggagactgtggaatacaagaacattagctttaccgtgtgggatgtcgggggtcaagacaagattcgtccattgtggaggcactacttccagaacactcagggacttatctttgtggtggacagcaatgatcgtgaccgtgttgtggaagccagagatgagcttcacagaatgttgaacgaagatgagttgagagatgctgtgcttctcgtttttgctaacaagcaagatcttccaaattgcgatgaacgccgctgagataaccgataagcttggacttcactctctccgtcaacgacactggtacatacagagcacatgtgctacctccggagaagggctttatgagggacttgactggctctctaacaacatcgcaaacaaggcttaggagaacaacgtgtggtttggtttttaatcgaggagagtcttgtcttcttccttctatcttttgttctttcgtctcaaactcttatcatttcatactctttgttcttcgctctaataatttacaagttttttttttgttgcttttatcctataattcagactcttataaaatggggcccaatttcggcggatattcc

SEQ ID NO: 5557 - protein, 181 aa, Arabidopsis thaliana
  misc_feature (1)..(181): useful for making plants with modified plant phenotypes as described in USSN 12/139,269
  misc_feature (4)..(177): Pfam Name: Arf; Pfam Description: ADP-ribosylation factor family
  misc_feature (18)..(129): Pfam Name: MMR_HSR1; Pfam Description: GTPase of unknown function
  misc_feature (19)..(179): Pfam Name: Ras; Pfam Description: Ras family
  misc_feature (1)..(181): Utility: Useful for delaying flowering time
  misc_feature (1)..(181): Utility: Useful for making larger plants
  misc_feature (1)..(181): Utility: Useful for making smaller plants
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 5558 - protein, 164 aa, Zea mays
  misc_feature (1)..(164): useful for making plants with modified plant phenotypes as described in USSN 12/139,269
  misc_feature (1)..(164): Ceres CLONE ID no. 380874
  misc_feature (1)..(164): Utility: Useful for delaying flowering time
  misc_feature (1)..(164): Utility: Useful for making larger plants
  misc_feature (1)..(164): Utility: Useful for making smaller plants
MRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATTGEGLYEGLDWLSNNIANKA

SEQ ID NO: 5559 - protein, 164 aa, Zea mays
  misc_feature (1)..(164): useful for making plants with modified plant phenotypes as described in USSN 12/139,269
  misc_feature (1)..(164): Ceres CLONE ID no. 276776
  misc_feature (1)..(164): Utility: Useful for delaying flowering time
  misc_feature (1)..(164): Utility: Useful for making larger plants
  misc_feature (1)..(164): Utility: Useful for making smaller plants
MRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKS

SEQ ID NO: 5560 - protein, 164 aa, Glycine max
  misc_feature (1)..(164): useful for making plants with modified plant phenotypes as described in USSN 12/139,269
  misc_feature (1)..(164): Ceres CLONE ID no. 529239
  misc_feature (1)..(164): Utility: Useful for delaying flowering time
  misc_feature (1)..(164): Utility: Useful for making larger plants
  misc_feature (1)..(164): Utility: Useful for making smaller plants
  misc_feature (67)..(67): Xaa is any aa, unknown or other
  misc_feature (110)..(110): Xaa is any aa, unknown or other
MRILMVGLDAAGKTTILYKLKLGEIVTTIPTIGFNVETVEYKNISFTVWDVGGQDKIRPLWRHYFQXTQGLIFVVDSNDRDRVVEARDELHRMLNEDELRDAVLLVFANXQDLPNAMNAAEITDKLGLHSLRQRHWYIQSTCATSGEGLYEGLDWLSNNIANKA

SEQ ID NO: 5561 - protein, 164 aa, Zea mays; identical to SEQ ID NO: 5559
  misc_feature (1)..(164): useful for making plants with modified plant phenotypes as described in USSN 12/139,269
  misc_feature (1)..(164): Ceres CLONE ID no. 240510
  misc_feature (1)..(164): Utility: Useful for delaying flowering time
  misc_feature (1)..(164): Utility: Useful for making larger plants
  misc_feature (1)..(164): Utility: Useful for making smaller plants

SEQ ID NO: 5562 - protein, 164 aa, Zea mays
  misc_feature (1)..(164): useful for making plants with modified plant phenotypes as described in USSN 12/139,269
  misc_feature (1)..(164): Ceres CLONE ID no. 1535974
  misc_feature (1)..(164): Utility: Useful for delaying flowering time
  misc_feature (1)..(164): Utility: Useful for making larger plants
  misc_feature (1)..(164): Utility: Useful for making smaller plants
MRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 5563 - protein, 181 aa, Triticum aestivum
  misc_feature (1)..(181): useful for making plants with modified plant phenotypes as described in USSN 12/139,269
  misc_feature (1)..(181): Ceres CLONE ID no. 738726
  misc_feature (1)..(181): Utility: Useful for delaying flowering time
  misc_feature (1)..(181): Utility: Useful for making larger plants
  misc_feature (1)..(181): Utility: Useful for making smaller plants
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 5564 - protein, 181 aa, Zea mays
  misc_feature (1)..(181): useful for making plants with modified plant phenotypes as described in USSN 12/139,269
  misc_feature (1)..(181): Ceres CLONE ID no. 1428788
  misc_feature (1)..(181): Utility: Useful for delaying flowering time
  misc_feature (1)..(181): Utility: Useful for making larger plants
  misc_feature (1)..(181): Utility: Useful for making smaller plants
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 5565 - protein, 181 aa, Triticum aestivum
  misc_feature (1)..(181): useful for making plants with modified plant phenotypes as described in USSN 12/139,269
  misc_feature (1)..(181): Ceres CLONE ID no. 631823
  misc_feature (1)..(181): Utility: Useful for delaying flowering time
  misc_feature (1)..(181): Utility: Useful for making larger plants
  misc_feature (1)..(181): Utility: Useful for making smaller plants
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKP

SEQ ID NO: 5566 - protein, 181 aa, Zea mays
  misc_feature (1)..(181): useful for making plants with modified plant phenotypes as described in USSN 12/139,269
  misc_feature (1)..(181): Ceres CLONE ID no. 416460
  misc_feature (1)..(181): Utility: Useful for delaying flowering time
  misc_feature (1)..(181): Utility: Useful for making larger plants
  misc_feature (1)..(181): Utility: Useful for making smaller plants
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATTGEGLYEGLDWLSSNIATKS

SEQ ID NO: 5567 - protein, 181 aa, Zea mays
  misc_feature (1)..(181): useful for making plants with modified plant phenotypes as described in USSN 12/139,269
  misc_feature (1)..(181): Ceres CLONE ID no. 1561415
  misc_feature (1)..(181): Utility: Useful for delaying flowering time
  misc_feature (1)..(181): Utility: Useful for making larger plants
  misc_feature (1)..(181): Utility: Useful for making smaller plants
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRAPVLLVFPNNQDLPNAMNAPEITANLGLHSLRQRHWSIQSPCAPSGEGLYEGLDWLSTNISTKS

SEQ ID NO: 5568 - DNA, 1623 bp, Arabidopsis thaliana
  misc_feature (1)..(1623): useful for making plants with modified plant phenotypes as described in USSN 12/139,269
  misc_feature (1)..(1623): Ceres CLONE ID no. 16412
  misc_feature (1)..(1623): Also known as  Ceres CDNA ID no. 23369620
aaaaataaaaatgaaacctttctctagagtgttcattattttggtcatcgttttgttaacaagctacatagatgcctttaccagaaacgattttccagaggattttctcttcggagctgccacttctgcttatcagtgggaaggagctgttgatgaagatggaagaactcctagcgtctgggacacgacctctcactgttatagtggaagtaatggagatgtagcatgtgatgggtatcacaagtacaaggaagatgttaagttgatggtagatatgggcttacaagcattcagattctctatctcctggccaagacctaatggaagaggatccatgaacccaaaaggtctattgttttacaagaacctcatcaaagaattacggagccatggaattgaaccacacgttacactttaccactacgatcttccgcagcctcttgaagatgagtacggaggatggatcaaccgaaaaatcatagaagactttactgcttttgcagatgtatgcttcagagagtttggcgatgatgtgaagttatggactacaatcaacgaagctacaatattcgccattgctacttatggcgaaggtgtcacgtttggacattgtactcctaccaaattcaccaattgttcttccgggaattcttgtacagaaacatatattgcagggcataacatgttgctagcacatgcctctgcttcaaatttgtataaactaaagtatcagagtaagcaaagaggatccataggccttagtatatatgcattcgggttatctccttatacaaactccaaggacgatgaaatcgcaactcaaagagctaaagctttcctctatggatggatgttgaagccattggtatttggggactatccggatgaaatgaagagaaccttgggatcgagattaccggttttctcagaggcagagtcggaacaaatgaaagggtcatctgactttgtaggaattattcactacacgacagtctatgtcacaaaccaacccgcaccttatatctttcccagcagcgtcaacaaaggcttctttaaagatatgggcgcatatattatatccactgggaattcttcattatttgagtttgaagcaactccatggggtcttgaaggtgttcttgagtatctaaagcagagctataacaatcctccaatctatattcttgaaaatggtacaccaatgaaacacgattcgatgctacaagacacaccaagagttgaatacattcaagcttacattggtgctgtgctcaacgccatcaagaatggatcggacacgagaggttacttcgtatggtcgctgatagatttgtatgagataataggtggatataaaagcagcttcggaatgtaccatgtcaatttcagcgatcctgctcgcaagaggtcgtcaaagctctctgcttcttggtactcaggttttctcaatggtacaattgatgttgcttctcaaaatattactaagttgcagaacaagttctctggctcttcttcattgtaatgttcttaaactaaagtagcctggtttgattttgatctatctattctatgataaagacctcagggatttgcatatgaataaatgatgtgtcttgtgagacc

SEQ ID NO: 5569 - protein, 503 aa, Arabidopsis thaliana
  misc_feature (1)..(503): useful for making plants with modified plant phenotypes as described in USSN 12/139,269
  misc_feature (24)..(484): Pfam Name: Glyco_hydro_1; Pfam Description: Glycosyl hydrolase family 1
  misc_feature (1)..(503): Utility: Useful for delaying flowering time
  misc_feature (1)..(503): Utility: Useful for making ornamental plants with modified leaves
  misc_feature (1)..(503): Utility: Useful for making plants with altered leaf shape eg curled leaves
  misc_feature (1)..(503): Utility: Useful for making plants with increased biomass and foliage
  misc_feature (1)..(503): Utility: Useful for making smaller plants
MKPFSRVFIILVIVLLTSYIDAFTRNDFPEDFLFGAATSAYQWEGAVDEDGRTPSVWDTTSHCYSGSNGDVACDGYHKYKEDVKLMVDMGLQAFRFSISWPRPNGRGSMNPKGLLFYKNLIKELRSHGIEPHVTLYHYDLPQPLEDEYGGWINRKIIEDFTAFADVCFREFGDDVKLWTTINEATIFAIATYGEGVTFGHCTPTKFTNCSSGNSCTETYIAGHNMLLAHASASNLYKLKYQSKQRGSIGLSIYAFGLSPYTNSKDDEIATQRAKAFLYGWMLKPLVFGDYPDEMKRTLGSRLPVFSEAESEQMKGSSDFVGIIHYTTVYVTNQPAPYIFPSSVNKGFFKDMGAYIISTGNSSLFEFEATPWGLEGVLEYLKQSYNNPPIYILENGTPMKHDSMLQDTPRVEYIQAYIGAVLNAIKNGSDTRGYFVWSLIDLYEIIGGYKSSFGMYHVNFSDPARKRSSKLSASWYSGFLNGTIDVASQNITKLQNKFSGSSSL

SEQ ID NO: 5570 - protein, 497 aa, Arabidopsis thaliana
  misc_feature (1)..(497): useful for making plants with modified plant phenotypes as described in USSN 12/139,269
  misc_feature (1)..(497): Public GI no. 51971769
  misc_feature (1)..(497): Utility: Useful for delaying flowering time
  misc_feature (1)..(497): Utility: Useful for making ornamental plants with modified leaves
  misc_feature (1)..(497): Utility: Useful for making plants with altered leaf shape eg curled leaves
  misc_feature (1)..(497): Utility: Useful for making plants with increased biomass and foliage
  misc_feature (1)..(497): Utility: Useful for making smaller plants
MKHFNLLSIILVIVLATSYIDAFTRNDFPEDFLFGAGTSAYQWEGAANEDGRTPSVWDTTSHCYNGSNGDIACDGYHKYKEDVKLMAEMGLESFRFSISWSRLIPNGRGRINPKGLLFYKNLIKELRSHGIEPHVTLYHYDLPQSLEDEYGGWINHKIIEDFTAFADVCFREFGEDVKLWTTINEATIFAFAFYGKDVRYGNCTTGNYCMETYIAGHNMLLAHASASNLYKLKYKSKQRGSIGLSIFALGLTPYTNSKDDEIATQRAKAFLYGWMLKPLVFGDYPDEMKRTLGSRLPVFSEEESEQVKGSSDFVGIIHYTTVYVTNQPAPYIFPSSTNKDFFTDMGAYIISTGNSSSFVFDAVPWGLEGVLQHIKHRYNNPPIYILENGSPMKHDSMLQDTPRVEYIQAYIGAVLNAIKSGSDTRGYFVWSLIDLFEVQVGYKSSFGMYYVNFSDPGRKRSPKLSASWYTGFLNGTIDVASQDMTQLQRNFSGSSSL

SEQ ID NO: 5571 - protein, 506 aa, Arabidopsis thaliana
  misc_feature (1)..(506): useful for making plants with modified plant phenotypes as described in USSN 12/139,269
  misc_feature (1)..(506): Public GI no. 30687750
  misc_feature (1)..(506): Utility: Useful for delaying flowering time
  misc_feature (1)..(506): Utility: Useful for making ornamental plants with modified leaves
  misc_feature (1)..(506): Utility: Useful for making plants with altered leaf shape eg curled leaves
  misc_feature (1)..(506): Utility: Useful for making plants with increased biomass and foliage
  misc_feature (1)..(506): Utility: Useful for making smaller plants
MKHFSLLFIFLVILLATSYSDAFTRNSFPKDFLFGAATSAYQWEGAVAEDGRTPSVWDTFSNSYDTGNGDVTSDGYHKYKEDVKLMATMGLESFRFSISWSRLIPNGRGLINPKGLLFYNNLIKDLKSHGIEPHVTLYHYDLPQSLEDEYGGWINRKIIEDFTAYADVCFREFGEDVKLWTTINEATIFAIGSYDQGTAPPGHCSPNKFVNCSTGNSSTEPYIAGHNILLAHASASKLYKLKYKSKQKGSIGLSIFAFGLSPYTNSKDDEIATQRAKTFLYGWMLKPLVFGDYPDEMKKTVGSRLPVFSEEESEQVKGSSDFIGIIHYTTFYVTNHQPSASLFPSMGEGFFKDMGVYIIPTGNSSFLVWEATPWGLEGILEYIKQSYNNPPVYILENGMPMVRDSTLQDTQRIEYIQAYIDAVLNAMKNGSDTRGYFVWSMVDVYEILSGYTTSFGMYHVNFSDPGRKRTPKLSASWYTGFLNGTIDVASQDTIQLWSNFSVSSSL

SEQ ID NO: 5572 - protein, 508 aa, Arabidopsis thaliana
  misc_feature (1)..(508): useful for making plants with modified plant phenotypes as described in USSN 12/139,269
  misc_feature (1)..(508): Ceres CLONE ID no. 1352771
  misc_feature (1)..(508): Utility: Useful for delaying flowering time
  misc_feature (1)..(508): Utility: Useful for making ornamental plants with modified leaves
  misc_feature (1)..(508): Utility: Useful for making plants with altered leaf shape eg curled leaves
  misc_feature (1)..(508): Utility: Useful for making plants with increased biomass and foliage
  misc_feature (1)..(508): Utility: Useful for making smaller plants
MKLYSLLSVFLVILLATSDSDAFTRNNFPKDFLFGAATSAYQWEGAVAEDGRTPSVWDTFSHTYNRGNLGNGDITSDGYHKYKEDVKLMAEMGLESFRFSISWSRLIPNGRGLINPKGLLFYKNLIKELISHGIEPHVTLYHYDLPQSLEDEYGGWINRKIIEDFTAYADVCFREFGEDVKLWTTINEATIFAIGSYDQGISPPGHCSPNKFINCTSGNSSTEPYLAGHNILLAHASASKLYKLKYKSTQKGSIGLSIFAFGLSPYTNSKDDEIATQRAKAFFYGWMLKPLVFGDYPDEMKRTVGSRLPVFSEEESEQLKGSSDFIGIIHYTTFYVTNKPSPSIFPSMNEGFFKDMGVYMISAANSSFLLWEATPWGLEGILEYIKQSYNNPPIYILENGMPMGRDSTLQDTQRIEFIQAYIGAMLNAIKNGSDTRGYFVWSMIDLYELLSGYTTSFGMYYVNFSDPGRKRTPKLSASWYTGFLNGTIDVATQDTIQLQSNISGSSSL

SEQ ID NO: 5573 - protein, 508 aa, Arabidopsis thaliana; identical to SEQ ID NO: 5572
  misc_feature (1)..(508): useful for making plants with modified plant phenotypes as described in USSN 12/139,269
  misc_feature (1)..(508): Public GI no. 27363302
  misc_feature (1)..(508): Utility: Useful for delaying flowering time
  misc_feature (1)..(508): Utility: Useful for making ornamental plants with modified leaves
  misc_feature (1)..(508): Utility: Useful for making plants with altered leaf shape eg curled leaves
  misc_feature (1)..(508): Utility: Useful for making plants with increased biomass and foliage
  misc_feature (1)..(508): Utility: Useful for making smaller plants

SEQ ID NO: 5574 - protein, 502 aa, Arabidopsis thaliana
  misc_feature (1)..(502): useful for making plants with modified plant phenotypes as described in USSN 12/139,269
  misc_feature (1)..(502): Public GI no. 42566152
  misc_feature (1)..(502): Utility: Useful for delaying flowering time
  misc_feature (1)..(502): Utility: Useful for making ornamental plants with modified leaves
  misc_feature (1)..(502): Utility: Useful for making plants with altered leaf shape eg curled leaves
  misc_feature (1)..(502): Utility: Useful for making plants with increased biomass and foliage
  misc_feature (1)..(502): Utility: Useful for making smaller plants
MKPFSQFFVFVVTVSATSYIDAFTRNDFPNDFLFGAATSAYQWEGAFDEDGKSPSVWDTTSHCDSGSNNGDIACDGYHKYKEDVMLMAEMGLESFRFSISWSRLIPNGRGRINPKGLLFYKNLIKELRSHGIEPQVTLYHYDLPQSLEDEYGGWINRKIIEDFTAFADVCFREFGEDVKLWTKINEATLFAIGSYGDGMRYGHCPPMNYSTANVCTETYIAGHNMLLAHSSASNLYKLKYKTKQRGSVGLSIYAYGLSPYTDSKDDETATERAEAFLFGWMLKPLVVGDYPDIMKRTLGSRLPVFSEEESKQVKGSSDFVGVVHYNTFYVTNRPAPSLVTSINKLFFADIGAYLIAAGNASLFEFDAVPWGLEGILQHIKQSYNNPPIYILENGKPMKHGSTLQDTPRAEFIQAYIGAVHNAITNGSDTRGYFVWSMIDLYELIGRYMTSYGMYYVNFSDPGRKRSPKLSASWYTGFLNGTIDVASQDTIQLQRKCSGSSSL

SEQ ID NO: 5575 - protein, 498 aa, Arabidopsis thaliana
  misc_feature (1)..(498): useful for making plants with modified plant phenotypes as described in USSN 12/139,269
  misc_feature (1)..(498): Public GI no. 7269635
  misc_feature (1)..(498): Utility: Useful for delaying flowering time
  misc_feature (1)..(498): Utility: Useful for making ornamental plants with modified leaves
  misc_feature (1)..(498): Utility: Useful for making plants with altered leaf shape eg curled leaves
  misc_feature (1)..(498): Utility: Useful for making plants with increased biomass and foliage
  misc_feature (1)..(498): Utility: Useful for making smaller plants
MKHFSLLFIFLVILLATSYSDAFTRNSFPKDFLFGAATSAYQWEGAVAEDGRTPSVWDTFSNSYDTGNGDVTSDGYHKYKEDVKLMATMGLESFRFSISWSRLIPNGRGLINPKGLLFYNNLIKDLKSHGIEPHVTLYHYDLPQSLEDEYGGWINRKIIEDFTAYADVCFREFGEDVKLWTTINEATIFAIGSYDQGTAPPGHCSPNKFVNCSTGNSSTEPYIAGHNILLAHASASKLYKLKYKSKQKGSIGLSIFAFGLSPYTNSKDDEIATQRAKTFLYGWMLKPLVFGDYPDEMKKTVGSRLPVFSEEESEQVKGSSDFIGIIHYTTFYVTNHQPSASLFPSMGEGFFKDMGLLFLKWEATPWGLEGILEYIKQSYNNPPVYILENGMPMVRDSTLQDTQRIEYIQAYIDAVLNAMKNGSDTRGYFVWSMVDVYEILSGYTTSFGMYHVNFSDPGRKRTPKLSASWYTGFLNGTIDVASQDTIQLWSNFSVSSSL

SEQ ID NO: 5576 - protein, 507 aa, Arabidopsis thaliana
  misc_feature (1)..(507): useful for making plants with modified plant phenotypes as described in USSN 12/139,269
  misc_feature (1)..(507): Public GI no. 22328869
  misc_feature (1)..(507): Utility: Useful for delaying flowering time
  misc_feature (1)..(507): Utility: Useful for making ornamental plants with modified leaves
  misc_feature (1)..(507): Utility: Useful for making plants with altered leaf shape eg curled leaves
  misc_feature (1)..(507): Utility: Useful for making plants with increased biomass and foliage
  misc_feature (1)..(507): Utility: Useful for making smaller plants
MELTLSLLTIFLLFFALSGRCSDKNDFPEGFIFGSATSAYQWEGAFDEDGRKPSVWDTFLHTRNLSNGDITSDGYHKYKEDVKLMVETGLDAFRFSISWSRLIPNGRGPVNPKGLQFYKNFIQELVSHGIEPHVTLFHYDHPQYLEDEYGGWINRRIIQDFTAYANVCFREFGHHVKFWTTINEANIFTIGGYNDGITPPGRCSSPGRNCSSGNSSTEPYIVGHNLLLAHASASRLYKQKYKDMQGGSVGFSLFSLGFTPSTSSKDDDIAVQRAKDFYFGWMLEPFIFGDYPDEMKRTVGSRLPVFSKEESEQVKGSSDFIGIIHYLAASVTSIKIKPSISGNPDFYSDMGVSMTWTVLGNFSAFEYAVAPWAMESVLEYIKQSYGNPPIYILENGTPMKQDLQLQQKDTPRIEYLHAYIAAVLKSIRNGSDTRGYFIWSFMDLYELVKGYEFSFGLYSVNFSDPHRTRSPKLSAHWYSAFLKGNTTFLGSQGIMQMQSNFSSSASS

SEQ ID NO: 5577 - DNA, 834 bp, Arabidopsis thaliana
  misc_feature (1)..(834): useful for making plants with modified plant phenotypes as described in USSN 12/139,269
  misc_feature (1)..(834): Ceres CLONE ID no. 16461
  misc_feature (1)..(834): Also known as  Ceres CDNA ID no. 23388889
atattagtttgttatacaactcacttagaataatgtagattacatttcagccaaattcatgtaaaagatgcttttctttgtgatgtttttaaaatgctttcttttcactttttttctttcttaactataaatcttgatgcaatgcctaccttcttagaacataagatcttctttaaaatccaaaatcattcttgagagaaaagaaatcgaagatggcaacaaaatccaccggaggtaccgagaaaaccaagtcgatagaagtgaagaagaaactaatcaacgtgttgatcgtcgatgatgatccattaaaccgtagactccacgagatgatcatcaaaacgatcggaggaatttctcagactgcaaagaatggcgaggaggcagtgatcctccaccgtgacggcgaagcatctttcgaccttattctaatggataaggaaatgcctgagagggatggagtttcgacaactaagaagctaagagaaatgaaagtgacgtcaatgatcgttggggtaacgtcagtagctgaccaagaagaagagcgtaaggcttttatggaagctgggctcaaccattgcttggaaaaacccttaaccaaggccaagatcttcccgctcattagccacctcttcgatgcttgatggatgaaggctcattaatgtatctatattttcaatcatgaaatcacctacacgtgtatttgacacaaaaatctgcatttgttgtgatatagggtttctcatatctatgtttgatttattttcttatcgtccgaggtaaaatcatgcaagtcatttcttttggctaataaaatattaaaataaggttttctcc

SEQ ID NO: 5578 - protein, 142 aa, Arabidopsis thaliana
  misc_feature (1)..(142): useful for making plants with modified plant phenotypes as described in USSN 12/139,269
  misc_feature (22)..(142): Pfam Name: Response_reg; Pfam Description: Response regulator receiver domain
  misc_feature (1)..(142): Utility: Useful for delaying flowering time
  misc_feature (1)..(142): Utility: Useful for increasing chlorophyll and photosynthetic capacity
  misc_feature (1)..(142): Utility: Useful for making larger plants
  misc_feature (1)..(142): Utility: Useful for making ornamental plants with modified leaves
  misc_feature (1)..(142): Utility: Useful for making smaller plants
MATKSTGGTEKTKSIEVKKKLINVLIVDDDPLNRRLHEMIIKTIGGISQTAKNGEEAVILHRDGEASFDLILMDKEMPERDGVSTTKKLREMKVTSMIVGVTSVADQEEERKAFMEAGLNHCLEKPLTKAKIFPLISHLFDA

SEQ ID NO: 5579 - protein, 136 aa, Arabidopsis thaliana
  misc_feature (1)..(136): useful for making plants with modified plant phenotypes as described in USSN 12/139,269
  misc_feature (1)..(136): Public GI no. 3687688
  misc_feature (1)..(136): Utility: Useful for delaying flowering time
  misc_feature (1)..(136): Utility: Useful for increasing chlorophyll and photosynthetic capacity
  misc_feature (1)..(136): Utility: Useful for making larger plants
  misc_feature (1)..(136): Utility: Useful for making ornamental plants with modified leaves
  misc_feature (1)..(136): Utility: Useful for making smaller plants
MATKSMGDIEKIKKKLNVLIVDDDPLNLIIHEKIIKAIGGISQTANNGEEAVIIHRDGGSSFDLILMDKEMPERDGVSTTKKLREMEVKSMIVGVTSLADNEEERRAFMEAGLNHCLAKPLTKDKIIPLINQLMDA

SEQ ID NO: 5580 - protein, 132 aa, Glycine max
  misc_feature (1)..(132): useful for making plants with modified plant phenotypes as described in USSN 12/139,269
  misc_feature (1)..(132): Ceres CLONE ID no. 1051749
  misc_feature (1)..(132): Utility: Useful for delaying flowering time
  misc_feature (1)..(132): Utility: Useful for increasing chlorophyll and photosynthetic capacity
  misc_feature (1)..(132): Utility: Useful for making larger plants
  misc_feature (1)..(132): Utility: Useful for making ornamental plants with modified leaves
  misc_feature (1)..(132): Utility: Useful for making smaller plants
MAPKNLGTKLTALVVDDNILNRKIHQNLLESVGVKNQGVENGQEAVDIHCHGQIFDLILMDMDMPIMNGIEATKELRSMGIGSMIVGVSSRCTEAEIRKFMEAGLNDYHEKPLNNAKLSSILDKINPSFTRN

SEQ ID NO: 5581 - protein, 127 aa, Glycine max
  misc_feature (1)..(127): useful for making plants with modified plant phenotypes as described in USSN 12/139,269
  misc_feature (1)..(127): Public GI no. 50918565
  misc_feature (1)..(127): Utility: Useful for delaying flowering time
  misc_feature (1)..(127): Utility: Useful for increasing chlorophyll and photosynthetic capacity
  misc_feature (1)..(127): Utility: Useful for making larger plants
  misc_feature (1)..(127): Utility: Useful for making ornamental plants with modified leaves
  misc_feature (1)..(127): Utility: Useful for making smaller plants
MARKMIRVLLVEDEEINRVVARAALKAAGGGDVVDEAENGEVAVQRVRDAAAPYDLVLMDKQMPVMDGHEATRRIRGMGVTTPIVAVSSDGLPADVDAFITAGADDFTSKPLSKEKLGVILAKFRLA

SEQ ID NO: 5582 - DNA, 934 bp, Arabidopsis thaliana
  misc_feature (1)..(934): useful for making plants with modified plant phenotypes as described in USSN 12/139,269
  misc_feature (1)..(934): Ceres CLONE ID no. 17409
  misc_feature (1)..(934): Also known as  Ceres CDNA ID no. 23373418
gttttgtcctccttctacgccgcacactatcttttcctctcactcagacttcctcttcatctcaagagaaatggctgaatccaaggtagtggttccagagtctgtgctaaagaagatcaagaggcaagaggaatgggcattggccaagaaagatgaagctgtagctgcaaagaagaagagtgttgaggcccgcaagcttatcttcaagagagctgagcagtatgccaaagaatacgctgagaaggataacgagttgatccgattgaagcgggaggctaagttgaaaggaggtttctacgttgaccctgaggctaagttgctctttatcattcgtatccgtggtatcaatgccattgacccaaaaaccaagaagattctgcagctcctgcgtttgagacagatcttcaatggtgtgtttcttaaggtgaacaaggcaacagtaaacatgctgcgccgagttgaaccatacgtgacttacggatacccaaacttgaagagcgttaaggaactgatctacaaaagaggttatggaaagctgaaccaccagaggatagcacttactgacaactccattgtggatcaggctctcggaaagcatgggatcatctgcgttgaggatctcatccacgagatcatgactgttggacctcacttcaaggaagccaacaacttcctgtggccattccaattgaaggcaccactcggtggccttaagaagaagagaaaccactacgtcgaaggtggtgatgctggaaacagggagaatttcatcaacgagcttgtcaggagaatgaattgatgaaagcttccttctttatctttgcaaatttcaaagattttgggaccgagtttttttttttttttgttcaagttatcagagacttgtgatcttttatccgagataggctttttatgactaatcatgttattttcc

SEQ ID NO: 5583 - protein, 242 aa, Arabidopsis thaliana
  misc_feature (1)..(242): useful for making plants with modified plant phenotypes as described in USSN 12/139,269
  misc_feature (82)..(134): Pfam Name: Ribosomal_L30; Pfam Description: Ribosomal protein L30p/L7e
  misc_feature (11)..(81): Pfam Name: Ribosomal_L30_N; Pfam Description: Ribosomal L30 N-terminal domain
  misc_feature (1)..(242): Utility: Useful for delaying flowering time
  misc_feature (1)..(242): Utility: Useful for making larger plants
  misc_feature (1)..(242): Utility: Useful for making plants with altered leaf shape eg curled leaves
  misc_feature (1)..(242): Utility: Useful for making smaller plants
MAESKVVVPESVLKKIKRQEEWALAKKDEAVAAKKKSVEARKLIFKRAEQYAKEYAEKDNELIRLKREAKLKGGFYVDPEAKLLFIIRIRGINAIDPKTKKILQLLRLRQIFNGVFLKVNKATVNMLRRVEPYVTYGYPNLKSVKELIYKRGYGKLNHQRIALTDNSIVDQALGKHGIICVEDLIHEIMTVGPHFKEANNFLWPFQLKAPLGGLKKKRNHYVEGGDAGNRENFINELVRRMN

SEQ ID NO: 5584 - protein, 242 aa, Glycine max
  misc_feature (1)..(242): useful for making plants with modified plant phenotypes as described in USSN 12/139,269
  misc_feature (1)..(242): Ceres CLONE ID no. 1073780
  misc_feature (1)..(242): Utility: Useful for delaying flowering time
  misc_feature (1)..(242): Utility: Useful for making larger plants
  misc_feature (1)..(242): Utility: Useful for making plants with altered leaf shape eg curled leaves
  misc_feature (1)..(242): Utility: Useful for making smaller plants
MGEAKALVPESVVKKEKRNEEWALAKKQELDAAKKMRFETRKLIFNRAKQYSKEYDEQQKELIRLKREAKLKGGFYVEPEAKLLFIIRIRGINAMDPKTRKILQLLRLRQIFNGVFLKVNKATVNMLHRVEPYVTYGYPNLKSVRELIYKRGYGKVNKQRIALTDNSIIEQTLGKHGIICVEDLIHEIMTVGPHFKEANNFLWPLKLKAPLGGLEKKRNHYVEGGDAGNREDYINELIRRMN

SEQ ID NO: 5585 - protein, 244 aa, Zea mays
  misc_feature (1)..(244): useful for making plants with modified plant phenotypes as described in USSN 12/139,269
  misc_feature (1)..(244): Ceres CLONE ID no. 240836
  misc_feature (1)..(244): Utility: Useful for delaying flowering time
  misc_feature (1)..(244): Utility: Useful for making larger plants
  misc_feature (1)..(244): Utility: Useful for making plants with altered leaf shape eg curled leaves
  misc_feature (1)..(244): Utility: Useful for making smaller plants
MSSVASKVAVPESVLRKRKREEQWATEKKEKALVEKKKSIESRKLIFTRAKQYAEEYDAQEKELVQLKREARLKGGFYVSPEAKLLFVVRIRGINAMHPKTRKILQLLRLRQIFNGVFLKVNKATINMLRRVEPYVAYGYPNLKSVRELIYKRGYGKLNKQRIPLSNNQVIEEGLGKHNIICIEDLVHEIMTVGPHFKEANNFLWPFKLKAPLGGLKKKRNHYVEGGDAGNRENYINELIKRMN

SEQ ID NO: 5586 - protein, 244 aa, Zea mays
  misc_feature (1)..(244): useful for making plants with modified plant phenotypes as described in USSN 12/139,269
  misc_feature (1)..(244): Ceres CLONE ID no. 281173
  misc_feature (1)..(244): Utility: Useful for delaying flowering time
  misc_feature (1)..(244): Utility: Useful for making larger plants
  misc_feature (1)..(244): Utility: Useful for making plants with altered leaf shape eg curled leaves
  misc_feature (1)..(244): Utility: Useful for making smaller plants
MSSEAVKVAVPESVLRKRKREEQWAAEKKEKSLAERKKSIENRKLIFTRAKQYAEEYDAQEKELVQLKREARLKGGFYVSPEAKLLFVIRIRGINAMHPKTRKILQLLRLRQIFNGVFLKVNKATINMLRRVEPYVAYGYPNLKSVRELIYKRGYGKLNKQRIPLSNNQVIEEGLGKHNIICIEDLVHEIMTVGPHFKEANNFLWPFKLKAPLGGLKKKRNHYVEGGDAGNRENYINELIKRMN

SEQ ID NO: 5587 - protein, 245 aa, Zea mays
  misc_feature (1)..(245): useful for making plants with modified plant phenotypes as described in USSN 12/139,269
  misc_feature (1)..(245): Ceres CLONE ID no. 225601
  misc_feature (1)..(245): Utility: Useful for delaying flowering time
  misc_feature (1)..(245): Utility: Useful for making larger plants
  misc_feature (1)..(245): Utility: Useful for making plants with altered leaf shape eg curled leaves
  misc_feature (1)..(245): Utility: Useful for making smaller plants
MSAAEAKAAAVPESVLRKRKREEQWAADKKEKALADRKKALESRKIIFARAKQYAEEYHAQEKELVQLKREARLKGGFYVSPEAKLLFVVRIRGINAMHPKTRKILQLLRLRQIFNGVFLKVNKATINMLRRVEPYVAYGYPNLKSVRELIYKRGYGKLNKQRIPLSNNSVIEEGLGKHNIICIEDLVHEIMTVGPHFKEANNFLWPFKLKAPLGGLKKKRNHYVEGGDAGNRENYINELIKRMN

SEQ ID NO: 5588 - protein, 244 aa, Triticum aestivum
  misc_feature (1)..(244): useful for making plants with modified plant phenotypes as described in USSN 12/139,269
  misc_feature (1)..(244): Ceres CLONE ID no. 779692
  misc_feature (1)..(244): Utility: Useful for delaying flowering time
  misc_feature (1)..(244): Utility: Useful for making larger plants
  misc_feature (1)..(244): Utility: Useful for making plants with altered leaf shape eg curled leaves
  misc_feature (1)..(244): Utility: Useful for making smaller plants
  misc_feature (152)..(152): Xaa is any aa, unknown or other
  misc_feature (159)..(159): Xaa is any aa, unknown or other
  misc_feature (181)..(181): Xaa is any aa, unknown or other
  misc_feature (221)..(221): Xaa is any aa, unknown or other
MSSEAAKMVVPESVLLKRKREELWAAEKKTKAVEEKKKSSENIKVIYARAKQYAEEYDAQDKELVQLKREARMKGGFYVSPEAKLLFVVRIRGINAMHPKTKKILQLLRLRQIFNGVFLKVNKATINMLRRVEPYVAYGYPNLKSVRELIYXRGYGKLXKQRIPLTNNKVIEEGLGKHNIXCIEDLVHEILTVGPHFKEANNFLWPFKLKAPLGGLKKKRXHYVEGGDAGNRENYINQLVRRMN

SEQ ID NO: 5589 - DNA, 948 bp, Arabidopsis thaliana
  misc_feature (1)..(948): useful for making plants with modified plant phenotypes as described in USSN 12/139,269
  misc_feature (1)..(948): Ceres CLONE ID no. 17482
  misc_feature (1)..(948): Also known as  Ceres CDNA ID no. 23357748
acacataacacacacacatcttcttcctctctttatcttcttcttctctgtttctctaagaagatagaacaatcccaagaatctcctcttatttgatcaaccatgtcgaatgtcttgctatccccaaacggctacgtatttgcatcgcctaaacctcttggcagattcatcaattcaaagtccggcggacggaaacttttcttctccgtcgttagagcttcttccgatgatgctgattgtaatgccgaagaatgtgctcccgagaaggaggtaggaacagtgagtatggaatggttagctggagagaagaccaaagtggtgggaacatttcctcctcggaagccgcgtggttggactggctatgtagagaaagatactgctggtcagactaatgtttactccattgagcctgcagtatatgttgcagagagcgcgattagctcaggtactgcaggatcatcggctgatggggctgagaacacagcagcaatcgtagcaggcattgctcttatcgcagtcgctgcagcttcctctatactcctccaagtcgggaaagatgccccaactcgacccaaagcagtggattacagtggaccgtctcttagctactacatcaacaagttcaagccttctgaaattgttcaaccttctaccccctccgtcacagaagccccaccggtggccgagctagaaacttcactgccagaaactccaccggtggctcagcaagaaacctcactgccggaaactatggctagtgaggctcagccagaggcgtcttttgttccaacaacaagtagtacctcttaggggcttagcctaggattatatctttgtgtaaaaatgagatgaagcatataccaagattatgcattctgttaatattcggatatacctatatgtatgtatacactctgtcactcttctctttgagtgaatgattatacc

SEQ ID NO: 5590 - protein, 235 aa, Arabidopsis thaliana
  misc_feature (1)..(235): useful for making plants with modified plant phenotypes as described in USSN 12/139,269
  misc_feature (1)..(235): Utility: Useful for delaying flowering time
  misc_feature (1)..(235): Utility: Useful for making lethal plants for genetic confinement systems
  misc_feature (1)..(235): Utility: Useful for making plants with altered leaf shape eg curled leaves
  misc_feature (128)..(128): Xaa is any aa, unknown or other
MSNVLLSPNGYVFASPKPLGRFINSKSGGRKLFFSVVRASSDDADCNAEECAPEKEVGTVSMEWLAGEKTKVVGTFPPRKPRGWTGYVEKDTAGQTNVYSIEPAVYVAESAISSGTAGSSADGAENTXAIVAGIALIAVAAASSILLQVGKDAPTRPKAVDYSGPSLSYYINKFKPSEIVQPSTPSVTEAPPVAELETSLPETPPVAQQETSLPETMASEAQPEASFVPTTSSTS

SEQ ID NO: 5591 - protein, 238 aa, Arabidopsis thaliana
  misc_feature (1)..(238): useful for making plants with modified plant phenotypes as described in USSN 12/139,269
  misc_feature (1)..(238): Public GI no. 51457942
  misc_feature (1)..(238): Utility: Useful for delaying flowering time
  misc_feature (1)..(238): Utility: Useful for making lethal plants for genetic confinement systems
  misc_feature (1)..(238): Utility: Useful for making plants with altered leaf shape eg curled leaves
MACAALSANSCTIASSSTGRLSFSTYQKDSKLRQRHSLVRFRVRASTDDSDCNAEECAPDKEVGKVSMEWVAMDNTKVVGTFPPRKPRGWTGYVEKDTAGQTNIYSVEPAVYVAESAISSGTAGTSSDGAENTKAISAGIALISVAAASSILLQVGKNSPPPIQTVEYRGPSLSYYINKLKPAEIVQASITEAPTAPETEEVAITPEVESSAPEAPAPQVEVQSEAPQDTSSSSSNIS

SEQ ID NO: 5592 - protein, 223 aa, Glycine max
  misc_feature (1)..(223): useful for making plants with modified plant phenotypes as described in USSN 12/139,269
  misc_feature (1)..(223): Ceres CLONE ID no. 658444
  misc_feature (1)..(223): Utility: Useful for delaying flowering time
  misc_feature (1)..(223): Utility: Useful for making lethal plants for genetic confinement systems
  misc_feature (1)..(223): Utility: Useful for making plants with altered leaf shape eg curled leaves
MACALQATLAANTYAFSSRRFSLKHQKNSKRRFSLFTVRADSDDSDCNEEECAPDKEVGKVSVEWLAGEKTKVVGTFPPRRKPGWTGYVEKDTAGQTNIYSVEPAVYVAESAISSGTAGSSSDGAENTAAIVAGLALISIAAASSILLQVGKNAPPQIQTAQYSGPSLSYYINKFTPPEITQVSVPSEAELSSSVQPESPPPEVSQVQVEAQASETSSVNIES

SEQ ID NO: 5593 - protein, 231 aa, Zea mays
  misc_feature (1)..(231): useful for making plants with modified plant phenotypes as described in USSN 12/139,269
  misc_feature (1)..(231): Ceres CLONE ID no. 1559567
  misc_feature (1)..(231): Utility: Useful for delaying flowering time
  misc_feature (1)..(231): Utility: Useful for making lethal plants for genetic confinement systems
  misc_feature (1)..(231): Utility: Useful for making plants with altered leaf shape eg curled leaves
MACPAQSMLSASGCILLRSKPRASSSHVRGGIIGGGCSSRPFQLTCNASSSPSPPSPAPAQEDPDCNDEECAPEKEVGSLRAEWLAEERTQVVGTFPPRKRGWTGLVEKDTAGQTNIYSVEPVVYVAESAISSGAAGMSAEGAENTAAIAAGLVLITVAAASSILIQVNKSQPQVPEAAYNGPPLSYYVAKFQPAQTLEAPAPAEAVEAQDGAATVQDSAAPEAQEAVLIS

SEQ ID NO: 5594 - DNA, 1266 bp, Arabidopsis thaliana
  misc_feature (1)..(1266): useful for making plants with modified plant phenotypes as described in USSN 12/139,269
  misc_feature (1)..(1266): Ceres CLONE ID no. 17632
  misc_feature (1)..(1266): Also known as  Ceres CDNA ID no. 23374596
aaaatctcatctttttccctcgacgacaaccaccttagggttaggtttattttctcgcttattctctctaactctttttccctattccgatttcgatttgtcttctccgattcgcttttcctttcgctctctagactctagagtcaatttgatttctactctcgtatcggatctatacttaatcatggatactcgtaagagaggacggcctgaagctggctcattcaactccaatggcggcggatacaagaagtctaagcaagagatggaatcatattcaactggtttaggaagcaaatcgaagccatgcacaaaatttttcagtacttctggctgtcctttcggagagaattgccatttcttgcattatgttcccggaggatacaatgctgtatcgcagatgacaaatatgggaccacccattcctcaagtttccagaaacatgcaaggttctggtaatggaggccgattctcagggaggggagagtctgggcctggccatgtctctaactttggtgactcagccactgccagattcagtgttgatgcctctttagccggtgcaatcattgggaaaggcggagtcagttcaaagcagatatgtcgtcagacgggagtaaaattatcaattcaagatcacgagagagacccaaacttgaagaacattgtgcttgaaggaacacttgagcagataagcgaagcgagtgcaatggtaaaagatttgattgggaggcttaattcagcagctaagaaaccacctggtggtggtcttggtggtggtggtggcatgggttctgaagggaaaccacatccagggagcaacttcaagactaagatatgtgagagattctcaaaaggaaactgtacatttggtgatagatgtcactttgctcatggggaagcagagctacgcaagtcaggaatcgtctagttgttgcttgcagatagagaatttgctggtaaaactagtttcttatttagtggtggtgatatctgatatcatcttcacctactttgtttttgtttgttatgagagaatacaattttagtttcattatcattgtaagtctatttggtgtttttttttaatagctttagtttttggttaattctgagtatgaattgagatgggaggaagcttgaagagaatgattgacaaaactcagaaacagtggttaggattgtatgacgccttttattcatattcttgttatctccgttatgtcatgtgtgtgaatcacttatataattttcgtaagattttcc

SEQ ID NO: 5595 - protein, 248 aa, Arabidopsis thaliana
  misc_feature (1)..(248): useful for making plants with modified plant phenotypes as described in USSN 12/139,269
  misc_feature (37)..(63): Pfam Name: zf-CCCH; Pfam Description: Zinc finger C-x8-C-x5-C-x3-H type (and similar)
  misc_feature (115)..(177): Pfam Name: KH_1; Pfam Description: KH domain
  misc_feature (1)..(248): Utility: Useful for delaying flowering time
  misc_feature (1)..(248): Utility: Useful for increasing chlorophyll and photosynthetic capacity
  misc_feature (1)..(248): Utility: Useful for making plants with increased biomass and foliage
  misc_feature (1)..(248): Utility: Useful for making smaller plants
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 5596 - protein, 295 aa, Glycine max
  misc_feature (1)..(295): useful for making plants with modified plant phenotypes as described in USSN 12/139,269
  misc_feature (1)..(295): Ceres CLONE ID no. 473410
  misc_feature (1)..(295): Utility: Useful for delaying flowering time
  misc_feature (1)..(295): Utility: Useful for increasing chlorophyll and photosynthetic capacity
  misc_feature (1)..(295): Utility: Useful for making plants with increased biomass and foliage
  misc_feature (1)..(295): Utility: Useful for making smaller plants
MDIRKRGRPEPGFSLNGGFKKSKQEMESLSTGVGSKSKPCTKFFSTAGCPFGEGCHFLHYVPGGYNAVAHMMNLTPAAPLPPTRNVAALPHVPNGSAPSAVKTRICNKFNTAEGCKFGDKCHFAHGEWELGKHIAPSFDDHRAMGPPGAGRLAGRMEPPGPAASFGANSTAKISVEASLAGAIIGKGGVNSKQICRQTGAKLSIREHESDPNLRNIELEGSFEQIKEASNMVKDLLLTLQMSAPPKTTPGVPGAPASHGSNFKTKLCENFAKGSCTFGDRCHFAHGASELRKSGV

SEQ ID NO: 5597 - protein, 300 aa, Glycine max
  misc_feature (1)..(300): useful for making plants with modified plant phenotypes as described in USSN 12/139,269
  misc_feature (1)..(300): Public GI no. 50905911
  misc_feature (1)..(300): Utility: Useful for delaying flowering time
  misc_feature (1)..(300): Utility: Useful for increasing chlorophyll and photosynthetic capacity
  misc_feature (1)..(300): Utility: Useful for making plants with increased biomass and foliage
  misc_feature (1)..(300): Utility: Useful for making smaller plants
MEVGGRKRGKPDGANGAGGKRARESESFQTGVGSKSKPCTKFFSTSGCPFGEGCHFLHHFPGGYQAVAKMTNLGGPAIAPPPGRMPMGNAVPDGPPTPTVKTRLCNKYNTAEGCKWGDKCHFAHGERELGKPMLMDSSMPPPMGPRPTGHFAPPPMPSPAMSTPASFGASATAKISVDASLAGGIIGRGGVNTKQISRVTGAKLAIRDHESDTNLKNIELEGTFDQIKNASAMVRELIVSIGGGAPPQGKKPVGGSHRGGGPGSNFKTKLCENFTKGSCTFGDRCHFAHGENELRKSAAA

SEQ ID NO: 5598 - protein, 299 aa, Triticum aestivum
  misc_feature (1)..(299): useful for making plants with modified plant phenotypes as described in USSN 12/139,269
  misc_feature (1)..(299): Ceres CLONE ID no. 703717
  misc_feature (1)..(299): Utility: Useful for delaying flowering time
  misc_feature (1)..(299): Utility: Useful for increasing chlorophyll and photosynthetic capacity
  misc_feature (1)..(299): Utility: Useful for making plants with increased biomass and foliage
  misc_feature (1)..(299): Utility: Useful for making smaller plants
MDAGRKRAVPEGANGGAAVKRARESESVQTGVGSKSKPCTKFFSTAGCPFGSSCHFLHNFPGGHQAVSKMTNLGGPAVSAPQGRMPMGPGVPDGPPTPSLKTRLCNKFNTAEGCKWGNKCHFAHGERELGKPMLLNNSMAPPMGPRPNGHFQPPPMPGPDMVPPSTFGASATAKISVDASLAGAIIGKGGVNTKHISRMTGAKLAIRDNEADPNHKNIELEGSFDQVNHASAMVKELILRIGGNAPPQAKNPGRGPAGGGGGSNFKTKLCDNFNKGSCTFGDRCHFAHGESELRKSAAA

SEQ ID NO: 5599 - protein, 339 aa, Zea mays
  misc_feature (1)..(339): useful for making plants with modified plant phenotypes as described in USSN 12/139,269
  misc_feature (1)..(339): Ceres CLONE ID no. 277297
  misc_feature (1)..(339): Utility: Useful for delaying flowering time
  misc_feature (1)..(339): Utility: Useful for increasing chlorophyll and photosynthetic capacity
  misc_feature (1)..(339): Utility: Useful for making plants with increased biomass and foliage
  misc_feature (1)..(339): Utility: Useful for making smaller plants
FLHFSASDLVANRTGGLGFRCASAIGREARLGMEGTAAARKRSRPETANGAAAAGKRSKDTESFQTGLSSKSKPCTKFFSTIGCPFGEGCHFLHFVPGGYPAVAKMLNLSSSAVSAPSRTHVDHAALTGASHPASTVKTRMCTKYNTTEGCKFGDKCHFAHSERELAKPAYMSQEGPPMGGRYGRAEPMQPAAMGPPAGNFGASATAKISVDASLAGGIIGKGGVNTKQISRITGVKLSIRDHESNPNLKNIELEGNFDQIKQASDLVRDLIATISASMPAKNPSAAAAPAGGGRGGGPGGKSSNYKTKLCENFLKGACTFGDRCHFAHGETEQRRGAA

SEQ ID NO: 5600 - protein, 306 aa, Zea mays
  misc_feature (1)..(306): useful for making plants with modified plant phenotypes as described in USSN 12/139,269
  misc_feature (1)..(306): Ceres CLONE ID no. 1459706
  misc_feature (1)..(306): Utility: Useful for delaying flowering time
  misc_feature (1)..(306): Utility: Useful for increasing chlorophyll and photosynthetic capacity
  misc_feature (1)..(306): Utility: Useful for making plants with increased biomass and foliage
  misc_feature (1)..(306): Utility: Useful for making smaller plants
MDAAARKRSRPESANGGAAGGKRSRESESQQTGLSSKSKPCTKFFSTVGCPFGEGCHFAHFVPGGYQAVSKSHSLGHAAVSAPSRAPADHAASGVKTRMCTKYNTAEGCKFGDKCHFAHGERELGRPPSSYMSQESSYAPPMGGRYGGRHEPPLPASMGPPAGNFGASSTCKVSVDAALAGGIIGKGGVNTKQICRITGVKLSIRDHESNPDLKNIELEGSFDQIKQANDMVRDLIASISASTPSKNPASAAAPAGRGGGGGGGGPGGRSNYKTKICENFLKGTCTFGERCHFAHGETEQRKGAAV

SEQ ID NO: 5601 - DNA, 1787 bp, Arabidopsis thaliana
  misc_feature (1)..(1787): useful for making plants with modified plant phenotypes as described in USSN 12/139,269
  misc_feature (1)..(1787): Ceres CLONE ID no. 18612
  misc_feature (1)..(1787): Also known as  Ceres CDNA ID no. 23381084
aaaagcttataaacacatacaaataaatccacttcaaagtttttctcttttttctctgcattattatcacttcaccacattcacaacaatcccaaatttttctttctcatacttcatattttgattactacttctcagagattcttttgagaaagagagtgagggcaataaaaaaagctatggatttcgatttgaacggaggaaacaaacgagtcttcaacagactcggtggcggcggcggcgtcggcggcgggtcaactcgtccgatggcaccaacggatacaagacaaaaggtttgtttccactggcgagctgggcgttgtaatcgttctccttgtccttatctacatcgggaattaccgggtcctggtccgggtcagggtcaaggtccgggttatacgaacaaaagggttgctgaggaatctggttttgcgggtccgagtcatcggagaggacctgggtttaatgggaactcgagtagtagttgggggagatttggtgggaacagaacggtgacgaagactgagaaagtttgcaacttttgggtagatgggaattgcacatacggtgataagtgtagatacttgcattgttggagtaaaggagagagctttgcgttgttgactcagcttgatggtcatgagaagcttgttagtggtattgctttgccttctggttctgataagctttacactggaagtaaagatgagaccttgcgtgtttgggattgtgcttctggacagtgtacaggagtactcaaacttggtggggaaattggctgtgtgcttagtgaaggcccgaggctattagttggcatgccaaatcttgtcaaggcgtggaatattgaaaccaatgctgaccagagtctaagtggacctgttggccaagtctattctcttgttgtgggtactgatctgctctttgctggaacacaggatggctctattttggcatggagatataatgctgccactaactgttttgaaccagcagcgtcactgacgggccatacacttgcagttgttaccttatatgttggggcaaacagactttattcaggttccatggacaaaactataaaagtttggagtttggataatctacagtgtatacaaacactcacggatcatacatcagttgtgatgtctcttatttgctgggatcagtttcttttgtcttgttcattggacaacacggttaagatatgggctgcaattgaaggtggcaatttggaagtaacatatactcacaaagaagaacatggagtgctagctctatgtggtgtacatgatgcagaagccaagcctgttttgttatgcgcttgcaatgacaacaccttgcgcctctacgacttaccatcatttacggagaggggaaaaatctttgcaaagcaagagatacgggcgatccagataggtcccgggggcatatttttcacgggtgatggaactggtcaagttaaagtatggaaatggtgcactgaaccaaccgcggctttgccttgagaaagtttgatgctatcgtcaactagatgttttctacgattttcttgtaccattatatatgagtctatttttgagacttttctttcttgttgaggtcctagtagaagccacggtttgatgaaatggacagtggccaagatcgtgtcatgttaggagttttgagacagaattgggagaatttaggtccctttttgtccaatttcagcatttgtcttgtaacacttggattgtattggtcaatttatcataaaggattatcttattcaagagagattcagagtt

SEQ ID NO: 5602 - protein, 441 aa, Arabidopsis thaliana
  misc_feature (1)..(441): useful for making plants with modified plant phenotypes as described in USSN 12/139,269
  misc_feature (352)..(391): Pfam Name: WD40; Pfam Description: WD domain, G-beta repeat
  misc_feature (114)..(139): Pfam Name: zf-CCCH; Pfam Description: Zinc finger C-x8-C-x5-C-x3-H type (and similar)
  misc_feature (1)..(441): Utility: Useful for delaying flowering time
  misc_feature (1)..(441): Utility: Useful for making ornamental plants with modified leaves
  misc_feature (1)..(441): Utility: Useful for making plants sterile and for genetic confinement
  misc_feature (1)..(441): Utility: Useful for making plants with increased biomass and foliage
  misc_feature (1)..(441): Utility: Useful for making smaller plants
MDFDLNGGNKRVFNRLGGGGGVGGGSTRPMAPTDTRQKVCFHWRAGRCNRSPCPYLHRELPGPGPGQGQGPGYTNKRVAEESGFAGPSHRRGPGFNGNSSSSWGRFGGNRTVTKTEKVCNFWVDGNCTYGDKCRYLHCWSKGESFALLTQLDGHEKLVSGIALPSGSDKLYTGSKDETLRVWDCASGQCTGVLKLGGEIGCVLSEGPRLLVGMPNLVKAWNIETNADQSLSGPVGQVYSLVVGTDLLFAGTQDGSILAWRYNAATNCFEPAASLTGHTLAVVTLYVGANRLYSGSMDKTIKVWSLDNLQCIQTLTDHTSVVMSLICWDQFLLSCSLDNTVKIWAAIEGGNLEVTYTHKEEHGVLALCGVHDAEAKPVLLCACNDNTLRLYDLPSFTERGKIFAKQEIRAIQIGPGGIFFTGDGTGQVKVWKWCTEPTAALP

SEQ ID NO: 5603 - protein, 430 aa, Arabidopsis thaliana
  misc_feature (1)..(430): useful for making plants with modified plant phenotypes as described in USSN 12/139,269
  misc_feature (1)..(430): Ceres CLONE ID no. 1359803
  misc_feature (1)..(430): Utility: Useful for delaying flowering time
  misc_feature (1)..(430): Utility: Useful for making ornamental plants with modified leaves
  misc_feature (1)..(430): Utility: Useful for making plants sterile and for genetic confinement
  misc_feature (1)..(430): Utility: Useful for making plants with increased biomass and foliage
  misc_feature (1)..(430): Utility: Useful for making smaller plants
MDLDMNGGNKRVFQRLGGGSNRPTTDSNQKVCFHWRAGRCNRYPCPYLHRELPGPGSGPVAASSNKRVADESGFAGPSHRRGPGFSGTANNWGRFGGNRTVTKTEKLCKFWVDGNCPYGDKCRYLHCWSKGDSFSLLTQLDGHQKVVTGIALPSGSDKLYTASKDETVRIWDCASGQCTGVLNLGGEVGCIISEGPWLLVGMPNLVKAWNIQNNADLSLNGPVGQVYSLVVGTDLLFAGTQDGSILVWRYNSTTSCFDPAASLLGHTLAVVSLYVGANRLYSGAMDNSIKVWSLDNLQCIQTLTEHTSVVMSLICWDQFLLSCSLDNTVKIWAATEGGNLEVTYTHKEEYGVLALCGVHDAEAKPVLLCSCNDNSLHLYDLPSFTERGKILAKQEIRSIQIGPGGIFFTGDGSGQVKVWKWSTESTPILS

SEQ ID NO: 5604 - protein, 430 aa, Arabidopsis thaliana; identical to SEQ ID NO: 5603
  misc_feature (1)..(430): useful for making plants with modified plant phenotypes as described in USSN 12/139,269
  misc_feature (1)..(430): Public GI no. 12057164
  misc_feature (1)..(430): Utility: Useful for delaying flowering time
  misc_feature (1)..(430): Utility: Useful for making ornamental plants with modified leaves
  misc_feature (1)..(430): Utility: Useful for making plants sterile and for genetic confinement
  misc_feature (1)..(430): Utility: Useful for making plants with increased biomass and foliage
  misc_feature (1)..(430): Utility: Useful for making smaller plants

SEQ ID NO: 5605 - protein, 427 aa, Zea mays
  misc_feature (1)..(427): useful for making plants with modified plant phenotypes as described in USSN 12/139,269
  misc_feature (1)..(427): Ceres CLONE ID no. 374674
  misc_feature (1)..(427): Utility: Useful for delaying flowering time
  misc_feature (1)..(427): Utility: Useful for making ornamental plants with modified leaves
  misc_feature (1)..(427): Utility: Useful for making plants sterile and for genetic confinement
  misc_feature (1)..(427): Utility: Useful for making plants with increased biomass and foliage
  misc_feature (1)..(427): Utility: Useful for making smaller plants
MDIEADGRFGNKRVHNRLGPGSGGAPPSTNGKVCNYWRAGRCNRFPCPFLHSELPEAAPPKRPTGPGGNVWRNPNTGGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 5606 - protein, 427 aa, Zea mays
  misc_feature (1)..(427): useful for making plants with modified plant phenotypes as described in USSN 12/139,269
  misc_feature (1)..(427): Public GI no. 50919691
  misc_feature (1)..(427): Utility: Useful for delaying flowering time
  misc_feature (1)..(427): Utility: Useful for making ornamental plants with modified leaves
  misc_feature (1)..(427): Utility: Useful for making plants sterile and for genetic confinement
  misc_feature (1)..(427): Utility: Useful for making plants with increased biomass and foliage
  misc_feature (1)..(427): Utility: Useful for making smaller plants
MAAVQLLPLPPAAPPQPRRGKPGCWNTPPAPPKVCHYWKSGRCSRNPCRFLHTDAPDPAPPIAAVNTRSNTWVNPSCVAANSDGKGRAPPVQPAKRQVEAPPETPAKRRCGGGAWCVGDGFCGVARLKGHAKAVTGFALPEGSDKLFSGSLDSTVRAWDCSTGQCVRVEEMQEGEVHKLIAMGPWVLAGVRGAVKAIHTGTGKELRLRGPASQITAMLAEDEDHLFAGAEDGAVFMWRMNQEQQSFDEVAALTGHYKAVVSLAQGKGALYSGSTDGSIRVWDLDTHRCIYSFAGHSSTVTALLCWERFLLSSSDDGTVKVWQWKPDHDDLDLEVHYTHKEDERVVSMDGTYDADEKPVLLVSRGDGVVRVYDLPSLKKRGDIICDDEVRTISVRSRGVVFTGDASGEVRVVKWTSLSDAAESYLAMA

SEQ ID NO: 5607 - protein, 441 aa, Triticum aestivum
  misc_feature (1)..(441): useful for making plants with modified plant phenotypes as described in USSN 12/139,269
  misc_feature (1)..(441): Ceres CLONE ID no. 925629
  misc_feature (1)..(441): Utility: Useful for delaying flowering time
  misc_feature (1)..(441): Utility: Useful for making ornamental plants with modified leaves
  misc_feature (1)..(441): Utility: Useful for making plants sterile and for genetic confinement
  misc_feature (1)..(441): Utility: Useful for making plants with increased biomass and foliage
  misc_feature (1)..(441): Utility: Useful for making smaller plants
MAAVQRRQPLPPASHQLRRADPACPGTAPPPVCRYWKSGHCGRNPCRFLHADPAPPPPVVVVAKKRSNTWVNTSSKIAKPSATTDEGEAAVPPVPPPTKAKPSPATNAREAAVPLPPPERVQEPPGSGAWCVGDGIRGVARLEGHSKAVTGVAVPEGSGKLFSGSLDGTVRAWDCATGQCVRVAPVQEGEVGRLIAMGPWVLVRVRGAVRAFQAGSGEELRLRLPVAAAQVTALLAEDDERLFAGVEDGAIYMWRLDPGRQRFDEVAALAGHDGHAVASLAQGKGALYSGAADGGIRVWDLETRRCVCSFAGHASMVTALLCWDRFLLSSSVDGTVKAWRSKPDRAGDVEPELEVHYTHREEGERVVAMDGTHDADKKPVLLVSRGDGVVRVCDLPSFKPRGQIRCNGEVTAMSLRTPGVIFTGDKSGEVRVVKWTPAAAA

SEQ ID NO: 5608 - DNA, 1326 bp, Arabidopsis thaliana
  misc_feature (1)..(1326): useful for making plants with modified plant phenotypes as described in USSN 12/139,269
  misc_feature (1)..(1326): Ceres CLONE ID no. 18820
  misc_feature (1)..(1326): Also known as  Ceres CDNA ID no. 23386374
agccttttcatctctcttgcatcacaagtaaacctctcatcattcatttccacacagcactgaaactcgagcatttgctctctcgaatcccatttccctagctaaaaggttcggaattccacaacaacaacaaaagacctattttgtgaatcttttctctaaattaagagttattagggcaaatttctacatagcatgggctacatctccaacaacaacctcatcaactatttgcccctctctactactcaacctcctcttcttctcacccactgtgatattaacggcaatgatcaccatcagctcataaccgcatcatcaggagaacacgatattgatgaacggaaaaacaacattcctgcggcggcgactttgagatggaatccgacgccagagcagatcacgacgctagaagagctttacagaagcggaacacggacgccgacgacggaacagatccaacagatagcatctaagcttcgtaaatatgggagaatcgaagggaagaacgttttctattggtttcagaatcataaggctagagagagactaaaacgccgccgtcgtgaaggtggtgctattatcaaaccacataaagacgtcaaggattcatcatcaggtggtcatcgagttgatcagacaaagctctgcccatcttttccacacacaaaccgaccacagccacagcatgaattagatcctgcgagttacaataaagacaacaatgctaataatgaagatcatgggacgactgaagaatctgatcagagggcatcagaggttggtaaatacgccacatggagaaatcttgttacttggtcgataactcaacaaccggaagagattaatatcgacgaaaatgtcaacggagaagaagaagaaacgagggacaaccggactttaaatctctttccggttagggagtaccaagagaaaacaggccggttgatagagaagacgaaagcatgcaactactgttactactacgagttcatgcctctgaagaactgaaacaaaaaacccatgtgtgaataataaataggactttaatgaaggttttatttgttgttttgtccacgaatggtaagtgatgtgttcttataatagaagagaagcgtttgaagatggagacgtgtagtaaatgttatataggagcgtttgaagattattattgttagttattacccaaatgagaaggtggaccatgttggggcttgggtttggagttgcaactatctatacatatgtctgaaagtgaaactgaaagcttcgatggttccttgtcaatgtaaggaatatatattaattagatgtttgttagtaatc

SEQ ID NO: 5609 - protein, 271 aa, Arabidopsis thaliana
  misc_feature (1)..(271): useful for making plants with modified plant phenotypes as described in USSN 12/139,269
  misc_feature (58)..(119): Pfam Name: Homeobox; Pfam Description: Homeobox domain
  misc_feature (1)..(271): Utility: Useful for delaying flowering time
  misc_feature (1)..(271): Utility: Useful for making ornamental plants with modified leaves
  misc_feature (1)..(271): Utility: Useful for making plants that grow better in shade
  misc_feature (1)..(271): Utility: Useful for making plants with altered leaf shape eg curled leaves
  misc_feature (1)..(271): Utility: Useful for making plants with enhanced abiotic stress tolerance
  misc_feature (1)..(271): Utility: Useful for making plants with increased biomass and foliage
  misc_feature (1)..(271): Utility: Useful for making smaller plants
MGYISNNNLINYLPLSTTQPPLLLTHCDINGNDHHQLITASSGEHDIDERKNNIPAAATLRWNPTPEQITTLEELYRSGTRTPTTEQIQQIASKLRKYGRIEGKNVFYWFQNHKARERLKRRRREGGAIIKPHKDVKDSSSGGHRVDQTKLCPSFPHTNRPQPQHELDPASYNKDNNANNEDHGTTEESDQRASEVGKYATWRNLVTWSITQQPEEINIDENVNGEEEETRDNRTLNLFPVREYQEKTGRLIEKTKACNYCYYYEFMPLKN

SEQ ID NO: 5610 - protein, 250 aa, Zea mays
  misc_feature (1)..(250): useful for making plants with modified plant phenotypes as described in USSN 12/139,269
  misc_feature (1)..(250): Ceres CLONE ID no. 277479
  misc_feature (1)..(250): Utility: Useful for delaying flowering time
  misc_feature (1)..(250): Utility: Useful for making ornamental plants with modified leaves
  misc_feature (1)..(250): Utility: Useful for making plants that grow better in shade
  misc_feature (1)..(250): Utility: Useful for making plants with altered leaf shape eg curled leaves
  misc_feature (1)..(250): Utility: Useful for making plants with enhanced abiotic stress tolerance
  misc_feature (1)..(250): Utility: Useful for making plants with increased biomass and foliage
  misc_feature (1)..(250): Utility: Useful for making smaller plants
MRLHHFHVAYLDKAAGSPPPSSSPPSISPASHSHSSSSAATIVPLALQQYCLRPLAPKISFPEARKMVVLPEFARVRNASSRLLNCTVQVPPTTTTVGGTTRWNPSPDQIRVLEMLYRGGMRTPNSFQIEQITEELGKYGRIEGKNVFYWFQNHKARERQKQKRAALLTLSTTTTASTLLPPAAETKEGVETKKEEACEDASSRKRRCRAWEDVVVHGGGDDAGTEVADDYYTDDDVTLELFPLRPDQGK

SEQ ID NO: 5611 - protein, 264 aa, Brassica napus
  misc_feature (1)..(264): useful for making plants with modified plant phenotypes as described in USSN 12/139,269
  misc_feature (1)..(264): Ceres CLONE ID no. 978584
  misc_feature (1)..(264): Utility: Useful for delaying flowering time
  misc_feature (1)..(264): Utility: Useful for making ornamental plants with modified leaves
  misc_feature (1)..(264): Utility: Useful for making plants that grow better in shade
  misc_feature (1)..(264): Utility: Useful for making plants with altered leaf shape eg curled leaves
  misc_feature (1)..(264): Utility: Useful for making plants with enhanced abiotic stress tolerance
  misc_feature (1)..(264): Utility: Useful for making plants with increased biomass and foliage
  misc_feature (1)..(264): Utility: Useful for making smaller plants
  misc_feature (118)..(118): Xaa is any aa, unknown or other
  misc_feature (119)..(119): Xaa is any aa, unknown or other
HFRNKDIRAMKVHEFSNGFSSWEQHDSPSSLSLSCKRLRPLGPKLSGSPCSPSSSSGVTSATFDLKSFIKPDQTGPRKFEYSIEHQRDLPHVGTHQGGTRWNPTQEQIGILEMLYKGXXRTPNAQQIENITSQLGKYGKIEGKNVFYWFQNHKARERQKQKRNNFISLSCLSSFKTTNINNASVTTKTTTSSNDVIRRDSMVEKGELVEEAEYKRTCRSWGFENLEIDSRRNINSSKNATMATTFNKIIENVTLELFPLHPEGR

SEQ ID NO: 5612 - protein, 231 aa, Glycine max
  misc_feature (1)..(231): useful for making plants with modified plant phenotypes as described in USSN 12/139,269
  misc_feature (1)..(231): Ceres CLONE ID no. 673690
  misc_feature (1)..(231): Utility: Useful for delaying flowering time
  misc_feature (1)..(231): Utility: Useful for making ornamental plants with modified leaves
  misc_feature (1)..(231): Utility: Useful for making plants that grow better in shade
  misc_feature (1)..(231): Utility: Useful for making plants with altered leaf shape eg curled leaves
  misc_feature (1)..(231): Utility: Useful for making plants with enhanced abiotic stress tolerance
  misc_feature (1)..(231): Utility: Useful for making plants with increased biomass and foliage
  misc_feature (1)..(231): Utility: Useful for making smaller plants
MKVHQFARGFWEHEPSLTLGCKRLRPLAPKLSNTDTISPPHHPVTTFDLKSFIKPESASRKLGIGSSDDNTNKRDPSSPQGQAETHIPGGTRWNPTQEQIGILEMLYRGGMRTPNAQQIEQITAQLSKYGKIEGKNVFYWFQNHKARERQKQKRNNLGLAHSPRTTLTTSPPFSCCVITTMDTTKRGEVVEREEEDSPLKKCRSWAFEYLEDQREEEHRTLELFPLHPEGR

SEQ ID NO: 5613 - protein, 235 aa, Triticum aestivum
  misc_feature (1)..(235): useful for making plants with modified plant phenotypes as described in USSN 12/139,269
  misc_feature (1)..(235): Ceres CLONE ID no. 1018883
  misc_feature (1)..(235): Utility: Useful for delaying flowering time
  misc_feature (1)..(235): Utility: Useful for making ornamental plants with modified leaves
  misc_feature (1)..(235): Utility: Useful for making plants that grow better in shade
  misc_feature (1)..(235): Utility: Useful for making plants with altered leaf shape eg curled leaves
  misc_feature (1)..(235): Utility: Useful for making plants with enhanced abiotic stress tolerance
  misc_feature (1)..(235): Utility: Useful for making plants with increased biomass and foliage
  misc_feature (1)..(235): Utility: Useful for making smaller plants
MRVHHLHAPSYLEKAASASPSPATAPSTSPPSALFPFGAFQCLRPLAPKISLPDQPKKLVAPPDVLGRVRNATKLLSCTVRNHTVQVPVGGTTRWNPSAEQIKVLEALYRGGMRTPNSAQIERITEELGRHGRIEGKNVFYWFQNHKARERQKQKRAALLTLSTLDSSSLPATATKDGAGDKKEDCDEATNSCKRRCMKWSAGHGDAAAEVAAPDGCTDNVTLELFPLRPQGKAA

SEQ ID NO: 5614 - DNA, 950 bp, Arabidopsis thaliana
  misc_feature (1)..(950): useful for making plants with modified plant phenotypes as described in USSN 12/139,269
  misc_feature (1)..(950): Ceres CLONE ID no. 19188
  misc_feature (1)..(950): Also known as  Ceres CDNA ID no. 23366917
acctaaaaccacaagcaaattgaacccttctcccttttttcatctacaaaccatcttttcttctcaagtctctgccatggcgactctcaaagcttcctttttgatcaaaaccctcgacaatgacgtcaccggagattttctctccgatctggaacgtcgtgggtcaggtgctgttcatgttatcatgggtcctatgttttctgggaaatcgacctctctccttcgccgaatcaagtcagagatcagcgacggaagaagtgttgcgatgctgaaatcgagtaaggatacgagatacgcaaaagattcggtggtgacacatgatggaattggattcccttgctgggctcttccagatctcatgtcatttcctgagaaattcggactagatgcttataacaagcttgatgtgattggtattgatgaggctcagttctttggagatctttatgagttttgctgcaaagtcgctgatgatgatggtaaaattgtgatcgttgctggcctagatggtgactatttaaggaggagttttggggctgtacttgacattataccaatagctgattctgtgactaagctaactgcaaggtgtgaggtctgtggacataaagctttcttcactttaagaaagaattgtgacaccagaactgagcttattggtggagctgatgtctatatgcctgtttgtcgcaagcattacatcactaatcatattgttattaaagcctctaagaaagtcttggaagattctgacaaggctagagctgaatcctgtgttgctgctacaatctaactataaatgatatggaacaagcaacatatgttatggtgaagttttctttcttttttggttgtttggtttctttactggtctggtttatccttaatgttgtctttgaaatacacttgtgatgttcattgtatataaatataagtttgatgctttctct

SEQ ID NO: 5615 - protein, 238 aa, Arabidopsis thaliana
  misc_feature (1)..(238): useful for making plants with modified plant phenotypes as described in USSN 12/139,269
  misc_feature (31)..(208): Pfam Name: TK; Pfam Description: Thymidine kinase
  misc_feature (1)..(238): Utility: Useful for delaying flowering time
  misc_feature (1)..(238): Utility: Useful for increasing chlorophyll and photosynthetic capacity
  misc_feature (1)..(238): Utility: Useful for making larger plants
  misc_feature (1)..(238): Utility: Useful for making smaller plants
MATLKASFLIKTLDNDVTGDFLSDLERRGSGAVHVIMGPMFSGKSTSLLRRIKSEISDGRSVAMLKSSKDTRYAKDSVVTHDGIGFPCWALPDLMSFPEKFGLDAYNKLDVIGIDEAQFFGDLYEFCCKVADDDGKIVIVAGLDGDYLRRSFGAVLDIIPIADSVTKLTARCEVCGHKAFFTLRKNCDTRTELIGGADVYMPVCRKHYITNHIVIKASKKVLEDSDKARAESCVAATI

SEQ ID NO: 5616 - protein, 234 aa, Brassica napus
  misc_feature (1)..(234): useful for making plants with modified plant phenotypes as described in USSN 12/139,269
  misc_feature (1)..(234): Ceres CLONE ID no. 953088
  misc_feature (1)..(234): Utility: Useful for delaying flowering time
  misc_feature (1)..(234): Utility: Useful for increasing chlorophyll and photosynthetic capacity
  misc_feature (1)..(234): Utility: Useful for making larger plants
  misc_feature (1)..(234): Utility: Useful for making smaller plants
MATPKASVLLSDISKDEGHLGSGAIHVITGPMFSGKSTSLLRRIKTEISVGRSVAMVKSSKDTRYAKDSVVTHDGIGFPCWALPDLMSFPERFGQDAYDKLDVIGIDEAQFFGDLYEFCCKVADVDGKTVVVAGLDGDYLRRRFGAILDIIPIADSVTKLTARCEVCGQKGFFTLRKTCDTRTELIGGADVYMPVCRKHYVNNQIVINASKKVLDSDKERAESCVDTVATMVQV

SEQ ID NO: 5617 - protein, 216 aa, Triticum aestivum
  misc_feature (1)..(216): useful for making plants with modified plant phenotypes as described in USSN 12/139,269
  misc_feature (1)..(216): Ceres CLONE ID no. 901252
  misc_feature (1)..(216): Utility: Useful for delaying flowering time
  misc_feature (1)..(216): Utility: Useful for increasing chlorophyll and photosynthetic capacity
  misc_feature (1)..(216): Utility: Useful for making larger plants
  misc_feature (1)..(216): Utility: Useful for making smaller plants
MASSSSLSLDTAKDLSNSSGEVHVIVGPMFAGKTTALLCRIESELNAAKNVVLLKSSKDTRYAIDSVVTHDGIKFPCRALPDLLSFREKHGDDAYQKLDVIGIDEAQFFEDLYEFCCKAADEDGKTVIVAGLDGDYLRRSFGSVLHIIPLADSVTKLTARCELCGKRAFFTLRKTEQRETELIGGADLYMPVCRLHYLNSQVAERSVLESQNFKTD

SEQ ID NO: 5618 - protein, 194 aa, Glycine max
  misc_feature (1)..(194): useful for making plants with modified plant phenotypes as described in USSN 12/139,269
  misc_feature (1)..(194): Ceres CLONE ID no. 524628
  misc_feature (1)..(194): Utility: Useful for delaying flowering time
  misc_feature (1)..(194): Utility: Useful for increasing chlorophyll and photosynthetic capacity
  misc_feature (1)..(194): Utility: Useful for making larger plants
  misc_feature (1)..(194): Utility: Useful for making smaller plants
MFAGKTTSLLRRIQSETTNGRNVAIIKSSKDTRYGLDSIVTHDGAELPCWALANLSSFKQKFGIDAYEKLDVIGIDEAQFFDDLYEFCLQAADHDGKTVIVAGLDGNYLRRSFGSVLDIIPLADSVTKLTARCEICGKRACFTLRKTQDKQIELIGGVDVYMPVCRQHYVSGQVAMEATRHVLESHKVECASHT

SEQ ID NO: 5619 - protein, 234 aa, Glycine max
  misc_feature (1)..(234): useful for making plants with modified plant phenotypes as described in USSN 12/139,269
  misc_feature (1)..(234): Public GI no. 33325041
  misc_feature (1)..(234): Utility: Useful for delaying flowering time
  misc_feature (1)..(234): Utility: Useful for increasing chlorophyll and photosynthetic capacity
  misc_feature (1)..(234): Utility: Useful for making larger plants
  misc_feature (1)..(234): Utility: Useful for making smaller plants
MAFSSSARNPVDLRNGSKNSFCPVGEIHVIVGPMFAGKTTALLRRVNLESNDGRNVVLIKSSKDARYAVDAVVTHDGTRFPCWSLPDLSSFKQRFGKDAYEKVDVIGIDEAQFFGDLYEFCCNAADFDGKIIVVAGLDGDYLRKSFGSVLDIIPLADTVTKLTARCELCNRRAFFTFRKTNETETELIGGADIYMPVCRQHYVNGQSVNESAKMVLESHKVSNELILESPLVDP

SEQ ID NO: 5620 - protein, 270 aa, Glycine max
  misc_feature (1)..(270): useful for making plants with modified plant phenotypes as described in USSN 12/139,269
  misc_feature (1)..(270): Public GI no. 27476082
  misc_feature (1)..(270): Utility: Useful for delaying flowering time
  misc_feature (1)..(270): Utility: Useful for increasing chlorophyll and photosynthetic capacity
  misc_feature (1)..(270): Utility: Useful for making larger plants
  misc_feature (1)..(270): Utility: Useful for making smaller plants
MRSLLAASTFLRSGASPLLRPLSRPLPSRLNLSRFGPVRPVSAAAAAADKSRGGGGSAMEAQPSYPGEIHVIVGPMFAGKTTALLRRVQVEAGTGRNVALIKSDKDNRYGLDSVVTHDGTKMPCWALPELSSFQDKLGTEAYDKVDVIGIDEAQFFDDLHDFCCKAADRDGKIVVVAGLDGDYKRNKFGSVLDIIPLADSVTKLTARCELCGRRAFFTLRKTRETKTELIGGADVYMPVCRQHYLDGQIVIEATRIVLDLEKSKVIHAFK

SEQ ID NO: 5621 - protein, 212 aa, Glycine max
  misc_feature (1)..(212): useful for making plants with modified plant phenotypes as described in USSN 12/139,269
  misc_feature (1)..(212): Public GI no. 3411152
  misc_feature (1)..(212): Utility: Useful for delaying flowering time
  misc_feature (1)..(212): Utility: Useful for increasing chlorophyll and photosynthetic capacity
  misc_feature (1)..(212): Utility: Useful for making larger plants
  misc_feature (1)..(212): Utility: Useful for making smaller plants
MEAQPSYPGEIHVIVGPMFAGKTTALLRRVQVEAGTGRNVALIKSDKDNRYGLDSVVTHDGTKMPCWALPELSSFQDKLGTEAYDKVDVIGIDEAQFFDDLHDFCCKAADRDGKIVVVAGLDGDYKRNKFGSVLDIIPLADSVTKLTARCELCGRRAFFTLRKTRETKTELIGGADVYMPVCRQHYLDGQIVIEATRIVLDLEKSKVIHAFK

SEQ ID NO: 5622 - protein, 281 aa, Zea mays
  misc_feature (1)..(281): useful for making plants with modified plant phenotypes as described in USSN 12/139,269
  misc_feature (1)..(281): Ceres CLONE ID no. 284998
  misc_feature (1)..(281): Utility: Useful for delaying flowering time
  misc_feature (1)..(281): Utility: Useful for increasing chlorophyll and photosynthetic capacity
  misc_feature (1)..(281): Utility: Useful for making larger plants
  misc_feature (1)..(281): Utility: Useful for making smaller plants
MRSMFATRSLLAAAAAASAPTVLRASAFASRSLLLYLPFRRGRAARNMLGAARSISSAAPARVGGGAAMEVRAAQSGEIHVIVGPMFAGKTTALLRRVQAEAGNGRSVALIKSDKDNRYGLDSVVTHDGTKMACWALSELSSFHDKLGIDAYNKVDVIGIDEAQFFDDLYDFCCKAADRDGKIVVVAGLDGDYKRRKFGSILDIVPLADSVTKLTARCELCGRRAFFTLRKTQETKTELIGGADVYMPVCRQHYMDGQIVIEATRIVLDLDRSTVTAKALK

SEQ ID NO: 5623 - protein, 234 aa, Zea mays
  misc_feature (1)..(234): useful for making plants with modified plant phenotypes as described in USSN 12/139,269
  misc_feature (1)..(234): Ceres CLONE ID no. 226318
  misc_feature (1)..(234): Utility: Useful for delaying flowering time
  misc_feature (1)..(234): Utility: Useful for increasing chlorophyll and photosynthetic capacity
  misc_feature (1)..(234): Utility: Useful for making larger plants
  misc_feature (1)..(234): Utility: Useful for making smaller plants
MLGAARSISSAAPSRVGGRAAMEVRAAQSGEIHVIVGPMFAGKTTALLRRVQAEAGNGRSVALIKSDKDNRYGLDSVVTHDGTKMACWALSELSSFHDKLGIEAYNKVDVIGIDEAQFFDDLYDFCCKAADRDGKIVVVAGLDGDYKRRKFGSILDIVPLADSVTKLTARCELCGRRAFFTLRKTQETKTELIGGADVYMPVCRQHYMDGQIVIEATRIVLDLDRSTVTAKALK

SEQ ID NO: 5624 - DNA, 487 bp, Arabidopsis thaliana
  misc_feature (1)..(487): useful for making plants with modified plant phenotypes as described in USSN 12/139,269
  misc_feature (1)..(487): Ceres CLONE ID no. 20257
  misc_feature (1)..(487): Also known as  Ceres CDNA ID no. 23356894
aaaatctcaggtagtaaattgtcaaagctgaggagaaagaaagctttttcggtctgaaattgaagtgcgaatcggggaatctagggtttcgagagagagataatgggtggaggaggacatggcggaggtataacttacaagggagtcactgttcacactcccaagacttggcacaccgtcaccggaaaaggcttgtgcgccgttatgtggttctggattctgtacagggcaaagcaagatggtcctgtagttatgggatggaggcacccttgggatggtcatggtgatcacggtcacggagatcatcactaggtctcactgaacctttgaagatcatgagaaaaaaggatcgtctcttgtttttttcttaattttcagcttcatatgtcgaaataaagagaactgtgaagaagacgtgaattgtttttgtacacaactttgtaagacttgctgcttctgttttaagttactacttgtgtgttgcact

SEQ ID NO: 5625 - protein, 69 aa, Arabidopsis thaliana
  misc_feature (1)..(69): useful for making plants with modified plant phenotypes as described in USSN 12/139,269
  misc_feature (1)..(69): Utility: Useful for delaying flowering time
MGGGGHGGGITYKGVTVHTPKTWHTVTGKGLCAVMWFWILYRAKQDGPVVMGWRHPWDGHGDHGHGDHH

SEQ ID NO: 5626 - protein, 67 aa, Brassica napus
  misc_feature (1)..(67): useful for making plants with modified plant phenotypes as described in USSN 12/139,269
  misc_feature (1)..(67): Ceres CLONE ID no. 1038259
  misc_feature (1)..(67): Utility: Useful for delaying flowering time
MGGGGGITYKGVTVHTPKTWHTVAGKGLCGVMWFWILYRAKQDGPVVMGWRHPWDGHGDHGHGGDHH

SEQ ID NO: 5627 - protein, 58 aa, Brassica napus
  misc_feature (1)..(58): useful for making plants with modified plant phenotypes as described in USSN 12/139,269
  misc_feature (1)..(58): Ceres CLONE ID no. 957946
  misc_feature (1)..(58): Utility: Useful for delaying flowering time
MTYKGVSVQTPKTWHTVAGKGLCGVMWFWILYRAKQDGPVVMGWRHPWDGHGDHGDHH

SEQ ID NO: 5628 - protein, 67 aa, Glycine max
  misc_feature (1)..(67): useful for making plants with modified plant phenotypes as described in USSN 12/139,269
  misc_feature (1)..(67): Ceres CLONE ID no. 855445
  misc_feature (1)..(67): Utility: Useful for delaying flowering time
MGGGQGHGTTYKGVTIHQPKRWHTITGKGLCAVMWFWVFYRAKQDGPVVLGWRHPWEGHHDDHGKGH

SEQ ID NO: 5629 - protein, 65 aa, Zea mays
  misc_feature (1)..(65): useful for making plants with modified plant phenotypes as described in USSN 12/139,269
  misc_feature (1)..(65): Ceres CLONE ID no. 1447025
  misc_feature (1)..(65): Utility: Useful for delaying flowering time
MGGGGAHGGTTYKGYTIPHNKRWHTIAGKGLCATMWFWIFYRAKQDGAVLLGMRHPWDGHDDHAH

SEQ ID NO: 5630 - protein, 80 aa, Zea mays
  misc_feature (1)..(80): useful for making plants with modified plant phenotypes as described in USSN 12/139,269
  misc_feature (1)..(80): Ceres CLONE ID no. 291379
  misc_feature (1)..(80): Utility: Useful for delaying flowering time
MGGGGAHGGTTYKGYTIPHNKRWHTVAGKGLCAVMWFWVFYRAKQDGATLLGLRHPWDGHDDHSHGHGHGHEASSSSSSH

SEQ ID NO: 5631 - protein, 80 aa, Zea mays; identical to SEQ ID NO: 5630
  misc_feature (1)..(80): useful for making plants with modified plant phenotypes as described in USSN 12/139,269
  misc_feature (1)..(80): Ceres CLONE ID no. 327661
  misc_feature (1)..(80): Utility: Useful for delaying flowering time

SEQ ID NO: 5632 - protein, 83 aa, Triticum aestivum
  misc_feature (1)..(83): useful for making plants with modified plant phenotypes as described in USSN 12/139,269
  misc_feature (1)..(83): Ceres CLONE ID no. 1047513
  misc_feature (1)..(83): Utility: Useful for delaying flowering time
  misc_feature (40)..(40): Xaa is any aa, unknown or other
MGGGGAHGGTTYKGYTIPHNKRWHTIAGKGLCATMWFWIXYRAKQDGAVLLGMRHPWDGHDDHAHGHGHAHEHEASSSSSPSH

SEQ ID NO: 5633 - protein, 80 aa, Triticum aestivum
  misc_feature (1)..(80): useful for making plants with modified plant phenotypes as described in USSN 12/139,269
  misc_feature (1)..(80): Ceres CLONE ID no. 639625
  misc_feature (1)..(80): Utility: Useful for delaying flowering time
MGGGGGTTYKGYTIPHNKRWHTIAGKGLCATMWFWIFYRAKQDGAVLLGMRHPWDGHDDHAHGHGHAHEQEASSSSSPSH

SEQ ID NO: 5634 - protein, 75 aa, Triticum aestivum
  misc_feature (1)..(75): useful for making plants with modified plant phenotypes as described in USSN 12/139,269
  misc_feature (1)..(75): Ceres CLONE ID no. 1317381
  misc_feature (1)..(75): Utility: Useful for delaying flowering time
  misc_feature (12)..(12): Xaa is any aa, unknown or other
  misc_feature (39)..(39): Xaa is any aa, unknown or other
  misc_feature (45)..(45): Xaa is any aa, unknown or other
  misc_feature (47)..(47): Xaa is any aa, unknown or other
  misc_feature (67)..(67): Xaa is any aa, unknown or other
  misc_feature (68)..(68): Xaa is any aa, unknown or other
MGGGGGAHGGTXYKGYTIPHNKRWHTIAGKGLCATMWFXIFYRAXQXGAVLLGMRHPWDGHDDHAHXXFWTCTRA

SEQ ID NO: 5635 - DNA, 862 bp, Arabidopsis thaliana
  misc_feature (1)..(862): useful for making plants with modified plant phenotypes as described in USSN 12/139,269
  misc_feature (1)..(862): Ceres CLONE ID no. 21068
  misc_feature (1)..(862): Also known as  Ceres CDNA ID no. 23367701
aaaccgaaaacagagtagtcaagaaacagagtattttttctacatggatccacttttaattcagtccccattctccggcttctcaccggaatattctatcggatcttctccagaatctttctcatcctcttcttctaacaattactctcttcccttcaacgagaacgactcagaggaaatgtttctctacggtctaatcgagcaatccacgcaacaaacctatatcgactcggaacttcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcatacgatcaagccgctttctcgatgagagggtcctcggcgattctcaacttttcggcggagagagttcaagagtcgctttcggagattaagtgtacctacgaggatggttgttctccggttgtggcgttgaagaggaaacactcgatgagacggagaatgaccaataagaaaacgaaagatagtgactttgatcaccgctccgtgaagttagataatgtagttgtctttgaggatttgggagaacagtaccttgaggagcttttgggttcttctgaaaatagtgggacttggtgaaagattaggatttgtgttagggaccttaagtttgaagtggttgattaattttaaccctaatatgttttttgtttgcttaaatatttgattctattgagaaacatcgaaaacagtttgtatgtatttttgtgatacttgactttatcaatttcaagttagtgc

SEQ ID NO: 5636 - protein, 218 aa, Arabidopsis thaliana
  misc_feature (1)..(218): useful for making plants with modified plant phenotypes as described in USSN 12/139,269
  misc_feature (80)..(144): Pfam Name: AP2; Pfam Description: AP2 domain
  misc_feature (1)..(218): Utility: Useful for delaying flowering time
  misc_feature (1)..(218): Utility: Useful for increasing chlorophyll and photosynthetic capacity
  misc_feature (1)..(218): Utility: Useful for making ornamental plants with modified leaves
  misc_feature (1)..(218): Utility: Useful for making smaller plants
MDPLLIQSPFSGFSPEYSIGSSPESFSSSSSNNYSLPFNENDSEEMFLYGLIEQSTQQTYIDSELQDLPIKSVSSRKSEKSYRGVRRRPWGKFAAEIRDSTRNGIRVWLGTFESAEEAALAYDQAAFSMRGSSAILNFSAERVQESLSEIKCTYEDGCSPVVALKRKHSMRRRMTNKKTKDSDFDHRSVKLDNVVVFEDLGEQYLEELLGSSENSGTW

SEQ ID NO: 5637 - protein, 245 aa, Arabidopsis thaliana
  misc_feature (1)..(245): useful for making plants with modified plant phenotypes as described in USSN 12/139,269
  misc_feature (1)..(245): Public GI no. 25992126
  misc_feature (1)..(245): Utility: Useful for delaying flowering time
  misc_feature (1)..(245): Utility: Useful for increasing chlorophyll and photosynthetic capacity
  misc_feature (1)..(245): Utility: Useful for making ornamental plants with modified leaves
  misc_feature (1)..(245): Utility: Useful for making smaller plants
MDSSSSSSQFFYSMNSDLNSSDSSYEWSNFNTQSYLPFNVNDSEEMLLFGVLNAAHEETTSETVTSHRVKEEEVTSESEVIEAIPAKEKSYRGVRRRPWGKFAAEIRDSTRNGVRVWLGTFDSAEDAALAYDQAAFSMRGNSAILNFPVETVRDSLRDMKCHVDDDCSPVVALKKRHSMRKRSTNSKKVNSISKVVREVKMENVNNVVVFEDLGADYLEQLLSTSCQVIKVVVMQLISVHGKIKD

SEQ ID NO: 5638 - protein, 240 aa, Arabidopsis thaliana
  misc_feature (1)..(240): useful for making plants with modified plant phenotypes as described in USSN 12/139,269
  misc_feature (1)..(240): Public GI no. 23452024
  misc_feature (1)..(240): Utility: Useful for delaying flowering time
  misc_feature (1)..(240): Utility: Useful for increasing chlorophyll and photosynthetic capacity
  misc_feature (1)..(240): Utility: Useful for making ornamental plants with modified leaves
  misc_feature (1)..(240): Utility: Useful for making smaller plants
MDSSSSSSQFFYSMNSDLNSSDSSYEWSNFNTQSYLPFNVNDSEEMLLFGVLNAAHEETTSETVTSHRVKEEEVTSESEVIEAIPAKEKSYRGVRRRPWGKFAAEIRDSTRNGVRVWLGTFDSAEDAALAYDQAAFSMRGNSAILNFPVETVRDSLRDMKCHVDDDCSPVVALKKRHSMRKRSTNSKKVNSISKVVREVKMENVNNVVVFEDLGADYLEQLLSSSSSDQSSCDATYFSPW

SEQ ID NO: 5639 - protein, 234 aa, Arabidopsis thaliana
  misc_feature (1)..(234): useful for making plants with modified plant phenotypes as described in USSN 12/139,269
  misc_feature (1)..(234): Public GI no. 52547872
  misc_feature (1)..(234): Utility: Useful for delaying flowering time
  misc_feature (1)..(234): Utility: Useful for increasing chlorophyll and photosynthetic capacity
  misc_feature (1)..(234): Utility: Useful for making ornamental plants with modified leaves
  misc_feature (1)..(234): Utility: Useful for making smaller plants
MSSNSSPLEIDTSFSHSNFFFLQDQSPILQWDDDLFFNDPWFDDDQSPIIPCNSEKDENHQVFEESSDNTIMSKGSSHGQELEEVTSQEEKEKEEEEKHYIGVRKRPWGKYAAEIRDSTRNGIRVWLGTFDTAEEAALAYDQAALSMRGPWSLLNFPLEKVKKSLEKIEYSCKDGLSPAAVLKATHKTRRVKHKRSSRKKKNKETHNVIVFEDLGAELLEELLMTSSQHSCRRD

SEQ ID NO: 5640 - DNA, 522 bp, Arabidopsis thaliana
  misc_feature (1)..(522): useful for making plants with modified plant phenotypes as described in USSN 12/139,269
  misc_feature (1)..(522): Ceres CLONE ID no. 22461
  misc_feature (1)..(522): Also known as  Ceres CDNA ID no. 23356890
catcttcttcattatcatcatctccatctctctctctctctctctctctcattttcttgaaaaagatgagaaccttaaagactcagaccacaaggggaagaagaagagcaaatgtgtcgtcacgtacgagagttttacacacgtgctgtggaaatggtagtagcgacggagggaagacggtgatggagaagcttcttgcgttaaagagccttcttcctccaccggtgaatgtcggtggtggagagacggaggagctgtttcaagagacggcggagtatatcgtgaagcttagaacacaagtcgtggtgttgaagaaactgattgagatttacgataactcttctgatcagaagaaagatgttgttttataatgttcatttatattttctttaatttaaattatttcaggtttttctgtttttttttgttataaacttataattattatattgtgatccgtaattgttttaggttgtcgatgtctttaatgtattggttaaaaggaaaaagtattgatgattg

SEQ ID NO: 5641 - protein, 101 aa, Arabidopsis thaliana
  misc_feature (1)..(101): useful for making plants with modified plant phenotypes as described in USSN 12/139,269
  misc_feature (1)..(101): Utility: Useful for delaying flowering time
  misc_feature (1)..(101): Utility: Useful for increasing chlorophyll and photosynthetic capacity
  misc_feature (1)..(101): Utility: Useful for making ornamental plants with modified flowers
  misc_feature (1)..(101): Utility: Useful for making ornamental plants with modified leaves
  misc_feature (1)..(101): Utility: Useful for making smaller plants
MRTLKTQTTRGRRRANVSSRTRVLHTCCGNGSSDGGKTVMEKLLALKSLLPPPVNVGGGETEELFQETAEYIVKLRTQVVVLKKLIEIYDNSSDQKKDVVL

SEQ ID NO: 5642 - protein, 119 aa, Glycine max
  misc_feature (1)..(119): useful for making plants with modified plant phenotypes as described in USSN 12/139,269
  misc_feature (1)..(119): Ceres CLONE ID no. 601676
  misc_feature (1)..(119): Utility: Useful for delaying flowering time
  misc_feature (1)..(119): Utility: Useful for increasing chlorophyll and photosynthetic capacity
  misc_feature (1)..(119): Utility: Useful for making ornamental plants with modified flowers
  misc_feature (1)..(119): Utility: Useful for making ornamental plants with modified leaves
  misc_feature (1)..(119): Utility: Useful for making smaller plants
MTTITRHSYKLSLKRATKRITRRRRRNPHNHRKRSTSTTIDPFKPKCSNNNKVCEKLETLKNLIPGGEEAVKPDQLFKETAEYIVLLRTRVVVLQKLIEYYGNKDDTQDENEHDAVLFS

SEQ ID NO: 5643 - DNA, 736 bp, Arabidopsis thaliana
  misc_feature (1)..(736): useful for making plants with modified plant phenotypes as described in USSN 12/139,269
  misc_feature (1)..(736): Ceres CLONE ID no. 23118
  misc_feature (1)..(736): Also known as  Ceres CDNA ID no. 23375835
aattaagatctctctttactgttttcccacttttcctttgagaaaactcaaaacaaagtaaacaaacaaaccagaaaaaggaatggcactgagaatgtgggcttcctctagcaaatgctctcaagctctcttcttctgcctccaaatctcatctcttgccagctttctccatctccagatgcttctcctcagtgttggaaggacttaagtatgcaaattcacatgagtgggtgaaacatgaaggctcagttgctacaattggtatcactgaccatgcgcaggaccatttaggagaagttgtgtttgtggagctgcctgaagcaaacagttcagtgagcaaagaaaaaagctttggagctgttgagagtgttaaggccacaagtgagattctatctccaatctctggtgaagtcattgaggttaacacaaagctcaccgagtcacctggtttgatcaactcaagcccttatgaagatggttggatgataaaggtgaaaccgagcagccccgcggagttggaagctctgatgggtccaaaggaatacaccaagttctgcgaagaagaagacgctgctcactagggtttcttcgccttttatctttcccaaatgttcgaaaaacagagcaaaacaagagaatccatgctttagtttcaatctttcatttctcaatgtttcttaccactctcaacttgtatcagtgtgatactaatttgattaaaagatcatccaatgag

SEQ ID NO: 5644 - protein, 41 aa, Arabidopsis thaliana
  misc_feature (1)..(41): useful for making plants with modified plant phenotypes as described in USSN 12/139,269
  misc_feature (1)..(41): Utility: Useful for delaying flowering time
  misc_feature (1)..(41): Utility: Useful for increasing chlorophyll and photosynthetic capacity
  misc_feature (1)..(41): Utility: Useful for making ornamental plants with modified flowers
  misc_feature (1)..(41): Utility: Useful for making plants sterile and for genetic confinement
  misc_feature (1)..(41): Utility: Useful for making plants with increased biomass and foliage
  misc_feature (1)..(41): Utility: Useful for making smaller plants
  misc_feature (1)..(41): Utility: Useful for making stronger plants
MALRMWASSSKCSQALFFCLQISSLASFLHLQMLLLSVGRT

SEQ ID NO: 5645 - DNA, 611 bp, Arabidopsis thaliana
  misc_feature (1)..(611): useful for making plants with modified plant phenotypes as described in USSN 12/139,269
  misc_feature (1)..(611): Ceres CLONE ID no. 23203
  misc_feature (1)..(611): Also known as  Ceres CDNA ID no. 23373175
aatcaaaacacgtctcacttatctctcttcttcatttcttctctcttcaagctccaagatgtgtttaagttcttcagaaacattttcagacacacccacgagattagttttatacctcaaaacacaaagtcacgttcgtatccctcgtctctccaggaggagacggatgtggcgggaagagaaaaagatggagatgattaatctaaagctttacgtggagaatcaaaacatcataagagagaacgagaaacttaagaagaaagctcttcttcttcaccaagaaaacaaaactctcttctctctgcttcagaccaaaaaactctcctctgtccataaataaaatcttaccatcatcaccaatcactaagatcatcatattcttctttctttactgaaataataataagatctcaaggctccaagaaaaaaaaaacagaaaaatttgggttttacaagcaagggtttagttattattagtgggtatacatctaatttttatcttctttttagtgtgtcatctctttgtaatctttgtatctgagttcttttgttaaataatggtgtaatctactttcttattcaaagttttggatattaatctttttaatccc

SEQ ID NO: 5646 - protein, 109 aa, Arabidopsis thaliana
  misc_feature (1)..(109): useful for making plants with modified plant phenotypes as described in USSN 12/139,269
  misc_feature (1)..(109): Utility: Useful for delaying flowering time
  misc_feature (1)..(109): Utility: Useful for making ornamental plants with modified leaves
  misc_feature (1)..(109): Utility: Useful for making plants that grow better in shade
  misc_feature (1)..(109): Utility: Useful for making plants with altered leaf shape eg curled leaves
  misc_feature (1)..(109): Utility: Useful for making plants with increased biomass and foliage
  misc_feature (1)..(109): Utility: Useful for making smaller plants
RLTYLSSSFLLSSSSKMCLSSSETFSDTPTRLVLYLKTQSHVRIPRLSRRRRMWREEKKMEMINLKLYVENQNIIRENEKLKKKALLLHQENKTLFSLLQTKKLSSVHK

SEQ ID NO: 5647 - protein, 91 aa, Brassica napus
  misc_feature (1)..(91): useful for making plants with modified plant phenotypes as described in USSN 12/139,269
  misc_feature (1)..(91): Ceres CLONE ID no. 961876
  misc_feature (1)..(91): Utility: Useful for delaying flowering time
  misc_feature (1)..(91): Utility: Useful for making ornamental plants with modified leaves
  misc_feature (1)..(91): Utility: Useful for making plants that grow better in shade
  misc_feature (1)..(91): Utility: Useful for making plants with altered leaf shape eg curled leaves
  misc_feature (1)..(91): Utility: Useful for making plants with increased biomass and foliage
  misc_feature (1)..(91): Utility: Useful for making smaller plants
  misc_feature (78)..(78): Xaa is any aa, unknown or other
  misc_feature (79)..(79): Xaa is any aa, unknown or other
  misc_feature (85)..(85): Xaa is any aa, unknown or other
  misc_feature (87)..(87): Xaa is any aa, unknown or other
MCLRSSESFPDTRKMTSASRHNKRKPKTQTHLRVLSLTRRRRMLRAEKEMEMRNMKLFLENQSIIRENEALKKKALFXXQENNAXFXLLHP

SEQ ID NO: 5648 - protein, 116 aa, Brassica napus
  misc_feature (1)..(116): useful for making plants with modified plant phenotypes as described in USSN 12/139,269
  misc_feature (1)..(116): Public GI no. 52076162
  misc_feature (1)..(116): Utility: Useful for delaying flowering time
  misc_feature (1)..(116): Utility: Useful for making ornamental plants with modified leaves
  misc_feature (1)..(116): Utility: Useful for making plants that grow better in shade
  misc_feature (1)..(116): Utility: Useful for making plants with altered leaf shape eg curled leaves
  misc_feature (1)..(116): Utility: Useful for making plants with increased biomass and foliage
  misc_feature (1)..(116): Utility: Useful for making smaller plants
MCSGSWNSKNKIYLSLVVFRQDNQQQQQRKQPAHAPMALRRKRLRLRRRRETMRRSDGMEMEMVNLKLYLENRCILEENERLREKASALHRENLALRADLRNTSSPATTAAAASSC

SEQ ID NO: 5649 - protein, 110 aa, Glycine max
  misc_feature (1)..(110): useful for making plants with modified plant phenotypes as described in USSN 12/139,269
  misc_feature (1)..(110): Ceres CLONE ID no. 582490
  misc_feature (1)..(110): Utility: Useful for delaying flowering time
  misc_feature (1)..(110): Utility: Useful for making ornamental plants with modified leaves
  misc_feature (1)..(110): Utility: Useful for making plants that grow better in shade
  misc_feature (1)..(110): Utility: Useful for making plants with altered leaf shape eg curled leaves
  misc_feature (1)..(110): Utility: Useful for making plants with increased biomass and foliage
  misc_feature (1)..(110): Utility: Useful for making smaller plants
MCSFSSKQTLYLALPRPWTSKRHHHSHRHLRLGMLNRRRAHLKEARQRKRIVVKSEIQMKNLKLYMENQTIIEENEKLRKQAMLLHKENQALSSQLQKKLSGQNNNTNNN

SEQ ID NO: 5650 - protein, 114 aa, Zea mays
  misc_feature (1)..(114): useful for making plants with modified plant phenotypes as described in USSN 12/139,269
  misc_feature (1)..(114): Ceres CLONE ID no. 226408
  misc_feature (1)..(114): Utility: Useful for delaying flowering time
  misc_feature (1)..(114): Utility: Useful for making ornamental plants with modified leaves
  misc_feature (1)..(114): Utility: Useful for making plants that grow better in shade
  misc_feature (1)..(114): Utility: Useful for making plants with altered leaf shape eg curled leaves
  misc_feature (1)..(114): Utility: Useful for making plants with increased biomass and foliage
  misc_feature (1)..(114): Utility: Useful for making smaller plants
MCSGSWSWSSSSSKKRPSLVVVNLKRQQLQKTPPPTPPRASVAIRRKRLRLRRLRAGAEAMEMVNLKLYLENRCIIAENERLRERASALRRENLALLQDLSKTPPVPEAGAGAA

SEQ ID NO: 5651 - protein, 114 aa, Zea mays
  misc_feature (1)..(114): useful for making plants with modified plant phenotypes as described in USSN 12/139,269
  misc_feature (1)..(114): Ceres CLONE ID no. 1424939
  misc_feature (1)..(114): Utility: Useful for delaying flowering time
  misc_feature (1)..(114): Utility: Useful for making ornamental plants with modified leaves
  misc_feature (1)..(114): Utility: Useful for making plants that grow better in shade
  misc_feature (1)..(114): Utility: Useful for making plants with altered leaf shape eg curled leaves
  misc_feature (1)..(114): Utility: Useful for making plants with increased biomass and foliage
  misc_feature (1)..(114): Utility: Useful for making smaller plants
MCSGSWSWSSSKKRPSLVVVNLKRQQLQKTPPPTPPRASVAIRRKRLRLRRLRAGAEAMEMVNLKLYLENRCIIAENERLRERASALRRENLALLQDLSKTPAVPEAGAGAGAA

SEQ ID NO: 5652 - protein, 114 aa, Zea mays; identical to SEQ ID NO: 5651
  misc_feature (1)..(114): useful for making plants with modified plant phenotypes as described in USSN 12/139,269
  misc_feature (1)..(114): Ceres CLONE ID no. 488797
  misc_feature (1)..(114): Utility: Useful for delaying flowering time
  misc_feature (1)..(114): Utility: Useful for making ornamental plants with modified leaves
  misc_feature (1)..(114): Utility: Useful for making plants that grow better in shade
  misc_feature (1)..(114): Utility: Useful for making plants with altered leaf shape eg curled leaves
  misc_feature (1)..(114): Utility: Useful for making plants with increased biomass and foliage
  misc_feature (1)..(114): Utility: Useful for making smaller plants

SEQ ID NO: 5653 - protein, 107 aa, Zea mays
  misc_feature (1)..(107): useful for making plants with modified plant phenotypes as described in USSN 12/139,269
  misc_feature (1)..(107): Ceres CLONE ID no. 372782
  misc_feature (1)..(107): Utility: Useful for delaying flowering time
  misc_feature (1)..(107): Utility: Useful for making ornamental plants with modified leaves
  misc_feature (1)..(107): Utility: Useful for making plants that grow better in shade
  misc_feature (1)..(107): Utility: Useful for making plants with altered leaf shape eg curled leaves
  misc_feature (1)..(107): Utility: Useful for making plants with increased biomass and foliage
  misc_feature (1)..(107): Utility: Useful for making smaller plants
MCSGSWSWSSSSSKKRPSLVVVNLKRQQLQKTPPPTPPRASVAIRRKRLRLRRLRAGAEAMEMVNLKLYLENRCIIAENERLRERASALRRENLALMPHCSPGIRFC

SEQ ID NO: 5654 - protein, 116 aa, Glycine max
  misc_feature (1)..(116): useful for making plants with modified plant phenotypes as described in USSN 12/139,269
  misc_feature (1)..(116): Ceres CLONE ID no. 607279
  misc_feature (1)..(116): Utility: Useful for delaying flowering time
  misc_feature (1)..(116): Utility: Useful for making ornamental plants with modified leaves
  misc_feature (1)..(116): Utility: Useful for making plants that grow better in shade
  misc_feature (1)..(116): Utility: Useful for making plants with altered leaf shape eg curled leaves
  misc_feature (1)..(116): Utility: Useful for making plants with increased biomass and foliage
  misc_feature (1)..(116): Utility: Useful for making smaller plants
MCSFSSEQSSPYDDLPLVHPPWPSKRQPQHLRFSLHKRRRAQLQEARRRKRMIILKTEIKMRNLKLYMENQSIIEENEKLRKQAVLLHKENEALLFQLQKKLSEQNNSKTNQIAVS

SEQ ID NO: 5655 - DNA, 1095 bp, Arabidopsis thaliana
  misc_feature (1)..(1095): useful for making plants with modified plant phenotypes as described in USSN 12/139,269
  misc_feature (1)..(1095): Ceres CLONE ID no. 26907
  misc_feature (1)..(1095): Also known as  Ceres CDNA ID no. 24374217
gtagatctttttctgctctttctctctctctctctctctctctctctctctctctcttgtattatttctatctcccccgccgtcgaaagagaaacgtcgatcggagaacctttgaaatgtcgactggattagatatgtctctcgacgacatgatcgccaagaaccgtaagtctcgtggtggagccggccccgctcgtggaaccggatccggatccggaccgggtccgactcgccgcaacaaccctaatcggaaatcaacccgatctgctccataccaatcagccaaggcgccggagtccacctggggtcacgacatgttctccgatagatctgaagatcaccgatcgggacgttcctccgccggaatcgaaactggaaccaagctctacatttccaatttggattacggtgtcatgaacgaagacatcaaggaactgtttgctgaagttggagaacttaaacgctacacagttcattttgatagaagtggaagatcaaagggaactgctgaagtagtgtattctcggcgtggcgatgcactcgcagctgtgaagaagtataatgatgttcagctggatggaaaacccatgaagatagagattgtgggcactaatcttcaaactgctgcagccccgtctggtagacctgcgaatggaaactccaatggtgctccatggagaggaggacaagggagaggaggtcaacgaggtggtggacgaggaggcggtggccgaggtggtggtggtcgtggtaggcgtcctggtaagggccctgcagagaagatttctgcggaagatcttgatgcggatcttgataagtaccattctggagatatggagacaaactaaggaacgtgactgatcttctcaaaccggtaggggttttaggaggaagagaatcgagaaaatgtttgccagaggctttaccacttagcgcctttttggctgtgttgttcatttgtttcattagaatgactttacagaattgagaatatgtgttatttaaagttgttgtctatcttaataccctcaagtgaaaggcagaggaaggaataccaatttcgtttacagatcatatgcaggcaaaagagttttc

SEQ ID NO: 5656 - protein, 243 aa, Arabidopsis thaliana
  misc_feature (1)..(243): useful for making plants with modified plant phenotypes as described in USSN 12/139,269
  misc_feature (90)..(160): Pfam Name: RRM_1; Pfam Description: RNA recognition motif. (a.k.a. RRM, RBD, or RNP domain)
  misc_feature (1)..(243): Utility: Useful for delaying flowering time
  misc_feature (1)..(243): Utility: Useful for making larger plants
  misc_feature (1)..(243): Utility: Useful for making ornamental plants with modified leaves
  misc_feature (1)..(243): Utility: Useful for making plants with increased biomass and foliage
  misc_feature (1)..(243): Utility: Useful for making smaller plants
  misc_feature (1)..(243): Utility: Useful for making stronger plants
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQRGGGRGGGGRGGGGRGRRPGKGPAEKISAEDLDADLDKYHSGDMETN

SEQ ID NO: 5657 - protein, 247 aa, Glycine max
  misc_feature (1)..(247): useful for making plants with modified plant phenotypes as described in USSN 12/139,269
  misc_feature (1)..(247): Ceres CLONE ID no. 564029
  misc_feature (1)..(247): Utility: Useful for delaying flowering time
  misc_feature (1)..(247): Utility: Useful for making larger plants
  misc_feature (1)..(247): Utility: Useful for making ornamental plants with modified leaves
  misc_feature (1)..(247): Utility: Useful for making plants with increased biomass and foliage
  misc_feature (1)..(247): Utility: Useful for making smaller plants
  misc_feature (1)..(247): Utility: Useful for making stronger plants
MSAAMDMSLDDIIKNNKKSGSGSSRGRIRPSGSGPSRRFPNRAANRAAPYATAKAPEATWQHDLYADQQVAAAGYPAQGGRAASIETGTKLYISNLDYGVSSDDIKELFAEVGDLKRHAVHYDRSGRSKGTAEVVFSRRADAVAAVKRYNNVQLDGKPMKIEIVGTNISTPGVAPARNGAIGNFDGVPRSGQGRGGALRRPGGRGQGVRRDRGRGRGRGGAGRGEKVSADDLDADLEKYHAEAMQLN

SEQ ID NO: 5658 - protein, 252 aa, Glycine max
  misc_feature (1)..(252): useful for making plants with modified plant phenotypes as described in USSN 12/139,269
  misc_feature (1)..(252): Public GI no. 51490665
  misc_feature (1)..(252): Utility: Useful for delaying flowering time
  misc_feature (1)..(252): Utility: Useful for making larger plants
  misc_feature (1)..(252): Utility: Useful for making ornamental plants with modified leaves
  misc_feature (1)..(252): Utility: Useful for making plants with increased biomass and foliage
  misc_feature (1)..(252): Utility: Useful for making smaller plants
  misc_feature (1)..(252): Utility: Useful for making stronger plants
MAEAALDMSLDDLIKKNKTDTGGKRRGRGRGGASGPGPARRFPNRSANRAAPYSTAKAPEAAWNHDMFAAADQAFPFGQAGGDQAASSISTGTKLYISNLDYGVSNEDIKELFSEAGDLKRYAIHYDRSGRSKGTAEVVFSRRQDALAAVKRYNNVQLDGKPMKIEIVGTNIATPAAPAFNGAFGFGDTNGGPRTDQARSGGFGRSRGGRGRGRGFRGGSRGRGRGDRGEKVSAEDLDADLMKYHTEAMQTN

SEQ ID NO: 5659 - protein, 243 aa, Glycine max
  misc_feature (1)..(243): useful for making plants with modified plant phenotypes as described in USSN 12/139,269
  misc_feature (1)..(243): Ceres CLONE ID no. 473087
  misc_feature (1)..(243): Utility: Useful for delaying flowering time
  misc_feature (1)..(243): Utility: Useful for making larger plants
  misc_feature (1)..(243): Utility: Useful for making ornamental plants with modified leaves
  misc_feature (1)..(243): Utility: Useful for making plants with increased biomass and foliage
  misc_feature (1)..(243): Utility: Useful for making smaller plants
  misc_feature (1)..(243): Utility: Useful for making stronger plants
MSAALDMTLEDIIKNNKKSSLANTRGRGRASGPGPARRLPNRAANRAAPYAAAKAPETAWKHDMYANQPVAAAYPGGRASSIETGTKLYISNLDYGVSNDDIKELFLEVGDVKRHTVHYDRSGRSKGTAEVVFSRRADAVAAVKRYNNVQLDGKPMKVEIVGTNIATHAAPPAVNGTFGNPTGVPRSGQGRSGSLGRPRGGSRGRGSIQRGRGRGRGGRDEKVSAEDLDADLEKYHAEAMQLN

SEQ ID NO: 5660 - protein, 249 aa, Glycine max
  misc_feature (1)..(249): useful for making plants with modified plant phenotypes as described in USSN 12/139,269
  misc_feature (1)..(249): Public GI no. 51490663
  misc_feature (1)..(249): Utility: Useful for delaying flowering time
  misc_feature (1)..(249): Utility: Useful for making larger plants
  misc_feature (1)..(249): Utility: Useful for making ornamental plants with modified leaves
  misc_feature (1)..(249): Utility: Useful for making plants with increased biomass and foliage
  misc_feature (1)..(249): Utility: Useful for making smaller plants
  misc_feature (1)..(249): Utility: Useful for making stronger plants
MSNLDVSLDDLIKRNKSSSSRNPRPRTSGSGSGTGSGGPSPRRRFPSRAANRSAPYSSGPVHAPDSTWDHNMFAEHAPAYPAARGAGGISGIETGIKLLISNLDYGVSNEDIKELFSEAGDIKRYSIHYDKSGRSKGTAEVIFSRRRDAEAAIKKYNNVQLDGKPMKIEFAGPNIGAPTLPPLRNRLYRNPNPAPRSQQRGGGFRRPPRGGRGSMRKEGGRGRGRVENITAEDLDADLEKYHAEAMQTN

SEQ ID NO: 5661 - protein, 277 aa, Triticum aestivum
  misc_feature (1)..(277): useful for making plants with modified plant phenotypes as described in USSN 12/139,269
  misc_feature (1)..(277): Ceres CLONE ID no. 568942
  misc_feature (1)..(277): Utility: Useful for delaying flowering time
  misc_feature (1)..(277): Utility: Useful for making larger plants
  misc_feature (1)..(277): Utility: Useful for making ornamental plants with modified leaves
  misc_feature (1)..(277): Utility: Useful for making plants with increased biomass and foliage
  misc_feature (1)..(277): Utility: Useful for making smaller plants
  misc_feature (1)..(277): Utility: Useful for making stronger plants
MADALDMSLDDLISKNKSSSQRGRGRRNPASGSGSGSASGGPAPAGRRFQARAATRAAAAPYHQFNFPPPAPAAFAYAAQQAHAHAHAQVMAMVAPPTGVETGTKLYISNLDYNVSNEDIKELFAEVGDLKRYSINYDKSGRSKGTAEVIFSRKSDALAALKRYNNVQLDGKPMKIEVIGTNIEAPPPPPAIFTLNTPTIGNFIPSYSGGRGRGGDGGRGWPRGRGGFGGRSAAGRGRGRGDVGRGRGRGGRGSQPVSANDLDADLDKYHSEAMQTS

SEQ ID NO: 5662 - protein, 292 aa, Zea mays
  misc_feature (1)..(292): useful for making plants with modified plant phenotypes as described in USSN 12/139,269
  misc_feature (1)..(292): Ceres CLONE ID no. 218083
  misc_feature (1)..(292): Utility: Useful for delaying flowering time
  misc_feature (1)..(292): Utility: Useful for making larger plants
  misc_feature (1)..(292): Utility: Useful for making ornamental plants with modified leaves
  misc_feature (1)..(292): Utility: Useful for making plants with increased biomass and foliage
  misc_feature (1)..(292): Utility: Useful for making smaller plants
  misc_feature (1)..(292): Utility: Useful for making stronger plants
KKISNSPPQRATLTRFGRFLLCLPLTLVQHPEICSARAAMAETLDMTLDDIIKNNKKSNPSSGGARRSRGGSAPGGGSGGVGPTRRSFKRAGNRQAPYQPPKAPDAAWQHDMYPAVAAGGGGGGRVSALETGTKLYISNLDFGVSNDDIKELFSELGDLKRFSIIYDRSGRSKGTAEVVFARRSDAVAAVKKYNNVQLDGKPMKIEIVGTNTPTASAALPVSNGGHARNAVRSAPRGAAPAGVPQRRPHQRGGRRSGGSGGGRRGKERSKPKSAEELDADLEKYHADAMQTN

SEQ ID NO: 5663 - protein, 292 aa, Zea mays; identical to SEQ ID NO: 5662
  misc_feature (1)..(292): useful for making plants with modified plant phenotypes as described in USSN 12/139,269
  misc_feature (1)..(292): Ceres CLONE ID no. 240010
  misc_feature (1)..(292): Utility: Useful for delaying flowering time
  misc_feature (1)..(292): Utility: Useful for making larger plants
  misc_feature (1)..(292): Utility: Useful for making ornamental plants with modified leaves
  misc_feature (1)..(292): Utility: Useful for making plants with increased biomass and foliage
  misc_feature (1)..(292): Utility: Useful for making smaller plants
  misc_feature (1)..(292): Utility: Useful for making stronger plants

SEQ ID NO: 5664 - protein, 293 aa, Zea mays
  misc_feature (1)..(293): useful for making plants with modified plant phenotypes as described in USSN 12/139,269
  misc_feature (1)..(293): Ceres CLONE ID no. 293151
  misc_feature (1)..(293): Utility: Useful for delaying flowering time
  misc_feature (1)..(293): Utility: Useful for making larger plants
  misc_feature (1)..(293): Utility: Useful for making ornamental plants with modified leaves
  misc_feature (1)..(293): Utility: Useful for making plants with increased biomass and foliage
  misc_feature (1)..(293): Utility: Useful for making smaller plants
  misc_feature (1)..(293): Utility: Useful for making stronger plants
  misc_feature (120)..(120): Xaa is any aa, unknown or other
KEISNSSPYPPRCFLLPVDLDNLPPANPSPASEIYSARTAMAETLDMTLDDIIKNNKKSNPSSRGARRSRGGSAPGGGTGGVGPTRRPFKRAGNRQAPYQPPKAPDAAWQHDMYPAVAAXGGGGGRVSALETGAKLYISNLDFGVSNEDIKELFSELGDLKRFSINYDRSGRSKGTAEVVFARRSDAVAAVKKYDNVQLDGKPMKIEIVGTNTPAAASAHPVPNGGHARNAARSAPKDAAPAGMSQHRPHQRGGRRAAGSGGGRRGKERSKPKSTEELDADLEKYHADAMQTN

SEQ ID NO: 5665 - protein, 262 aa, Zea mays
  misc_feature (1)..(262): useful for making plants with modified plant phenotypes as described in USSN 12/139,269
  misc_feature (1)..(262): Ceres CLONE ID no. 259439
  misc_feature (1)..(262): Utility: Useful for delaying flowering time
  misc_feature (1)..(262): Utility: Useful for making larger plants
  misc_feature (1)..(262): Utility: Useful for making ornamental plants with modified leaves
  misc_feature (1)..(262): Utility: Useful for making plants with increased biomass and foliage
  misc_feature (1)..(262): Utility: Useful for making smaller plants
  misc_feature (1)..(262): Utility: Useful for making stronger plants
YYMQFGKCKFQSACIFNHSKDILSSGWHPAECPFYMKTRTCQFGSACEFYHPKDRRSFKRAGNRQAPYQPPKAPDAAWQHDMYPAVAAGGGGGGRVSALETGTKLYISNLDFGVSNDDIKELFSELGDLKRFSIIYDRSGRSKGTAEVVFARRSDAVAAVKKYNNVQLDGKPMKIEIVGTNTPTASAALPVSNGGHARNAVRSAPRGAAPAGMPQRRPHQRGGRRSGGSGGGRRGKERSKPKSAEELDADLEKYHADAMQTN

SEQ ID NO: 5666 - DNA, 1124 bp, Arabidopsis thaliana
  misc_feature (1)..(1124): useful for making plants with modified plant phenotypes as described in USSN 12/139,269
  misc_feature (1)..(1124): Ceres CLONE ID no. 27460
  misc_feature (1)..(1124): Also known as  Ceres CDNA ID no. 23385757
aatttatattgttgagctgtgtgtgtggagatgatgatgatgatgatgataaacccaatagaattttaaaaggataagaatcgcaaagctcatatcacaaaactttgagatctcatttcatctttcttcgattctacctactccgattcaatcgatcttatcgagacatggatgctcgtaagagaggacgccctgaagctgctgcctctcacaactccaatggcggattcaagaggtctaagcaagagatggaatcaatttcaactggtttaggaagcaaatccaagccatgcactaaatttttcagcacttctggatgtccatttggtgacaattgccacttcttgcactatgtgcccggtgggtacaatgctgcagcgcagcatgaaaaatctccgaccaccggtttctcaagtttccagaaatatgcaaggatctggtggtcccggcggcagattctcagggagaggagatccaggatcaggccctgtttcaatctttggtgcttctacttccaagatcagtgtagatgcttctttagccggtgccatcattggaaaaggtggaatccattccaaacagatatgccgtgaaacaggagcaaaattatcgattaaagatcatgaaagagacccaaacttgaagattatcgagctggaaggaacatttgaacagatcaatgtagcgagtgggatggtgagagagcttatagggaggcttggatcagtgaagaaacctcaagggattggtggtcctgaagggaaaccacatcctgggagcaactacaaaaccaagatctgtgataggtactctaaagggaactgtacatatggagatagatgccattttgctcatggtgaatctgagctgcgcaggtcaggaatcgcttagttatgtctttagactcttgagaacagattatgcattgttagctccattatcattgtgactttttgctctctctttttgttttatcaatttgttttatgcgactccctttgaaaactttagcccattctgtattgagctctgaagattcgacgagttctgtaagttaccgatcacagttaaaagactttgatatgttaaaacccttatattacagctacatactttttttgtcc

SEQ ID NO: 5667 - protein, 240 aa, Arabidopsis thaliana
  misc_feature (1)..(240): useful for making plants with modified plant phenotypes as described in USSN 12/139,269
  misc_feature (37)..(63): Pfam Name: zf-CCCH; Pfam Description: Zinc finger C-x8-C-x5-C-x3-H type (and similar)
  misc_feature (115)..(177): Pfam Name: KH_1; Pfam Description: KH domain
  misc_feature (1)..(240): Utility: Useful for delaying flowering time
  misc_feature (1)..(240): Utility: Useful for increasing chlorophyll and photosynthetic capacity
  misc_feature (1)..(240): Utility: Useful for making ornamental plants with modified flowers
  misc_feature (1)..(240): Utility: Useful for making plants that grow better in shade
  misc_feature (1)..(240): Utility: Useful for making smaller plants
MDARKRGRPEAAASHNSNGGFKRSKQEMESISTGLGSKSKPCTKFFSTSGCPFGDNCHFLHYVPGGYNAAAQMKNLRPPVSQVSRNMQGSGGPGGRFSGRGDPGSGPVSIFGASTSKISVDASLAGAIIGKGGIHSKQICRETGAKLSIKDHERDPNLKIIELEGTFEQINVASGMVRELIGRLGSVKKPQGIGGPEGKPHPGSNYKTKICDRYSKGNCTYGDRCHFAHGESELRRSGIA

SEQ ID NO: 5668 - protein, 252 aa, Brassica napus
  misc_feature (1)..(252): useful for making plants with modified plant phenotypes as described in USSN 12/139,269
  misc_feature (1)..(252): Ceres CLONE ID no. 975540
  misc_feature (1)..(252): Utility: Useful for delaying flowering time
  misc_feature (1)..(252): Utility: Useful for increasing chlorophyll and photosynthetic capacity
  misc_feature (1)..(252): Utility: Useful for making ornamental plants with modified flowers
  misc_feature (1)..(252): Utility: Useful for making plants that grow better in shade
  misc_feature (1)..(252): Utility: Useful for making smaller plants
  misc_feature (195)..(195): Xaa is any aa, unknown or other
MDTRKRAGSFNSNGGGGGGGSKKSKQEMESYSTGLGSKSKPCTKFFSTSGCPFGDNCHFLHYVPGGYNAVAQLTNMALPMPQASRNMQGPGGGGGGRFSGRGGESGPGHVSSFGASATAKISVDASLAGAIIGKGGVSSKQICRQTGAKLSIQDHERDPNLKNIELEGTFEQINEASVMVRELIGRLNSAASRRXPGGGGGIGGGVGSEGKPHPGSNFKTKMCERFAKGNCTFGDRCHFAHGEAELRRSGIA

SEQ ID NO: 5669 - DNA, 1794 bp, Arabidopsis thaliana
  misc_feature (1)..(1794): useful for making plants with modified plant phenotypes as described in USSN 12/139,269
  misc_feature (1)..(1794): Ceres CLONE ID no. 32348
  misc_feature (1)..(1794): Also known as  Ceres CDNA ID no. 24374562
ctcagcagcttcttctgctttcaattactctcgccgacgattttctcaccggaaaaaaacaatatcattgcggatacacaaactataatggacctcctcttgctggagaagtctttaatcgccgtcttcgtggcggtgattctcgccacggtgatttcaaagctccgcggcaagaaattgaagctacctccaggtcctataccaattccgatcttcggaaactggcttcaagtcggagatgatctcaaccaccgtaatctcgtcgattacgctaagaaattcggcgatctcttcctcctccgtatgggtcagcgaaacctagtcgtcgtctcctcaccggatctaacaaaggaagtgctcctcactcaaggcgttgagtttggatccagaacgagaaacgtcgtgttcgacattttcaccgggaaaggtcaagatatggtgttcactgtttacggcgagcattggaggaagatgagaagaatcatgacggttcctttcttcaccaacaaagttgttcaacagaatcgtgaaggttgggagtttgaagcagctagtgttgttgaagatgttaagaagaatccagattctgctacgaaaggaatcgtgttgaggaaacgtttgcaattgatgatgtataacaatatgttccgtatcatgttcgatagaagatttgagagtgaggatgatcctcttttccttaggcttaaggctttgaatggtgagagaagtcgattagctcagagctttgagtataactatggagatttcattcctatccttagaccattcctcagaggctatttgaagatttgtcaagatgtgaaagatcgaagaatcgctcttttcaagaagtactttgttgatgagaggaagcaaattgcgagttctaagcctacaggtagtgaaggattgaaatgtgccattgatcacatccttgaagctgagcagaagggagaaatcaacgaggacaatgttctttacatcgtcgagaacatcaatgtcgccgcgattgagacaacattgtggtctatcgagtggggaattgcagagctagtgaaccatcctgaaatccagagtaagctaaggaacgaactcgacacagttcttggaccgggtgtgcaagtcaccgagcctgatcttcacaaacttccataccttcaagctgtggttaaggagactcttcgtctgagaatggcgattcctctcctcgtgcctcacatgaacctccatgatgcgaagctcgctggctacgatatcccagcagaaagcaaaatccttgttaatgcttggtggctagcaaacaaccccaacagctggaagaagcctgaagagtttagaccagagaggttctttgaagaagaatcgcacgtggaagctaacggtaatgacttcaggtatgtgccatttggtgttggacgtcgaagctgtcccgggattatattggcattgcctattttggggatcaccattggtaggatggtccagaacttcgagcttcttcctcctccaggacagtctaaagtggatactagtgagaaaggtggacaattcagcttgcacatccttaaccactccataatcgttatgaaaccaaggaactgttaaactttctgcacaaaaaaaaggatgaagatgactttataaatgtttgtgaaatctgttgaaatattcccttgttttgcttttgtgagatgtttttgtgtaaaatgtctttaaatggttcgttctacgattgcaataataattagtggtgctcattgttttggatggatcaatgttatacttatatcattt

SEQ ID NO: 5670 - protein, 505 aa, Arabidopsis thaliana
  misc_feature (1)..(505): useful for making plants with modified plant phenotypes as described in USSN 12/139,269
  misc_feature (34)..(499): Pfam Name: p450; Pfam Description: Cytochrome P450
  misc_feature (1)..(505): Utility: Useful for delaying flowering time
  misc_feature (1)..(505): Utility: Useful for increasing chlorophyll and photosynthetic capacity
  misc_feature (1)..(505): Utility: Useful for increasing increasing anthocyanin content
  misc_feature (1)..(505): Utility: Useful for making plants with altered leaf shape eg curled leaves
  misc_feature (1)..(505): Utility: Useful for making plants with increased biomass and foliage
  misc_feature (1)..(505): Utility: Useful for making smaller plants
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERSRLAQSFEYNYGDFIPILRPFLRGYLKICQDVKDRRIALFKKYFVDERKQIASSKPTGSEGLKCAIDHILEAEQKGEINEDNVLYIVENINVAAIETTLWSIEWGIAELVNHPEIQSKLRNELDTVLGPGVQVTEPDLHKLPYLQAVVKETLRLRMAIPLLVPHMNLHDAKLAGYDIPAESKILVNAWWLANNPNSWKKPEEFRPERFFEEESHVEANGNDFRYVPFGVGRRSCPGIILALPILGITIGRMVQNFELLPPPGQSKVDTSEKGGQFSLHILNHSIIVMKPRNC

SEQ ID NO: 5671 - protein, 505 aa, Arabidopsis thaliana
  misc_feature (1)..(505): useful for making plants with modified plant phenotypes as described in USSN 12/139,269
  misc_feature (1)..(505): Public GI no. 12276037
  misc_feature (1)..(505): Utility: Useful for delaying flowering time
  misc_feature (1)..(505): Utility: Useful for increasing chlorophyll and photosynthetic capacity
  misc_feature (1)..(505): Utility: Useful for increasing increasing anthocyanin content
  misc_feature (1)..(505): Utility: Useful for making plants with altered leaf shape eg curled leaves
  misc_feature (1)..(505): Utility: Useful for making plants with increased biomass and foliage
  misc_feature (1)..(505): Utility: Useful for making smaller plants
MDLLLLEKTLLGSFVAILVAILVSKLRGKRFKLPPGPIPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRLQLMMYNNMYRIMFDRRFESEDDPLFNKLKALNGERSRLAQSFDYNYGDFIPILRPFLRGYLKICQEVKERRLQLFKDYFVDERKKLASTKNMSNEGLKCAIDHILDAQKKGEINEDNVLYIVENINVAAIETTLWSIEWGIAELVNHPEIQKKLRHELDTLLGPGHQITEPDTYKLPYLNAVIKETLRLRMAIPLLVPHMNLHDAKLGGFDIPAESKILVNAWWLANNPAHWKNPEEFRPERFLEEEAKVEANGNDFRYLPFGVGRRSCPGIILALPILGITLGRLVQNFELLPPPGQSKIDTAEKGGQFSLHILKHSTIVAKPRSF

SEQ ID NO: 5672 - protein, 505 aa, Arabidopsis thaliana
  misc_feature (1)..(505): useful for making plants with modified plant phenotypes as described in USSN 12/139,269
  misc_feature (1)..(505): Public GI no. 586082
  misc_feature (1)..(505): Utility: Useful for delaying flowering time
  misc_feature (1)..(505): Utility: Useful for increasing chlorophyll and photosynthetic capacity
  misc_feature (1)..(505): Utility: Useful for increasing increasing anthocyanin content
  misc_feature (1)..(505): Utility: Useful for making plants with altered leaf shape eg curled leaves
  misc_feature (1)..(505): Utility: Useful for making plants with increased biomass and foliage
  misc_feature (1)..(505): Utility: Useful for making smaller plants
MDLLLLEKTLLGLFLAAVVAIVVSKLRGKRFKLPPGPLPVPIFGNWLQVGDDLNHRNLTQLAKRFGDIFLLRMGQRNLVVVSSPDLAKEVLHTQGVEFGSRTRNVVFDIFTGEGQDMVFTVYGEHWRKMRRIMTVPFFTNKVVQQYRHGWEAEAAAVVDDVRKNPDAAVSGLVIRRRLQLMMYNNMYRIMFDRRFESEEDPLFQRLKALNGERSRLAQSFEYNYGDFIPILRPFLKGYLKICKEVKETRLKLFKDYFVDERKNIGSTKSTNNEGLKCAIDHILDAEKKGEINEDNVLYIVENINVAAIETTLWSIEWGIAELVNHPEIQQKVRDEIDRVLGVGHQVTEPDIQKLPYLQAVVKETLRLRMAIPLLVPHMNLHDAKLGGYDIPAESKILVNAWWLANNPAHWKKPEEFRPERFFEEESHVEANGNDFRYLPFGVGRRSCPGIILALPILGITLGRLVQNFELLPPPGQSQIDTSEKGGQFSLHILKHSTVVAKPRSF

SEQ ID NO: 5673 - protein, 506 aa, Triticum aestivum
  misc_feature (1)..(506): useful for making plants with modified plant phenotypes as described in USSN 12/139,269
  misc_feature (1)..(506): Ceres CLONE ID no. 755965
  misc_feature (1)..(506): Utility: Useful for delaying flowering time
  misc_feature (1)..(506): Utility: Useful for increasing chlorophyll and photosynthetic capacity
  misc_feature (1)..(506): Utility: Useful for increasing increasing anthocyanin content
  misc_feature (1)..(506): Utility: Useful for making plants with altered leaf shape eg curled leaves
  misc_feature (1)..(506): Utility: Useful for making plants with increased biomass and foliage
  misc_feature (1)..(506): Utility: Useful for making smaller plants
MDFVFVEKLLAGLLAAVVGAIVVSKIRGRKLRLPPGPFPVPIFGNWLQVGDDLNHRNLAAMARKFGEVFLLRMGQRNLVVVSSPPLAREVLHTQGVEFGSRTRNVVFDIFTGEGQDMVFTVYGDHWRKMRRIMTVPFFTNKVVQQYRPGWEAEAAFVIDNVRADPRAATEGVVLRRHLQLMMYNNMYRIMFDRRFESMDDPLFLRLRALNGERSRLAQSFEYNYGDFIPILRPFLRGYLRLCKEVKETRLKLFKDYFLDERKKLVSTKAMDNNGGLKCAIDHILEAEQKGEINEDNVLYIIENINVAAIETTLWSIEWGLAELVNHPEIQQKLRDEMDAVLGAGHQITEPETHKLPYLQAVIKETLRLRMAIPLLVPHMNLHDAKLAGYNIPAESKILVNAWFLANNPEQWKRPDEFRPERFLEEEKHVEANGNDFRYLPFGVGRRSCPGIILALPILGITIGRLVQNFVLTPPPGQDKLDTTEKGGQFSLHILKHSTIVAKPRVF

SEQ ID NO: 5674 - protein, 521 aa, Zea mays
  misc_feature (1)..(521): useful for making plants with modified plant phenotypes as described in USSN 12/139,269
  misc_feature (1)..(521): Ceres CLONE ID no. 241576
  misc_feature (1)..(521): Utility: Useful for delaying flowering time
  misc_feature (1)..(521): Utility: Useful for increasing chlorophyll and photosynthetic capacity
  misc_feature (1)..(521): Utility: Useful for increasing increasing anthocyanin content
  misc_feature (1)..(521): Utility: Useful for making plants with altered leaf shape eg curled leaves
  misc_feature (1)..(521): Utility: Useful for making plants with increased biomass and foliage
  misc_feature (1)..(521): Utility: Useful for making smaller plants
RLHEQTTHPTYPGRTGRQHNMDLALLEKALLGLFAAAVVAIAVAKLSGKRYRLPPGPPGAPVVGNWLQVGDDLNHRNLMAMAKRFGDIFLLRMGVRNLVVVSTPELAKEVLHTQGVEFGSRTRNVVFDIFTGKGQDMVFTVYGDHWRKMRRIMTVPFFTNKVVAQNRAGWEEEARLVVEDVRKDPEAAAGGVVLRRRLQLMMYNDMFRIMFDRRFDSEHDPLFNKLKALNAERSRLSQSFEYNYGDFIPVLRPFLRGYLNRCHDLKTRRMKFFEDNFVQERKKVMAQTGEIRCAMDHILEAERKGEINHDNVLYIVENINVAAIETTLWSIEWGIAELVNHPAIQHKLREELASVLGAGVPVTEPDLERLPYLQAIVKETLRLRMAIPLLVPHMNLNDGKLAGYDIPAESKILVNAWFLANDPKRWVRPDEFRPERFLEEEKSVEAHGNDFRFVPFGVGRRSCPGIILALPIIGITLGRLVQNFQLLPPPGLDKIDTTEKPGQFSNQIAKHATIVCKPLEA

SEQ ID NO: 5675 - protein, 505 aa, Zea mays
  misc_feature (1)..(505): useful for making plants with modified plant phenotypes as described in USSN 12/139,269
  misc_feature (1)..(505): Public GI no. 44889626
  misc_feature (1)..(505): Utility: Useful for delaying flowering time
  misc_feature (1)..(505): Utility: Useful for increasing chlorophyll and photosynthetic capacity
  misc_feature (1)..(505): Utility: Useful for increasing increasing anthocyanin content
  misc_feature (1)..(505): Utility: Useful for making plants with altered leaf shape eg curled leaves
  misc_feature (1)..(505): Utility: Useful for making plants with increased biomass and foliage
  misc_feature (1)..(505): Utility: Useful for making smaller plants
MELLLLEKTLISLFFAITLAIVISKLRGKKFKLPPGPLPVPIFGNWLQVGDDLNHRNLANFAKKFGDVFLLRMGQRNLVVVSSPDLARDVLHTQGVEFGSRTRNVVFDIFTGKGQDMVFTVYGEHWRKMRRIMTVPFFTNKVVNQYRYGWEDEAGRVVEDVKKDAKAATEGIVLRKRLQLMMYNNMYRIMFDRRFESENDPLFLKLKALNGERSRLAQSFEYNYGDFIPILRPFLRGYLKICKEVKERRIQLFKDYFLEERKKLSSTKPTDNAGLKCAIDHILDAEKKGEINEDNVLYIVENINVAAIETTLWSIEWGIAELVNHPKIQRKLQHELDTVLGPGTQITEPDTHRLPYLQAVIKETLRLRMAIPLLVPHMNLHDAKLGGYDIPAESKILVNAWWLANNPAHWKDPEEFRPERFLEEEAKVEANGNDFRYIPFGVGRRSCPGIILALPILGITIGRLVQNFDLMPPPGMDKIDTTEKGGQFSLHILNHSTIVAKPRVF

SEQ ID NO: 5676 - protein, 505 aa, Zea mays
  misc_feature (1)..(505): useful for making plants with modified plant phenotypes as described in USSN 12/139,269
  misc_feature (1)..(505): Public GI no. 9965897
  misc_feature (1)..(505): Utility: Useful for delaying flowering time
  misc_feature (1)..(505): Utility: Useful for increasing chlorophyll and photosynthetic capacity
  misc_feature (1)..(505): Utility: Useful for increasing increasing anthocyanin content
  misc_feature (1)..(505): Utility: Useful for making plants with altered leaf shape eg curled leaves
  misc_feature (1)..(505): Utility: Useful for making plants with increased biomass and foliage
  misc_feature (1)..(505): Utility: Useful for making smaller plants
MDLLFLEKALLGLFVAVVLAITISKLRGKRFKLPPGPLPVPVFGNWLQVGDDLNHRNLTDLAKKFGDIFLLRMGQRNLVVVSSPELAKEVLHTQGVEFGSRTRNVVFDIFTGKGQDMVFTVYGEHWRKMRRIMTVPFFTNKVVQQYRFGWEDEAARVVEDVRKNPEAATNGIVLRRRLQLMMYNNMYRIMFDTRFESEDDPLFVRLKALNGERSRLAQSFEYNYGDFIPILRPFLRGYLKICKEVKDRRLQLFKDHFVEERKKLGSTKSMNNDGLKCAIDHILDAQQKGEINEDNVLYIVENINVAAIETTLWSIEWGIAELVNHPEIQKKLRHELDTVLGPGNQITEPDTHKLPYLQAVIKETLRLRMAIPLLVPHMNLHDAKLGGYDIPAESKILVNAWWLANNPANWKNPEEFRPERFFEEEAKVEANGNDFRYLPFGVGRRSCPGIILALPILGITLGRLVQNFELLPPPGQSQIDTTEKGGQFSLHILKHSTIVAKPRQF

SEQ ID NO: 5677 - protein, 505 aa, Zea mays
  misc_feature (1)..(505): useful for making plants with modified plant phenotypes as described in USSN 12/139,269
  misc_feature (1)..(505): Public GI no. 9965899
  misc_feature (1)..(505): Utility: Useful for delaying flowering time
  misc_feature (1)..(505): Utility: Useful for increasing chlorophyll and photosynthetic capacity
  misc_feature (1)..(505): Utility: Useful for increasing increasing anthocyanin content
  misc_feature (1)..(505): Utility: Useful for making plants with altered leaf shape eg curled leaves
  misc_feature (1)..(505): Utility: Useful for making plants with increased biomass and foliage
  misc_feature (1)..(505): Utility: Useful for making smaller plants
MDLLFLEKVLISLFFTIIFAILVSKLRGKRFKLPPGPLPIPVFGNWLQVGDDLNHRNLTDLAKKFGDIFLLRMGQRNLVVISSPELAKEVLHTQGVEFGSRTRNVVFDIFTGKGQDMVFTVYGEHWRKMRRIMTVPFFTNKVVQQYRHGWEDEAASVVEDVKKNPEAATNGIVLRRKLQLMMYNNMYRIMFDRRFESEDDPLFVKLKALNGERSRLAQSFEYNYGDFIPILRPFLRGYLKLCKEVKEIRLQLFRDQFLEERKKLATTKRIDNNALKCAIDHILDAQRKGEINEDNVLYIVENINVAAIETTLWSIEWGIAELVNHPEIQQKLRNEIDTVLGPGVQVTEPDTHKLPYLQAVIKETLRLRMAIPLLVPHMNLHDAKLGGYDIPAESKILVNAWWLANNPAHWKNPEEFRPERFFEEESKVEANGNDFRYLPFGVGRRSCPGIILALPILGITLGRLVQNFELLPPKGQSKLDTSEKGGQFSLHILKHSTIVAKPRVF

SEQ ID NO: 5678 - protein, 505 aa, Zea mays
  misc_feature (1)..(505): useful for making plants with modified plant phenotypes as described in USSN 12/139,269
  misc_feature (1)..(505): Public GI no. 3915112
  misc_feature (1)..(505): Utility: Useful for delaying flowering time
  misc_feature (1)..(505): Utility: Useful for increasing chlorophyll and photosynthetic capacity
  misc_feature (1)..(505): Utility: Useful for increasing increasing anthocyanin content
  misc_feature (1)..(505): Utility: Useful for making plants with altered leaf shape eg curled leaves
  misc_feature (1)..(505): Utility: Useful for making plants with increased biomass and foliage
  misc_feature (1)..(505): Utility: Useful for making smaller plants
MDLLLVEKTLLALFAAIIASIFISKLRGKRFKLPPGPVPVPIFGNWLQVGDDLNHRNLTDLAKKFGEIFLLRMGQRNLVVVSSPNLAKEVLHTQGVEFGSRTRNVVFDIFTGKGQDMVFTVYGEHWRKMRRIMTVPFFTNKVVQQYRTGWEAEAAAVVDDVKKNPKAATEGVVIRKRLQLMMYNNMFRIMFDRRFESEDDPLFVKLKMLNGERSRLAQSFEYNYGDFIPILRPFLKGYLKLCKEVKEKRFQLFKDYFVDERKKLGSTKSMDNNQLKCAIDHILDAKDKGEINEDNVLYIVENINVAAIETTLWSIEWAIAELVNHPEIQAKLRHELVSQLGPGVQVTEPDLHKLPYLQAVIKETLRLRMAIPLLVPHMNLHDAKLGGYDIPAESKILVNAWWLANNPDQWKKPEEFRPERFLEEESKVEANGNDFRYLPFGVGRRSCPGIILALPILGITIGRLVQNFELLPPPGQDKVDTTEKGGQFSLHILKHSTIVAKPRVL

SEQ ID NO: 5679 - protein, 506 aa, Zea mays
  misc_feature (1)..(506): useful for making plants with modified plant phenotypes as described in USSN 12/139,269
  misc_feature (1)..(506): Public GI no. 24571503
  misc_feature (1)..(506): Utility: Useful for delaying flowering time
  misc_feature (1)..(506): Utility: Useful for increasing chlorophyll and photosynthetic capacity
  misc_feature (1)..(506): Utility: Useful for increasing increasing anthocyanin content
  misc_feature (1)..(506): Utility: Useful for making plants with altered leaf shape eg curled leaves
  misc_feature (1)..(506): Utility: Useful for making plants with increased biomass and foliage
  misc_feature (1)..(506): Utility: Useful for making smaller plants
MDLLLLEKALLGLFAAAVVAIAVSKLRGKRFKLPPGPFGFPVFGNWLQVGDDLNQRKLANLSKKFGDVYLLRMGQRNLVVVSSPEMAKEVLHTQGVEFGSRTRNVVFDIFTGKGQDMVFTVYSEHWRKMRRIMTVPFFTNKVVQQQRFNWEDEAARVVEDVKKDPQAATTGIVLRRRLQLLMYNNMYRIMFDRRFESVDDPLFNKLKALNGERSRLAQSFEYNYGDFIPILRPFLRGYLKLVKEVKERRLKLFKDYFVEERKKLTSTKSMTEENFKCAIDHVLDAQQKGEINEDNVLYIVENINVAAIETTLWSIEWGIAELVNHPDIQKKLRAEIDRVLGPDHQITEPDTHKLPYLQAVIKETLRLRMAIPLLVPHMNLNDAKLAGYDIPAESKILVNAWWLANNPAHWKDPQVFRPERFLEEESGVEANGNDFRYIPFGVGRRSCPGIILALPILGITIGRMVQNFELLPPPGQSKIDTSEKGGQFSLFILNHSTIVLKPRSSV

SEQ ID NO: 5680 - DNA, 756 bp, Arabidopsis thaliana
  misc_feature (1)..(756): useful for making plants with modified plant phenotypes as described in USSN 12/139,269
  misc_feature (1)..(756): Ceres CLONE ID no. 32548
  misc_feature (1)..(756): Also known as  Ceres CDNA ID no. 23551541
aaaatcacataagtctctctcttacattttgaaaccctaatttctcaaaataaatgtctgaagttgagtaccggtgctttgtcggcggccttgcctgggccaccaatgatgaagatcttcaaaggacgttctcacagttcggcgacgttatcgattctaagatcattaacgaccgcgagagtggaagatcaaggggattcggattcgtcaccttcaaggacgagaaagccatgagggatgcgattgaagagatgaacggtaaagagctcgatggacgtgtcatcaccgtgaacgaggctcagtcgagaggtagcggcggtggcggaggaggccgtggtggaagcggtggtggttaccgcagcggaggcggtggtggatactcaggaggcggtggcggcggatactcaggaggaggcggtggtggttacgagagacgtagcggaggttacggatctggtggaggcggtggtggccgaggatacggtggtggtggacgccgtgagggaggtggctacggaggcggtgatggtggaagttacggaggcggtggtggcggctggtaatcaaagatagagttgtttgcgtgctgctgctctgtttttggtttagatttggatttgtgtcaccacttctggtttggttatcgttcgtttggtttacttttttgatgaaacagtttcgtttaagtcttctttgtctggatcgaaatgttaattcgcgtgttgtttactaaatttataacgtttccttttaacc

SEQ ID NO: 5681 - protein, 169 aa, Arabidopsis thaliana
  misc_feature (1)..(169): useful for making plants with modified plant phenotypes as described in USSN 12/139,269
  misc_feature (8)..(79): Pfam Name: RRM_1; Pfam Description: RNA recognition motif. (a.k.a. RRM, RBD, or RNP domain)
  misc_feature (8)..(79): Pfam Name: RRM_1; Pfam Description: RNA recognition motif. (a.k.a. RRM, RBD, or RNP domain)
  misc_feature (1)..(169): Utility: Useful for delaying flowering time
  misc_feature (1)..(169): Utility: Useful for increasing chlorophyll and photosynthetic capacity
  misc_feature (1)..(169): Utility: Useful for making ornamental plants with modified leaves
  misc_feature (1)..(169): Utility: Useful for making plants sterile and for genetic confinement
  misc_feature (1)..(169): Utility: Useful for making plants with altered leaf shape eg curled leaves
  misc_feature (1)..(169): Utility: Useful for making plants with increased biomass and foliage
  misc_feature (1)..(169): Utility: Useful for making smaller plants
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERRSGGYGSGGGGGGRGYGGGGRREGGGYGGGDGGSYGGGGGGW

SEQ ID NO: 5682 - protein, 169 aa, Arabidopsis thaliana
  misc_feature (1)..(169): useful for making plants with modified plant phenotypes as described in USSN 12/139,269
  misc_feature (1)..(169): Public GI no. 17819
  misc_feature (1)..(169): Utility: Useful for delaying flowering time
  misc_feature (1)..(169): Utility: Useful for increasing chlorophyll and photosynthetic capacity
  misc_feature (1)..(169): Utility: Useful for making ornamental plants with modified leaves
  misc_feature (1)..(169): Utility: Useful for making plants sterile and for genetic confinement
  misc_feature (1)..(169): Utility: Useful for making plants with altered leaf shape eg curled leaves
  misc_feature (1)..(169): Utility: Useful for making plants with increased biomass and foliage
  misc_feature (1)..(169): Utility: Useful for making smaller plants
MSEVEYRCFVGGLAWATGDAELERTFSQFGEVIDSKIINDRETGRSRGFGFVTFKDEKSMKDAIDEMNGKELDGRTITVNEAQSRGGGGGGGRGGGGYGGRGGGGYGGGGGGYGDRRGGGGYGSGGGGRGGGGYGSGGGGYGGGGGRRDGGGYGGGDGGYGGGSGGGGW

SEQ ID NO: 5683 - protein, 157 aa, Arabidopsis thaliana; identical to SEQ ID NO: 441
  misc_feature (1)..(157): useful for making plants with modified plant phenotypes as described in USSN 12/139,269
  misc_feature (1)..(157): Public GI no. 18347
  misc_feature (1)..(157): Utility: Useful for delaying flowering time
  misc_feature (1)..(157): Utility: Useful for increasing chlorophyll and photosynthetic capacity
  misc_feature (1)..(157): Utility: Useful for making ornamental plants with modified leaves
  misc_feature (1)..(157): Utility: Useful for making plants sterile and for genetic confinement
  misc_feature (1)..(157): Utility: Useful for making plants with altered leaf shape eg curled leaves
  misc_feature (1)..(157): Utility: Useful for making plants with increased biomass and foliage
  misc_feature (1)..(157): Utility: Useful for making smaller plants

SEQ ID NO: 5684 - protein, 166 aa, Arabidopsis thaliana; identical to SEQ ID NO: 422
  misc_feature (1)..(166): useful for making plants with modified plant phenotypes as described in USSN 12/139,269
  misc_feature (1)..(166): Public GI no. 1346180
  misc_feature (1)..(166): Utility: Useful for delaying flowering time
  misc_feature (1)..(166): Utility: Useful for increasing chlorophyll and photosynthetic capacity
  misc_feature (1)..(166): Utility: Useful for making ornamental plants with modified leaves
  misc_feature (1)..(166): Utility: Useful for making plants sterile and for genetic confinement
  misc_feature (1)..(166): Utility: Useful for making plants with altered leaf shape eg curled leaves
  misc_feature (1)..(166): Utility: Useful for making plants with increased biomass and foliage
  misc_feature (1)..(166): Utility: Useful for making smaller plants

SEQ ID NO: 5685 - protein, 175 aa, Arabidopsis thaliana; identical to SEQ ID NO: 401
  misc_feature (1)..(175): useful for making plants with modified plant phenotypes as described in USSN 12/139,269
  misc_feature (1)..(175): Ceres CLONE ID no. 7420
  misc_feature (1)..(175): Utility: Useful for delaying flowering time
  misc_feature (1)..(175): Utility: Useful for increasing chlorophyll and photosynthetic capacity
  misc_feature (1)..(175): Utility: Useful for making ornamental plants with modified leaves
  misc_feature (1)..(175): Utility: Useful for making plants sterile and for genetic confinement
  misc_feature (1)..(175): Utility: Useful for making plants with altered leaf shape eg curled leaves
  misc_feature (1)..(175): Utility: Useful for making plants with increased biomass and foliage
  misc_feature (1)..(175): Utility: Useful for making smaller plants

SEQ ID NO: 5686 - protein, 169 aa, Arabidopsis thaliana; identical to SEQ ID NO: 423
  misc_feature (1)..(169): useful for making plants with modified plant phenotypes as described in USSN 12/139,269
  misc_feature (1)..(169): Public GI no. 1346181
  misc_feature (1)..(169): Utility: Useful for delaying flowering time
  misc_feature (1)..(169): Utility: Useful for increasing chlorophyll and photosynthetic capacity
  misc_feature (1)..(169): Utility: Useful for making ornamental plants with modified leaves
  misc_feature (1)..(169): Utility: Useful for making plants sterile and for genetic confinement
  misc_feature (1)..(169): Utility: Useful for making plants with altered leaf shape eg curled leaves
  misc_feature (1)..(169): Utility: Useful for making plants with increased biomass and foliage
  misc_feature (1)..(169): Utility: Useful for making smaller plants

SEQ ID NO: 5687 - protein, 176 aa, Arabidopsis thaliana; identical to SEQ ID NO: 399
  misc_feature (1)..(176): useful for making plants with modified plant phenotypes as described in USSN 12/139,269
  misc_feature (1)..(176): Public GI no. 4567224
  misc_feature (1)..(176): Utility: Useful for delaying flowering time
  misc_feature (1)..(176): Utility: Useful for increasing chlorophyll and photosynthetic capacity
  misc_feature (1)..(176): Utility: Useful for making ornamental plants with modified leaves
  misc_feature (1)..(176): Utility: Useful for making plants sterile and for genetic confinement
  misc_feature (1)..(176): Utility: Useful for making plants with altered leaf shape eg curled leaves
  misc_feature (1)..(176): Utility: Useful for making plants with increased biomass and foliage
  misc_feature (1)..(176): Utility: Useful for making smaller plants

SEQ ID NO: 5688 - protein, 175 aa, Arabidopsis thaliana; identical to SEQ ID NO: 403
  misc_feature (1)..(175): useful for making plants with modified plant phenotypes as described in USSN 12/139,269
  misc_feature (1)..(175): Ceres CLONE ID no. 13879
  misc_feature (1)..(175): Utility: Useful for delaying flowering time
  misc_feature (1)..(175): Utility: Useful for increasing chlorophyll and photosynthetic capacity
  misc_feature (1)..(175): Utility: Useful for making ornamental plants with modified leaves
  misc_feature (1)..(175): Utility: Useful for making plants sterile and for genetic confinement
  misc_feature (1)..(175): Utility: Useful for making plants with altered leaf shape eg curled leaves
  misc_feature (1)..(175): Utility: Useful for making plants with increased biomass and foliage
  misc_feature (1)..(175): Utility: Useful for making smaller plants
  misc_feature (142)..(142): Xaa is any aa, unknown or other

SEQ ID NO: 5689 - protein, 175 aa, Arabidopsis thaliana; identical to SEQ ID NO: 403
  misc_feature (1)..(175): useful for making plants with modified plant phenotypes as described in USSN 12/139,269
  misc_feature (1)..(175): Public GI no. 21553354
  misc_feature (1)..(175): Utility: Useful for delaying flowering time
  misc_feature (1)..(175): Utility: Useful for increasing chlorophyll and photosynthetic capacity
  misc_feature (1)..(175): Utility: Useful for making ornamental plants with modified leaves
  misc_feature (1)..(175): Utility: Useful for making plants sterile and for genetic confinement
  misc_feature (1)..(175): Utility: Useful for making plants with altered leaf shape eg curled leaves
  misc_feature (1)..(175): Utility: Useful for making plants with increased biomass and foliage
  misc_feature (1)..(175): Utility: Useful for making smaller plants
  misc_feature (142)..(142): Xaa is any aa, unknown or other

SEQ ID NO: 5690 - DNA, 1247 bp, Arabidopsis thaliana
  misc_feature (1)..(1247): useful for making plants with modified plant phenotypes as described in USSN 12/139,269
  misc_feature (1)..(1247): Ceres CLONE ID no. 32753
  misc_feature (1)..(1247): Also known as  Ceres CDNA ID no. 23478258
ctcttgcttctcttcactcacaatctcacagcaaagcctctcgttgctagaggaatcaaacaatggtgtttgtgaagtccaccaagtcgaatgcttacttcaagaggtaccaagtgaagttcaggagaagaagagatggaaagactgactacagggcaaggatccgtcttatcaaccaagacaagaacaagtacaatacacctaagtatcgttttgttgtccggtttaccaacaaagacatagtggcacagattgtatctgcaagcattgctggtgacattgttaaagcttctgcttacgcacatgaactgcctcagtatggtctcactgttggtcttacaaactatgctgcagcttactgtactggccttcttttggctcgccgtgttttaaagatgttggaaatggatgacgagtatgagggaaacgttgaggccactggagaggacttttccgttgagccaactgattcaaggagacctttccgtgctcttcttgatgttggacttatcaggaccacaacaggaaaccgtgtgttcggtgctcttaagggtgctttggatggtggtcttgatatccctcacagtgacaagagatttgctgggttccacaaggagaacaagcaacttgatgctgaaatccacaggaactacatctatggtggccatgtctcaaactacatgaagctgttgggagaagatgagccagagaagttacaaactcacttcagtgcttacatcaagaaaggagttgaagctgagagcattgaggagttgtacaagaaggttcacgcagctattcgtgctgaccccaacccaaagaaaaccgtgaaacctgctcccaagcaacacaagaggtacaacttgaagaaacttacttacgaggagaggaagaacaagttgatcgagagagtcaggcattgaatggagcaggtggtgatgatgatgatgaggacgatgaagagtaaatcagtcaagccttctttatctcatgcctcttgtagttttttatcttttgagcttaatgcctcaaattttctgttttcagactaaaacactcagcttttgtgttcacattttaattgtgttcgaggattttgatattgaggatacattttctttgaagtatcattatcttattattacctccatcataattttcaagaatttgtatgacaatagtttgatgacttgattttatctgtagtttgctattgttaaatgtaagaactgttagacttcatctat

SEQ ID NO: 5691 - protein, 286 aa, Arabidopsis thaliana
  misc_feature (1)..(286): useful for making plants with modified plant phenotypes as described in USSN 12/139,269
  misc_feature (26)..(172): Pfam Name: Ribosomal_L18p; Pfam Description: Ribosomal L18p/L5e family
  misc_feature (26)..(172): Pfam Name: Ribosomal_L18p; Pfam Description: Ribosomal L18p/L5e family
  misc_feature (1)..(286): Utility: Useful for delaying flowering time
  misc_feature (1)..(286): Utility: Useful for increasing chlorophyll and photosynthetic capacity
  misc_feature (1)..(286): Utility: Useful for making larger plants
  misc_feature (1)..(286): Utility: Useful for making plants sterile and for genetic confinement
  misc_feature (1)..(286): Utility: Useful for making smaller plants
  misc_feature (249)..(249): Xaa is any aa, unknown or other
  misc_feature (252)..(252): Xaa is any aa, unknown or other
MVFVKSTKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDDEYEGNVEATGEDFSVEPTDSRRPFRALLDVGLIRTTTGNRVFGALKGALDGGLDIPHSDKRFAGFHKENKQLDAEIHRNYIYGGHVSNYMKLLGEDEPEKLQTHFSAYIKKGVEAESIEELYKKVHAAIRAXPNXRKTVKPAPKQHKRYNLKKLTYEERKNKLIERVRH

SEQ ID NO: 5692 - protein, 301 aa, Arabidopsis thaliana
  misc_feature (1)..(301): useful for making plants with modified plant phenotypes as described in USSN 12/139,269
  misc_feature (1)..(301): Ceres CLONE ID no. 21756
  misc_feature (1)..(301): Utility: Useful for delaying flowering time
  misc_feature (1)..(301): Utility: Useful for increasing chlorophyll and photosynthetic capacity
  misc_feature (1)..(301): Utility: Useful for making larger plants
  misc_feature (1)..(301): Utility: Useful for making plants sterile and for genetic confinement
  misc_feature (1)..(301): Utility: Useful for making smaller plants
MVFVKSSKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDDEYEGNVEATGEDFSVEPTDSRRPFRALLDVGLIRTTTGNRVFGALKGALDGGLDIPHSDKRFAGFHKENKQLDAEIHRNYIYGGHVSNYMKLLGEDEPEKLQTHFSAYIKKGVEAESIEEMYKKVHAAIRAEPNHKKTEKSAPKEHKRYNLKKLTYEERKNKLIERVKALNGAGGDDDDEDDEE

SEQ ID NO: 5693 - protein, 302 aa, Zea mays
  misc_feature (1)..(302): useful for making plants with modified plant phenotypes as described in USSN 12/139,269
  misc_feature (1)..(302): Ceres CLONE ID no. 1538293
  misc_feature (1)..(302): Utility: Useful for delaying flowering time
  misc_feature (1)..(302): Utility: Useful for increasing chlorophyll and photosynthetic capacity
  misc_feature (1)..(302): Utility: Useful for making larger plants
  misc_feature (1)..(302): Utility: Useful for making plants sterile and for genetic confinement
  misc_feature (1)..(302): Utility: Useful for making smaller plants
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDKEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEADEIEALYKKVHAAIRADPSIVKSTKQPPKEHKRYNPKKLTYEQRKASLIERLNQLNSSGGADDDDEDDE

SEQ ID NO: 5694 - protein, 302 aa, Triticum aestivum
  misc_feature (1)..(302): useful for making plants with modified plant phenotypes as described in USSN 12/139,269
  misc_feature (1)..(302): Ceres CLONE ID no. 933957
  misc_feature (1)..(302): Utility: Useful for delaying flowering time
  misc_feature (1)..(302): Utility: Useful for increasing chlorophyll and photosynthetic capacity
  misc_feature (1)..(302): Utility: Useful for making larger plants
  misc_feature (1)..(302): Utility: Useful for making plants sterile and for genetic confinement
  misc_feature (1)..(302): Utility: Useful for making smaller plants
  misc_feature (92)..(92): Xaa is any aa, unknown or other
  misc_feature (94)..(94): Xaa is any aa, unknown or other
  misc_feature (96)..(96): Xaa is any aa, unknown or other
  misc_feature (107)..(107): Xaa is any aa, unknown or other
  misc_feature (126)..(126): Xaa is any aa, unknown or other
  misc_feature (134)..(134): Xaa is any aa, unknown or other
  misc_feature (135)..(135): Xaa is any aa, unknown or other
  misc_feature (139)..(139): Xaa is any aa, unknown or other
  misc_feature (142)..(142): Xaa is any aa, unknown or other
  misc_feature (196)..(196): Xaa is any aa, unknown or other
  misc_feature (199)..(199): Xaa is any aa, unknown or other
  misc_feature (201)..(201): Xaa is any aa, unknown or other
  misc_feature (208)..(208): Xaa is any aa, unknown or other
  misc_feature (210)..(210): Xaa is any aa, unknown or other
  misc_feature (211)..(211): Xaa is any aa, unknown or other
  misc_feature (215)..(215): Xaa is any aa, unknown or other
  misc_feature (216)..(216): Xaa is any aa, unknown or other
  misc_feature (218)..(218): Xaa is any aa, unknown or other
  misc_feature (220)..(220): Xaa is any aa, unknown or other
MVFVKNQKTRAYSKRFQVKFKRRRQGKTDYRARLRLTNQDKNKYNTPKYRFVVRFTNKDVTAQIVYATIAGDIVMAAAYSHELPRYGLEVGXTXYXAAYCTGLLLAXRVLKCRDLDQEYEGNVEAXGEDFSVEXXDERXPFXALLDVGLIRTTTGNRVFGALKGALDGGLDIPHSDKRFAGFKKDEKQLDAEIHRXYIXGXHVADYMXSXXDEEXXKXQXHFSEYIKRGISADDMEAVYKKVHAAIRADPTMAKSTKAPPKTHKRYNPKKLTYEQRKASLVERLNALNNSAGAADDDEDDDE

SEQ ID NO: 5695 - DNA, 1145 bp, Arabidopsis thaliana
  misc_feature (1)..(1145): useful for making plants with modified plant phenotypes as described in USSN 12/139,269
  misc_feature (1)..(1145): Ceres CLONE ID no. 34167
  misc_feature (1)..(1145): Also known as  Ceres CDNA ID no. 23385560
atttcacatctctctctctctctataagaaccctagaagaaggtttctcttgtcctccatacacttagcacaactgataaatcttttgaggtaaaatcagctttagatcaaggtttttctagtcatctctactcataaagatcaaagcttttgctattctcattttctaccaagagacaatatcatgatgatgggaaaagaggatttgggtttaagtcttagcttgggatttgcacaaaaccatcctctccagctaaatcttaaacccacttcttcaccaatgtccaatctccagatgtttccatggaaccaaacccttgtttcttcctcagatcaacaaaagcaacagtttcttaggaaaatcgacgtgaacagcttgccaacaacggtggatttggaagaggagataggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccaaacagaagctggctttggctaagaagctaggtttaacagcaagacaagtggaagtgtggttccaaaacagaagagcaaggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgggtcattgtactttttagattattgactctcagctaatgtatccttaaaagcctttttctacttttaaatttactttaatct

SEQ ID NO: 5696 - protein, 282 aa, Arabidopsis thaliana
  misc_feature (1)..(282): useful for making plants with modified plant phenotypes as described in USSN 12/139,269
  misc_feature (1)..(98): Pfam Name: HD-ZIP_N; Pfam Description: HD-ZIP protein N terminus
  misc_feature (190)..(234): Pfam Name: HALZ; Pfam Description: Homeobox associated leucine zipper
  misc_feature (135)..(189): Pfam Name: Homeobox; Pfam Description: Homeobox domain
  misc_feature (1)..(282): Utility: Useful for delaying flowering time
  misc_feature (1)..(282): Utility: Useful for increasing chlorophyll and photosynthetic capacity
  misc_feature (1)..(282): Utility: Useful for making lethal plants for genetic confinement systems
  misc_feature (1)..(282): Utility: Useful for making ornamental plants with modified leaves
  misc_feature (1)..(282): Utility: Useful for making smaller plants
MMMGKEDLGLSLSLGFAQNHPLQLNLKPTSSPMSNLQMFPWNQTLVSSSDQQKQQFLRKIDVNSLPTTVDLEEEIGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 5697 - protein, 283 aa, Arabidopsis thaliana
  misc_feature (1)..(283): useful for making plants with modified plant phenotypes as described in USSN 12/139,269
  misc_feature (1)..(283): Public GI no. 18857720
  misc_feature (1)..(283): Utility: Useful for delaying flowering time
  misc_feature (1)..(283): Utility: Useful for increasing chlorophyll and photosynthetic capacity
  misc_feature (1)..(283): Utility: Useful for making lethal plants for genetic confinement systems
  misc_feature (1)..(283): Utility: Useful for making ornamental plants with modified leaves
  misc_feature (1)..(283): Utility: Useful for making smaller plants
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 5698 - protein, 282 aa, Arabidopsis thaliana
  misc_feature (1)..(282): useful for making plants with modified plant phenotypes as described in USSN 12/139,269
  misc_feature (1)..(282): Ceres CLONE ID no. 1014844
  misc_feature (1)..(282): Utility: Useful for delaying flowering time
  misc_feature (1)..(282): Utility: Useful for increasing chlorophyll and photosynthetic capacity
  misc_feature (1)..(282): Utility: Useful for making lethal plants for genetic confinement systems
  misc_feature (1)..(282): Utility: Useful for making ornamental plants with modified leaves
  misc_feature (1)..(282): Utility: Useful for making smaller plants
MMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 5699 - protein, 297 aa, Glycine max
  misc_feature (1)..(297): useful for making plants with modified plant phenotypes as described in USSN 12/139,269
  misc_feature (1)..(297): Ceres CLONE ID no. 527278
  misc_feature (1)..(297): Utility: Useful for delaying flowering time
  misc_feature (1)..(297): Utility: Useful for increasing chlorophyll and photosynthetic capacity
  misc_feature (1)..(297): Utility: Useful for making lethal plants for genetic confinement systems
  misc_feature (1)..(297): Utility: Useful for making ornamental plants with modified leaves
  misc_feature (1)..(297): Utility: Useful for making smaller plants
  misc_feature (253)..(253): Xaa is any aa, unknown or other
  misc_feature (257)..(257): Xaa is any aa, unknown or other
MVQKEDLGLSLSLNFPHHSTPNPQHLSLMSSSTHSSSPSGFNPQKPSWNEAFASSDPDRNSDTCRGETRSFLRGIDVNRLPSAVDAEEEAGVSSPNSTVSCVSGKRSEREPNGEEHDMDRACSRGISDEEDAETSRKKLRLSKDQSSILEESFKEHNTLNPKQKLALAKQLGLRPRQVEVWFQNRRARTKLKQTEVDCEVLKRCCENLTEENRRLQKEVQELRALKLSPQFYMQMSPPTTLTMCPSCERVAVXSSAXGSATRHHPMAHAHAHARPMPNGPWASAAPIPHRPFDAFHQ

SEQ ID NO: 5700 - protein, 285 aa, Glycine max
  misc_feature (1)..(285): useful for making plants with modified plant phenotypes as described in USSN 12/139,269
  misc_feature (1)..(285): Ceres CLONE ID no. 514259
  misc_feature (1)..(285): Utility: Useful for delaying flowering time
  misc_feature (1)..(285): Utility: Useful for increasing chlorophyll and photosynthetic capacity
  misc_feature (1)..(285): Utility: Useful for making lethal plants for genetic confinement systems
  misc_feature (1)..(285): Utility: Useful for making ornamental plants with modified leaves
  misc_feature (1)..(285): Utility: Useful for making smaller plants
MTVEKEDLGLSLSLSFPQNPPTHLHLNLVSSSPSSHNPQKPSWNDPFTSSAGSSFLRGIDVNRLPSVVDCEEEAGVSSPNSTVSSVSGKRSEREEANGEENDTDRACSRGIISDEEDAETSRKKLRLSKDQSIILEESFKEHNTLNPKQKLALAKQLGLRARQVEVWFQNRRARTKLKQTEVDCEFLKRCCENLTVENRRLQKEVQELRALKLSPQFYMHMTPPTTLTMCPSCERVAVPPSSAVDPAMRHHHVPPTQPRAFPIGPWATAAATIPHRPFDALRRRS

SEQ ID NO: 5701 - protein, 289 aa, Glycine max
  misc_feature (1)..(289): useful for making plants with modified plant phenotypes as described in USSN 12/139,269
  misc_feature (1)..(289): Public GI no. 8919876
  misc_feature (1)..(289): Utility: Useful for delaying flowering time
  misc_feature (1)..(289): Utility: Useful for increasing chlorophyll and photosynthetic capacity
  misc_feature (1)..(289): Utility: Useful for making lethal plants for genetic confinement systems
  misc_feature (1)..(289): Utility: Useful for making ornamental plants with modified leaves
  misc_feature (1)..(289): Utility: Useful for making smaller plants
MMLEKDDLGLSLGLNYPKKQMNLNSNPSVSVTPSSSSFGLLRRSSLNESFTSSVPNSDSSQKETRTFIRGIDVNRPPSTAEYGEEDAGVSSPNSTVSSSTGKRSEREEDTDPQGSRGGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRALKLSPQFYMHMSPPTTLTMCPSCEHVSAPPPQQPPQAATSAQHHRGSLPVNAWAQGTRISHGLTFDALRPRS

SEQ ID NO: 5702 - protein, 286 aa, Glycine max
  misc_feature (1)..(286): useful for making plants with modified plant phenotypes as described in USSN 12/139,269
  misc_feature (1)..(286): Public GI no. 992598
  misc_feature (1)..(286): Utility: Useful for delaying flowering time
  misc_feature (1)..(286): Utility: Useful for increasing chlorophyll and photosynthetic capacity
  misc_feature (1)..(286): Utility: Useful for making lethal plants for genetic confinement systems
  misc_feature (1)..(286): Utility: Useful for making ornamental plants with modified leaves
  misc_feature (1)..(286): Utility: Useful for making smaller plants
MSSEKEDGLGLSLSLGIMSCPQNNHKTTPSLPLNLLPFMHHHQVSSGRKDEGGERVRGGIDMNEPARMIIECDDEEDEEEDQVLMVSSPNSTVSSVSGKRSHDREENEGERATSSLEDDGGDAAARKKLRLSKEQAAVLEETFKEHNTLNPKQKLALSKQLNLRPRQVEVWFQNRRARTKLKQTEVDCEYLKRCCENLTDENRRLQKEVSELRALKLSPQFYMNMSPPTTLTMCPQCERVAVSSSSSSSSVVNATRAQNHQAPVPMNKPWAAMFASKTLDVQRSQM

SEQ ID NO: 5703 - DNA, 1428 bp, Arabidopsis thaliana
  misc_feature (1)..(1428): useful for making plants with modified plant phenotypes as described in USSN 12/139,269
  misc_feature (1)..(1428): Ceres CLONE ID no. 34385
  misc_feature (1)..(1428): Also known as  Ceres CDNA ID no. 23369491
gcaattttaactgcgaaacgctttttttttcctctctacacccaaattgaagggaaaaaaaaatctgcggatcctcgagaagccctatcaaacacataaagttctttctcttactcatctccgccgccggcagtaaaaatatcacatcgttagggtttcacggcggagattcaagttctttgacctaggaagctttcactatcaccggagactatttcaatggcaaccatggctaggtcgtttctgcaggcgatatcgaaggatgaggcggtggctcctccgcttagagttgttcagatcgaaggactggctgtactaaagataatcaaacactgcaaggagttttcaccgacccttgtcactggacagcttcttggacttgatgttggtagcgtcctcgaagttaccaattgttttcctttcccggtcagggatgatgatgaagaaattgaagctgatggtgctaattatcagcttgagatgatgagatgtctgagggaggttaatgttgacaacaacactgttggctggtatcaatctacagttcttggttcgtatcagactgtggaactgattgagaccttcatgaattaccaggagaatatcaagaggtgtgtgtgcatcatatatgatccctctaaagctgatctaggcgtcttagctttgaaggctttgaagctttcagattcctttatggagttgtaccgaggtggaaactttactggcgagaagttgagagagaaaaatttctcctggatggatatttttgaggaaatacctatcaaggtttcaaattctgcccttgtcagtgcctttatgaccgaactggagactgatacacctgtctcacagggcgattatgatcgtctacactcatcaaccactcctttccttgagaacaatatggagtttttgattaaatgcatggatgatttatctatggaacagcaaaagttccagtattactaccggaacctgtctcgtcagcaagcacaacagcaagcctggctccagaagagaagaacggagaacatggctcgtaaatcagctggagaggagcctttaccagaagaggatccttcaaacccaatctttaaggcgatccctgaaccatctaggctagagagtttcctcatcacaaaccaagtctcaaacttctgtggccaaatcaatggagtggctggccagaacttcagcaggctttacctgaccaaagcattgcacgacaactgattgcaaagactacccaagtttttgttttttgagtcagaaagtgaaagacttggtggtagaatggatcctatatttgtttttggtggatgtttttgtttttatttttgttgttgtgaagtaatttaatttacaagcttttcaaaaaaaatctttattcttatgcataatgaaaaattattgaagttttgaaagact

SEQ ID NO: 5704 - protein, 337 aa, Arabidopsis thaliana
  misc_feature (1)..(337): useful for making plants with modified plant phenotypes as described in USSN 12/139,269
  misc_feature (20)..(128): Pfam Name: Mov34; Pfam Description: Mov34/MPN/PAD-1 family
  misc_feature (20)..(128): Pfam Name: Mov34; Pfam Description: Mov34/MPN/PAD-1 family
  misc_feature (1)..(337): Utility: Useful for delaying flowering time
  misc_feature (1)..(337): Utility: Useful for increasing chlorophyll and photosynthetic capacity
  misc_feature (1)..(337): Utility: Useful for increasing seed/fruit yield or modifying fruit content
  misc_feature (1)..(337): Utility: Useful for making plants sterile and for genetic confinement
  misc_feature (1)..(337): Utility: Useful for making plants with increased biomass and foliage
  misc_feature (1)..(337): Utility: Useful for making shorter plants and plants with modified flowers
  misc_feature (1)..(337): Utility: Useful for making smaller plants
MATMARSFLQAISKDEAVAPPLRVVQIEGLAVLKIIKHCKEFSPTLVTGQLLGLDVGSVLEVTNCFPFPVRDDDEEIEADGANYQLEMMRCLREVNVDNNTVGWYQSTVLGSYQTVELIETFMNYQENIKRCVCIIYDPSKADLGVLALKALKLSDSFMELYRGGNFTGEKLREKNFSWMDIFEEIPIKVSNSALVSAFMTELETDTPVSQGDYDRLHSSTTPFLENNMEFLIKCMDDLSMEQQKFQYYYRNLSRQQAQQQAWLQKRRTENMARKSAGEEPLPEEDPSNPIFKAIPEPSRLESFLITNQVSNFCGQINGVAGQNFSRLYLTKALHDN

SEQ ID NO: 5705 - protein, 337 aa, Glycine max
  misc_feature (1)..(337): useful for making plants with modified plant phenotypes as described in USSN 12/139,269
  misc_feature (1)..(337): Ceres CLONE ID no. 463738
  misc_feature (1)..(337): Utility: Useful for delaying flowering time
  misc_feature (1)..(337): Utility: Useful for increasing chlorophyll and photosynthetic capacity
  misc_feature (1)..(337): Utility: Useful for increasing seed/fruit yield or modifying fruit content
  misc_feature (1)..(337): Utility: Useful for making plants sterile and for genetic confinement
  misc_feature (1)..(337): Utility: Useful for making plants with increased biomass and foliage
  misc_feature (1)..(337): Utility: Useful for making shorter plants and plants with modified flowers
  misc_feature (1)..(337): Utility: Useful for making smaller plants
MATTPARSFLQVAATEEAAPPLRVVQIEGLVILKIIKHCKDHSPSLVTGQLLGLDVGSVLEVTNCFPFPMREEDEEIEADGANYQLEMMRCLREVNVDNNTVGWYQSTLLGSFQTVELIETFMNYQENIRRCVCIIYDPSRSDQGVLALKALKLSDSFMELYRSNNFTGEKLREKNLSWVDIFEEIPIKVSNSALISAFMTELEPDTPVTQCDYDRLQLSTSSLMERNTEFLIECMDDLSLEQQKFQFYYRSLSRQQAQQQAWLQKRRTENMARKAAGEEPLPEEDPSNPIFKPLPEPSRLESFLITNQISNYCNQINGVSGQSFNRLYLMKALHED

SEQ ID NO: 5706 - protein, 347 aa, Glycine max
  misc_feature (1)..(347): useful for making plants with modified plant phenotypes as described in USSN 12/139,269
  misc_feature (1)..(347): Public GI no. 50923675
  misc_feature (1)..(347): Utility: Useful for delaying flowering time
  misc_feature (1)..(347): Utility: Useful for increasing chlorophyll and photosynthetic capacity
  misc_feature (1)..(347): Utility: Useful for increasing seed/fruit yield or modifying fruit content
  misc_feature (1)..(347): Utility: Useful for making plants sterile and for genetic confinement
  misc_feature (1)..(347): Utility: Useful for making plants with increased biomass and foliage
  misc_feature (1)..(347): Utility: Useful for making shorter plants and plants with modified flowers
  misc_feature (1)..(347): Utility: Useful for making smaller plants
MANPAAAAGPSGGARSFLQAVSTVTEEAPSPLRVVQMEGLAVLKIIKHCEEFAPALVTGQLLGLDVGSVLEVTNCFPFPMREDDEEADADGANYQLEMMRCLREVNVDNNTVGWYQSCLLGSFQTVELIETFMNYQENIRRCVCIVYDPSRSNQGVLALKALKLTDSFMDLYRNNGLTGEKLREKKLSWVDIFEEIPIKVSNSALVSAFMTELEPESPVSQCDFDRLKLSTAPFMERNLEFLIGCMDDLSSEQNKFQYYYRNVSRQQSQQQAWLQKRRQENMARKAAGEEPLPEEDPSNPIFKPIPEPSRLEGYLVTNQISSYCNHINGVAGQNFNRLYLMKALQED

SEQ ID NO: 5707 - protein, 397 aa, Zea mays
  misc_feature (1)..(397): useful for making plants with modified plant phenotypes as described in USSN 12/139,269
  misc_feature (1)..(397): Ceres CLONE ID no. 222358
  misc_feature (1)..(397): Utility: Useful for delaying flowering time
  misc_feature (1)..(397): Utility: Useful for increasing chlorophyll and photosynthetic capacity
  misc_feature (1)..(397): Utility: Useful for increasing seed/fruit yield or modifying fruit content
  misc_feature (1)..(397): Utility: Useful for making plants sterile and for genetic confinement
  misc_feature (1)..(397): Utility: Useful for making plants with increased biomass and foliage
  misc_feature (1)..(397): Utility: Useful for making shorter plants and plants with modified flowers
  misc_feature (1)..(397): Utility: Useful for making smaller plants
  misc_feature (4)..(4): Xaa is any aa, unknown or other
NCTXPALCYSRSQPENPNFPAAAFLSLDPQLAPFLQVRTHRPAYALPPNDLRAAMANSAAPGGMRSFLQAVSTVTEEAPTPLRVVQMEGLAVLKIIKHCEEFAPALVTGQLLGLDVGSVLEVTNCFPFPIREEDDEADADGANYQLEMMRCLREVNVDNNTIGWYQSCLLGSFQTVELIETFMNYQESIRRCVCIVYDPSRSSQGVLALKALKLTDSFMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQICSYCNHINGVAGQNFDRLYLMKALHED

SEQ ID NO: 5708 - protein, 395 aa, Zea mays
  misc_feature (1)..(395): useful for making plants with modified plant phenotypes as described in USSN 12/139,269
  misc_feature (1)..(395): Ceres CLONE ID no. 246601
  misc_feature (1)..(395): Utility: Useful for delaying flowering time
  misc_feature (1)..(395): Utility: Useful for increasing chlorophyll and photosynthetic capacity
  misc_feature (1)..(395): Utility: Useful for increasing seed/fruit yield or modifying fruit content
  misc_feature (1)..(395): Utility: Useful for making plants sterile and for genetic confinement
  misc_feature (1)..(395): Utility: Useful for making plants with increased biomass and foliage
  misc_feature (1)..(395): Utility: Useful for making shorter plants and plants with modified flowers
  misc_feature (1)..(395): Utility: Useful for making smaller plants
INWTRTSCSLLSPADKKTLEFPAAALLSLDPFLQARTHPHASAPPPNDLRAAMANSAAPGGVRSFLQAVSTVTEETRTPLRVVQMEGLAVLKIIKHCEEFAPALVTGQLLGLDVGSVLEVTNCFPFPMREEDDEADADGANYQLEMMRCLREVNVDNNTIGWYQSCLLGSFQTVELIETFMNYQESIRRCVCIVYDPSRSSQGVLALKALKLTDSFMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQISSYCNHINGVAGQNFDRLYLMKALHED

SEQ ID NO: 5709 - protein, 343 aa, Zea mays
  misc_feature (1)..(343): useful for making plants with modified plant phenotypes as described in USSN 12/139,269
  misc_feature (1)..(343): Ceres CLONE ID no. 1213577
  misc_feature (1)..(343): Utility: Useful for delaying flowering time
  misc_feature (1)..(343): Utility: Useful for increasing chlorophyll and photosynthetic capacity
  misc_feature (1)..(343): Utility: Useful for increasing seed/fruit yield or modifying fruit content
  misc_feature (1)..(343): Utility: Useful for making plants sterile and for genetic confinement
  misc_feature (1)..(343): Utility: Useful for making plants with increased biomass and foliage
  misc_feature (1)..(343): Utility: Useful for making shorter plants and plants with modified flowers
  misc_feature (1)..(343): Utility: Useful for making smaller plants
MANSAAPGGMRSFLQAVSTVTEEAPTPLRVVQMEGLAVLKIIKHCEEFAPALVTGQLLGLDVGSVLEVTNCFPFPIREEDDEADADGANYQLEMMRCLREVNVDNNTIGWYQSCLLGSFQTVELIETFMNYQESIRRCVCIVYDPSRSSQGVLALKALKLTDSFMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQICSYCNHINGVAGQNFDRLYLMKALHED

SEQ ID NO: 5710 - DNA, 1839 bp, Arabidopsis thaliana
  misc_feature (1)..(1839): useful for making plants with modified plant phenotypes as described in USSN 12/139,269
  misc_feature (1)..(1839): Ceres CLONE ID no. 34552
  misc_feature (1)..(1839): Also known as  Ceres CDNA ID no. 23361470
aggtaacgtctctctctctctgtgactctctcaattagtttgaaccagtcaactcgtaaagcccttgtttcctgtaattttccgaattgggtcttcccttaatttatcatttctcgccggaaaaactttgagaatttccttgtatttcacggcgatgctataatcctcctgaaagcgacttactgatatatattagtttattaggcaatgaatgtgaaatttaccgagtcaaacgtgtttaaacaatgtaaaagtgttgcaggcgattgttttgtttatcttgttttgggtttggttgtcttggatgggaggaagtagctctaaagagtcacctagaggaggtggaagtggtcgtaggtatgaacgtagtgtgtctgggagctcatcttattcgtctgcttgggaccagagcagctattatcagacaccaaaccatccatctgcgtctcctgtttcatcctataattctgggagacaaacaccgaagaatcttgagaggaagtattcacggattgctgataactaccgttccattgatgaggttaccgctgctctttcacatgccggtttggagtcctcgaatctcattgttggtatagatgtcaccaagagcaacgagtggacaggggcgagatcatttggtaggaagagtctgcatttcattggaactactccaaacccttatcaacaagctatttccatcattggaaagactttatcggtttttgatgaggataatttgatcccctgttatggatttggagatgctacaactcatgatcaggatgtcttcagtttcaatcccaatgatacatattgtaacgggtttgaagaagttctcatgtgttacagagagattgttccccagcttcgtctctcaggtccgacatcttttgcacctatcatcgaaagggccatgacaattgtggaagaaagtggtggccagtaccatgttcttctcattatcgctgatggacaggtgacaagaagtgttgatacagataacggtggattcagtccacaagagcagcagactattgatgccattgttagagcaagtgaatatcctttgtctatagttcttgttggtgttggagatggtccctgggacaccatgagacagtttgatgacaacatccccgctcgtgcctttgacaatttccagtttgtgaatttcacggatataatgtcaaagaacattgatccagcaagaaaagaggcagaattcgcgctttctgccttgatggagatcccgtctcagtataaagccaccctcgaactaggcttacttggacaaagaaccggacattgtccagacaggattgcgcttccaccaccaacttatgctactcaatctatgcgcaacagcccaagaacttcccgatcaaccagttttcaaaacaaaccatatgataatggtgtttcctctacaccaccttcaactactcataacgagagccagcaacagttttgccccgtatgtctagtgagtgcaaagaacatggctttcaattgtggtcatcagacttgcgctggatgtggggaagacctccatgtgtgtcccatttgccggagctcaatctcggttcgtatcaagctttattaagataagtctctcaagaactgaaggaacccgaggtggtctgagatctttcacagccaacaccatcccaacttagatctcatttaccagtgtcctaacatttgtttttactttgaggggaataaccggttcctctcaaaggttttgtagataatctgttgtcaattttgcattctcattgcacatgaaaaaaccacagcagactctctcgtgaataaaggatcctttctctgcgg

SEQ ID NO: 5711 - protein, 433 aa, Arabidopsis thaliana
  misc_feature (1)..(433): useful for making plants with modified plant phenotypes as described in USSN 12/139,269
  misc_feature (116)..(264): Pfam Name: Copine; Pfam Description: Copine
  misc_feature (116)..(264): Pfam Name: Copine; Pfam Description: Copine
  misc_feature (1)..(433): Utility: Useful for delaying flowering time
  misc_feature (1)..(433): Utility: Useful for making plants with altered leaf shape eg curled leaves
  misc_feature (1)..(433): Utility: Useful for making plants with increased biomass
  misc_feature (1)..(433): Utility: Useful for making plants with increased biomass and foliage
  misc_feature (1)..(433): Utility: Useful for making smaller plants
MGGSSSKESPRGGGSGRRYERSVSGSSSYSSAWDQSSYYQTPNHPSASPVSSYNSGRQTPKNLERKYSRIADNYRSIDEVTAALSHAGLESSNLIVGIDVTKSNEWTGARSFGRKSLHFIGTTPNPYQQAISIIGKTLSVFDEDNLIPCYGFGDATTHDQDVFSFNPNDTYCNGFEEVLMCYREIVPQLRLSGPTSFAPIIERAMTIVEESGGQYHVLLIIADGQVTRSVDTDNGGFSPQEQQTIDAIVRASEYPLSIVLVGVGDGPWDTMRQFDDNIPARAFDNFQFVNFTDIMSKNIDPARKEAEFALSALMEIPSQYKATLELGLLGQRTGHCPDRIALPPPTYATQSMRNSPRTSRSTSFQNKPYDNGVSSTPPSTTHNESQQQFCPVCLVSAKNMAFNCGHQTCAGCGEDLHVCPICRSSISVRIKLY

SEQ ID NO: 5712 - DNA, 1856 bp, Arabidopsis thaliana
  misc_feature (1)..(1856): useful for making plants with modified plant phenotypes as described in USSN 12/139,269
  misc_feature (1)..(1856): Ceres CLONE ID no. 35776
  misc_feature (1)..(1856): Also known as  Ceres CDNA ID no. 23458256
  misc_feature (989)..(989): s is g or c
aacaaattcctacaccaatatctttagctagagagaaaaaaagagtgaggaaactagagagagagaccacccaataatggtgaggttcgagaaggttcatttagtgttagggttagctctggttctaactctggtcggagctccgaccaaagcccaaggacctgtttgcggtgcaggcctgcctgacaaatttagcagattaaacttccctgaaggcttcatttggggaaccgcaacagcagcatttcaggttgaaggagctgttaatgaaggttgcagaggtccaagcatgtgggatactttcactaagaagttcccacatagatgtgaaaatcataacgctgatgttgctgtggatttctatcatcgttacaaggaagatatccagttgatgaaagaccttaacactgatgcttttagactttctattgcgtggcccagaatattcccccatggaaggatgtctaagggaataagcaaagtgggagtccaattctaccacgacctcatcgatgagcttctcaaaaacaatataataccattagttacagtctttcattgggatactccccaagacttggaagatgaatatggtggtttcttaagtggtcgcatcgtgcaagattttaccgaatatgcgaatttcactttccacgaatatggacacaaagtgaaacattggatcacattcaatgagccatgggtgtttagtcgtgccggttacgacaacggaaagaaagctccgggacgttgttcaccgtacatccccggttatggacagcattgtcaagatgggcggtctggatacgaagcttatcaagtcagtcacaacttactcttgtcgcatgcttacgccgttgacgcattcagaaaatgcaaacagtgtgctggaggtaaaataggaattgcacacagtccagcttggttcgaaccacaagaccttgagcatgttggaggttccattgaacgtgtgcttgatttcatcctasgatggcatttggctccaacaacttatggagattatccacaatcgatgaaggatcgtgtcggtcatagattgccaaaattcacagaagctgagaagaagttgctgaagggttctacagattactaggaatgaattactatacttcagtgtttgcaaaagaaattagccctgatcctaagaatccgagttggacgactgattctcttgttgattgggatagcaagagtgtggatggatacaaaattggtagcaagccgtttaatggtaaactggatgtgtattcaaaaggtttgagataccttttgaagtatattaaggataactatggcgacccagaagttatcattgccgagaatggatacggagaagaccttggagagaagcacaatgacgtaaactttgggacacaagatcacaacaggaaatattatatccaaaggcatctcttgagtatgcacgacgccatttgcaaggacaaagtgaacgttacgggatactttgtgtggtcgttgatggacaactttgagtggcaagatgggtacaaggcgaggttcggactttactacatcgatttccagaacaacttgacccgtcaccaaaaagtttcgggcaaatggtattccgaattcctcaaaccacagtttccaacctccaagctgagggaagaactctagatgatcaagaatcctatcgggacaaaataattgagtacaagagtcttgaagatgttgttgaggataatatcagtttgtgtgttctatggatcgttttcatctaccggtccttcctatgttagaaggacttgtgagttgttcaagttttaataatatcaataaatgtcttcttttttaatatatgttgagttaat

SEQ ID NO: 5713 - protein, 345 aa, Arabidopsis thaliana
  misc_feature (1)..(345): useful for making plants with modified plant phenotypes as described in USSN 12/139,269
  misc_feature (40)..(344): Pfam Name: Glyco_hydro_1; Pfam Description: Glycosyl hydrolase family 1
  misc_feature (1)..(345): Utility: Useful for delaying flowering time
  misc_feature (1)..(345): Utility: Useful for increasing chlorophyll and photosynthetic capacity
  misc_feature (1)..(345): Utility: Useful for increasing increasing anthocyanin content
  misc_feature (1)..(345): Utility: Useful for making larger plants
  misc_feature (1)..(345): Utility: Useful for making ornamental plants with modified leaves
  misc_feature (1)..(345): Utility: Useful for making plants with altered leaf shape eg curled leaves
  misc_feature (1)..(345): Utility: Useful for making plants with increased biomass and foliage
  misc_feature (1)..(345): Utility: Useful for making smaller plants
MVRFEKVHLVLGLALVLTLVGAPTKAQGPVCGAGLPDKFSRLNFPEGFIWGTATAAFQVEGAVNEGCRGPSMWDTFTKKFPHRCENHNADVAVDFYHRYKEDIQLMKDLNTDAFRLSIAWPRIFPHGRMSKGISKVGVQFYHDLIDELLKNNIIPLVTVFHWDTPQDLEDEYGGFLSGRIVQDFTEYANFTFHEYGHKVKHWITFNEPWVFSRAGYDNGKKAPGRCSPYIPGYGQHCQDGRSGYEAYQVSHNLLLSHAYAVDAFRKCKQCAGGKIGIAHSPAWFEPQDLEHVGGSIERVLDFILGWHLAPTTYGDYPQSMKDRVGHRLPKFTEAEKKLLKGSTDY

SEQ ID NO: 5714 - protein, 501 aa, Arabidopsis thaliana
  misc_feature (1)..(501): useful for making plants with modified plant phenotypes as described in USSN 12/139,269
  misc_feature (1)..(501): Public GI no. 18377977
  misc_feature (1)..(501): Utility: Useful for delaying flowering time
  misc_feature (1)..(501): Utility: Useful for increasing chlorophyll and photosynthetic capacity
  misc_feature (1)..(501): Utility: Useful for increasing increasing anthocyanin content
  misc_feature (1)..(501): Utility: Useful for making larger plants
  misc_feature (1)..(501): Utility: Useful for making ornamental plants with modified leaves
  misc_feature (1)..(501): Utility: Useful for making plants with altered leaf shape eg curled leaves
  misc_feature (1)..(501): Utility: Useful for making plants with increased biomass and foliage
  misc_feature (1)..(501): Utility: Useful for making smaller plants
IHFTRANFPKGFIFGTATAAFQVEGAVNEGCRGPSMWDVYTKKFPHKCNYHNADVAVDFYHRYKEDIKLMKNLNTDGFRFSIAWPRIFPHGRMEKGISKAGVQYYHDLIDELLANGITPLVTVFHWDTPQDLEDEYGGFLSDRIIKDFTEYANFTFQEYGDKVKHWITFNEPWVFSRAGYDIGNKAPGRCSKYIKEHGEMCHDGRSGHEAYIVSHNMLLAHADAVDAFRKCDKCKGGKIGIAHSPAWFEAHELSDEEHETPVTGLIDFILGWHLHPTTYGDYPQSMKDHIGHRLPKFTEAQKEKLKNSADFVGINYYTSVFALHDEEPDPSQPSWQSDSLVDWEPRYVDKFNAFANKPDVAKVEVYAKGLRSLLKYIKDKYGNPEIMITENGYGEDLGEQDTSLVVALSDQHRTYYIQKHLLSLHEAICDDKVNVTGYFHWSLMDNFEWQDGYKARFGLYYVDYKNNLTRHEKLSAQWYSSFLHDGSKEFEIEHEFEHDEL

SEQ ID NO: 5715 - protein, 514 aa, Brassica napus
  misc_feature (1)..(514): useful for making plants with modified plant phenotypes as described in USSN 12/139,269
  misc_feature (1)..(514): Ceres CLONE ID no. 1119202
  misc_feature (1)..(514): Utility: Useful for delaying flowering time
  misc_feature (1)..(514): Utility: Useful for increasing chlorophyll and photosynthetic capacity
  misc_feature (1)..(514): Utility: Useful for increasing increasing anthocyanin content
  misc_feature (1)..(514): Utility: Useful for making larger plants
  misc_feature (1)..(514): Utility: Useful for making ornamental plants with modified leaves
  misc_feature (1)..(514): Utility: Useful for making plants with altered leaf shape eg curled leaves
  misc_feature (1)..(514): Utility: Useful for making plants with increased biomass and foliage
  misc_feature (1)..(514): Utility: Useful for making smaller plants
MKFPLLGLLLLVTLVGSPTRAEEGPVCPKTETLSRASFPEGFMFGTATASYQVEGAVNEGCRGPSLWDIYTKKFPHRVKNHNADVAVDFYHRFREDIKLMKKLNTDALRLSIAWPRIFPHGRMEKGNSKEGVQFYHDLIDELLKNDLTPLVTIFHWDMPADLEDEYGGFLSERVVPDFVEYANFTFHEYGDKVKNWITFNEPWVFSRSAYDVGKKAPGRCSPYIKDFGHLCQDGRSGFEAYVVSHNLLVSHAEAVDAFRKCEKCKGDKIGIAHSPAWFEPEDVEGGQRTVDRVLDFIMGWHLDPTTYGDYPQSMKDAVGARLPKFTKAQKAKLKGSADFVGINYYSSFYAKASEKPDYRQPSWATDSLVEFEPKTVDGSVKIGSQPSTAKMAVYAAGLRKLVKYIKDRYGNPEIIITENGYGEDLGEKDTDHSVALNDHNRKYYHQRHLLSLHQAICEDKVNVTSYFVWSLMDNFEWLDGYTARFGLYYIDFQNNLTRMEKESATCSLNSSNRA

SEQ ID NO: 5716 - protein, 514 aa, Brassica napus; identical to SEQ ID NO: 5715
  misc_feature (1)..(514): useful for making plants with modified plant phenotypes as described in USSN 12/139,269
  misc_feature (1)..(514): Public GI no. 757740
  misc_feature (1)..(514): Utility: Useful for delaying flowering time
  misc_feature (1)..(514): Utility: Useful for increasing chlorophyll and photosynthetic capacity
  misc_feature (1)..(514): Utility: Useful for increasing increasing anthocyanin content
  misc_feature (1)..(514): Utility: Useful for making larger plants
  misc_feature (1)..(514): Utility: Useful for making ornamental plants with modified leaves
  misc_feature (1)..(514): Utility: Useful for making plants with altered leaf shape eg curled leaves
  misc_feature (1)..(514): Utility: Useful for making plants with increased biomass and foliage
  misc_feature (1)..(514): Utility: Useful for making smaller plants

SEQ ID NO: 5717 - protein, 499 aa, Brassica napus
  misc_feature (1)..(499): useful for making plants with modified plant phenotypes as described in USSN 12/139,269
  misc_feature (1)..(499): Public GI no. 50947507
  misc_feature (1)..(499): Utility: Useful for delaying flowering time
  misc_feature (1)..(499): Utility: Useful for increasing chlorophyll and photosynthetic capacity
  misc_feature (1)..(499): Utility: Useful for increasing increasing anthocyanin content
  misc_feature (1)..(499): Utility: Useful for making larger plants
  misc_feature (1)..(499): Utility: Useful for making ornamental plants with modified leaves
  misc_feature (1)..(499): Utility: Useful for making plants with altered leaf shape eg curled leaves
  misc_feature (1)..(499): Utility: Useful for making plants with increased biomass and foliage
  misc_feature (1)..(499): Utility: Useful for making smaller plants
MRWLLLALFLVALVSNGAAVHGAFNRFSFPEDFIFGTGSAAYQYEGAVNEGGRGPSIWDTYAHIPGKVEDGSNGDVAVDFYHRYKEDLNFVTDMNMDAFRFSIAWSRILPNGTISGGINKEGIAFYNSLINEVISRGLKPFVTIFHFDTPQALEDKYRSFLSENIVKDFVDYADVCFREFGDRVKSWNTFNEPMIFCAGGYGSGTKAPGRCSPYVSKKCAPGDSGNEPYVAGHNLLLAHAEAVRLYRQKYQATQKGQIGITQVSHWFVPYSDAAADKHAVRRSLDFMYGWFMDPIVFGDYPGTMRKLVGDRLPKFTAEQSELVKGSYDFIGLNYYTTNYAKSVLRRPSKLKPAYATDNWVNQTAYRNGVPIGPPAFTKIFFTYAPGLRELLLYTKRKYNDPDIYIAENGTDEANNSTIPIAEALKDDNRISFHYQHLRFTQLAIKEGVKVKGYFTWTFMDDFEWGDGYTGRFGLIYVDRETLKRYRKKSSYWFADFLKR

SEQ ID NO: 5718 - protein, 445 aa, Brassica napus
  misc_feature (1)..(445): useful for making plants with modified plant phenotypes as described in USSN 12/139,269
  misc_feature (1)..(445): Public GI no. 51965008
  misc_feature (1)..(445): Utility: Useful for delaying flowering time
  misc_feature (1)..(445): Utility: Useful for increasing chlorophyll and photosynthetic capacity
  misc_feature (1)..(445): Utility: Useful for increasing increasing anthocyanin content
  misc_feature (1)..(445): Utility: Useful for making larger plants
  misc_feature (1)..(445): Utility: Useful for making ornamental plants with modified leaves
  misc_feature (1)..(445): Utility: Useful for making plants with altered leaf shape eg curled leaves
  misc_feature (1)..(445): Utility: Useful for making plants with increased biomass and foliage
  misc_feature (1)..(445): Utility: Useful for making smaller plants
MRWLLLALFLVALVSNGAAVHGAFNRFSFPEDFIFGTGSAAYQYEGAVNEGGRGPSIWDTYAHIPGKVEDGSNGDVAVDFYHRYKEDLNFVTDMNMDAFRFSIAWSRILPNGTISGGINKEGIAFYNSLINEVISRGLKPFVTIFHFDTPQALEDKYRSFLSENIVKDFVDYADVCFREFGDRVKSWNTFNEPMIFCAGGYGSGTKAPGRCSPYVSKKCAPGDSGNEPYVAGHNLLLAHAEAVRLYRQKYQATQKGQIGITQVSHWFVPYSDAAADKHAVRRSLDFMYGWFMDPIVFGDYPGTMRKLVGDRLPKFTAEQSELVKGSYDFIGLNYYTTNYAKSVLRRPSKLKPAYATDNWVNQTAYRNGVPIGPPAFTKIFFTYAPGLRELLLYTKRKYNDPDIYIAENGTDEANNSTIPIAEALKDDNRISFHYQHLRFTQLAIK

SEQ ID NO: 5719 - protein, 531 aa, Brassica napus
  misc_feature (1)..(531): useful for making plants with modified plant phenotypes as described in USSN 12/139,269
  misc_feature (1)..(531): Public GI no. 1155255
  misc_feature (1)..(531): Utility: Useful for delaying flowering time
  misc_feature (1)..(531): Utility: Useful for increasing chlorophyll and photosynthetic capacity
  misc_feature (1)..(531): Utility: Useful for increasing increasing anthocyanin content
  misc_feature (1)..(531): Utility: Useful for making larger plants
  misc_feature (1)..(531): Utility: Useful for making ornamental plants with modified leaves
  misc_feature (1)..(531): Utility: Useful for making plants with altered leaf shape eg curled leaves
  misc_feature (1)..(531): Utility: Useful for making plants with increased biomass and foliage
  misc_feature (1)..(531): Utility: Useful for making smaller plants
LLLLGFALANTNAARTDPPVVCATLNRTNFDTLFPGFTFGTATASYQLEGAANIDGRGPSIWDAFTHNHPEKITDGSNGDVAIDQYHRYKEDVAIMKDMGLDAYRFSISWSRLLPNGTLSGGINKKGIEYYNNLTNELIRNGIEPLVTLFHWDVPQALEEEYGGVLSPRIVYDFKAYAELCYKEFGDRVKHWTTLNEPYTISNHGYTIGIHAPGRCSSWYDPTCLGGDSGTEPYLVTHNLLLAHAAAVKLYREKYQASQEGVIGITVVSHWFEPASESQKDINASVRALDFMYGWFMDPLTRGDYPQSMRSLVKERLPNFTEEQSKSLIGSYDYIGVNYYSARYASAYPEDYSIPTPPSYLTDAYVNVTTELNGVPIGPQAASDWLYVYPKGLYDLVLYTKNKYNDPIMYITENGMDEFNNPKISLEQALNDSNRIDYCYRHLCYLQEAIIEGANVQGYFAWSLLDNFEWSEGYTVRFGINYVDYDNGLKRHSKLSTHWFKNFLKRSSISKEKIRRCGNNNARARKFVYRI

SEQ ID NO: 5720 - protein, 527 aa, Brassica napus
  misc_feature (1)..(527): useful for making plants with modified plant phenotypes as described in USSN 12/139,269
  misc_feature (1)..(527): Public GI no. 28628597
  misc_feature (1)..(527): Utility: Useful for delaying flowering time
  misc_feature (1)..(527): Utility: Useful for increasing chlorophyll and photosynthetic capacity
  misc_feature (1)..(527): Utility: Useful for increasing increasing anthocyanin content
  misc_feature (1)..(527): Utility: Useful for making larger plants
  misc_feature (1)..(527): Utility: Useful for making ornamental plants with modified leaves
  misc_feature (1)..(527): Utility: Useful for making plants with altered leaf shape eg curled leaves
  misc_feature (1)..(527): Utility: Useful for making plants with increased biomass and foliage
  misc_feature (1)..(527): Utility: Useful for making smaller plants
MLVLLISFLALTKPAMADYDGIPADFNRSYFPDDFIFGTATSAYQIEGAANILGRGPSVWDTFTHESPKRIKDQSNGDVAVDFYNRFEEDIKNVKDMGFDAFRFSISWSRVIPSGRRHEGVNEGGIEFYNTVINETIKQGLRPFVTIFHWDTPQALEDKYGGFLSRDIVKDFREYADLLFERFGDRVKHWMTFNEPWALSGFAYDYGVFAPGRCSSWVNRRCRAGNSATEPYIVAHHLLLSHAAVVQIYRENYQTTQNGKIGITLFTFWFEPLSNRTIDIEASRTALDFMFGLWMDPLTYGRYPRTVRDLIGDRLLKFTDEETQMLRGSYDFVGIQYYTSYFAKPNAAIDPNHRRYKTDSQIIETPYDYDGNLIGPQAYSPWFYIFPQGIRHLLNYTKDTYNNPVIYITENGVDNLNNETESIDEALQDEFRVNYYRKHMWNALGSLKEYNVNIKGYFAWSYLDNFEWNIGYTSRFGLFYVDYKKNLTRIPKSSAFWFAAFLNPESSKKITQTTSRNSRKVGKFYIM

SEQ ID NO: 5721 - protein, 507 aa, Brassica napus
  misc_feature (1)..(507): useful for making plants with modified plant phenotypes as described in USSN 12/139,269
  misc_feature (1)..(507): Public GI no. 32400332
  misc_feature (1)..(507): Utility: Useful for delaying flowering time
  misc_feature (1)..(507): Utility: Useful for increasing chlorophyll and photosynthetic capacity
  misc_feature (1)..(507): Utility: Useful for increasing increasing anthocyanin content
  misc_feature (1)..(507): Utility: Useful for making larger plants
  misc_feature (1)..(507): Utility: Useful for making ornamental plants with modified leaves
  misc_feature (1)..(507): Utility: Useful for making plants with altered leaf shape eg curled leaves
  misc_feature (1)..(507): Utility: Useful for making plants with increased biomass and foliage
  misc_feature (1)..(507): Utility: Useful for making smaller plants
MMAAKGSVVVGVLAIVAYALVVSEVAIAAQISSFNRTSFPDGFVFGAASSAYQFEGAAKEGGKGPNIWDTFTHEFPGKISNGSTGDVADDFYHRYKEDVKVLKFIGLDGFRMSISWARVLPRGKLSGGVNKEGIAFYNNVINDLLSKGIQPFITIFHWDLPQALEDEYGGFLSPHIVNDFRDFAELCFKEFGDRVKHWITMNEPWSYSYGGYDAGLLAPGRCSAFMAFCPKGNSGTEPYIVTHNLLLSHAAAVKLYKEKYQAYQKGQIGITLVTYWMIPYSNSKADKDAAQRALDFMYGWFIEPLSFGEYPKSMRRLVGKRLPRFTKEQAMLVKGSFDFLGLNYYIANYVLNVPTSNSVNLSYTTDSLSNQTAFRNGVAIGRPTGVPAFFMYPKGLKDLLVYTKEKYNDPVIYITENGMGDNNNVTTEEGIKDPQRVYFYNQHLLSLKNAIAAGVKVKGYFTWAFLDNFEWLSGYTQRFGIVYVDFKDGLKRYPKHSALWFKKFLLK

SEQ ID NO: 5722 - DNA, 1395 bp, Arabidopsis thaliana
  misc_feature (1)..(1395): useful for making plants with modified plant phenotypes as described in USSN 12/139,269
  misc_feature (1)..(1395): Ceres CLONE ID no. 36518
  misc_feature (1)..(1395): Also known as  Ceres CDNA ID no. 23471732
aaatcgtccccgtctcgtttccttcttcgctcgctgttcagattttgctttgaggctttaggctccccagatctctaatcgccgcagctttaagaaatggagactttcctattcacatctgagtctgtgaacgaaggacaccctgacaagctttgcgaccagatctctgatgcagtccttgatgcctgccttgagcaagaccctgatagcaaagttgcttgtgagacatgcaccaagaccaacatggtcatggttttcggtgagatcaccaccaaggctacgattgactacgagaagattgtccgtgacacttgccgttccattggattcatctctgacgatgttggtcttgatgcacaaatgcaaagtccttgttaacattgaacaacagagcccagacattgctcaaggtgttcacggtcacttcaccaaacgtccagaagacattggagctggtgaccaaggacacatgtttggttatgccactgatgaaacccctgagctcatgcctttgagtcatgtccttgcaaccaagattggtgctcgtctcactgaagtcaggaagaatggaacttgccgttggttaagaccagatggcaagacccaagtcactgttgagtactacaatgacaatggcgctatggttccagtccgtgtccacaccgtcctgatctcaacccagcacgatgaaaccgttaccaacgacgagattgcgcgtgacctcaaggagcatgtgatcaaaccaatcatcccagagaaataccttgacgacaaaaccatcttccacctcaacccatcaggccggtttgtgatcgggggaccacacggtgatgctggtttaactggacgtaagatcatcattgacacatacggaggatggggagctcatggaggtggtgctttctcaggcaaagacccaaccaaagtcgacagaagtggagcttacatcgtgaggcaagcagcaaagagtgtggtggctaatggcatggctcgcagggctcttgtccaggtctcatacgccattggagtacccgagccattgtctgtcttcgttgacacttacggaacagggttgattccagacaaggagatcctgaagatcgtgaaagagacattcgatttcagaccaggaatgatgacaatcaacttggacttgaagagaggaggaaatggaaggtttcagaaaacggcagcgtatggacatttcggaagagacgaccctgacttcacctgggaggtcgtgaagccactcaagtgggacaaacctcaagcttaaacttgattttatgtttcttctgtctttttactttaaacatctaccatggaccaataatcaaatccctctgtttcttttttcttgtattattgatatgaaagtttctggtttgtttaacc

SEQ ID NO: 5723 - protein, 368 aa, Arabidopsis thaliana
  misc_feature (1)..(368): useful for making plants with modified plant phenotypes as described in USSN 12/139,269
  misc_feature (62)..(77): Pfam Name: S-AdoMet_synt_N; Pfam Description: S-adenosylmethionine synthetase, N-terminal domain
  misc_feature (91)..(213): Pfam Name: S-AdoMet_synt_M; Pfam Description: S-adenosylmethionine synthetase, central domain
  misc_feature (215)..(357): Pfam Name: S-AdoMet_synt_C; Pfam Description: S-adenosylmethionine synthetase, C-terminal domain
  misc_feature (62)..(77): Pfam Name: S-AdoMet_synt_N; Pfam Description: S-adenosylmethionine synthetase, N-terminal domain
  misc_feature (91)..(213): Pfam Name: S-AdoMet_synt_M; Pfam Description: S-adenosylmethionine synthetase, central domain
  misc_feature (215)..(357): Pfam Name: S-AdoMet_synt_C; Pfam Description: S-adenosylmethionine synthetase, C-terminal domain
  misc_feature (1)..(368): Utility: Useful for delaying flowering time
  misc_feature (1)..(368): Utility: Useful for making larger plants
  misc_feature (1)..(368): Utility: Useful for making plants with increased biomass and foliage
  misc_feature (1)..(368): Utility: Useful for making smaller plants
  misc_feature (294)..(294): Xaa is any aa, unknown or other
MQSLMPALSKTLIAKLLVRHAPRPTWSWFSVRSPPRLRLTTRRLSVTLAVPLDSSLTMLVLMHKCKVLVNIEQQSPDIAQGVHGHFTKRPEDIGAGDQGHMFGYATDETPELMPLSHVLATKIGARLTEVRKNGTCRWLRPDGKTQVTVEYYNDNGAMVPVRVHTVLISTQHDETVTNDEIARDLKEHVIKPIIPEKYLDDKTIFHLNPSGRFVIGGPHGDAGLTGRKIIIDTYGGWGAHGGGAFSGKDPTKVDRSGAYIVRQAAKSVVANGMARRALVQVSYAIGVPEPLSVXVDTYGTGLIPDKEILKIVKETFDFRPGMMTINLDLKRGGNGRFQKTAAYGHFGRDDPDFTWEVVKPLKWDKPQA

SEQ ID NO: 5724 - protein, 344 aa, Arabidopsis thaliana
  misc_feature (1)..(344): useful for making plants with modified plant phenotypes as described in USSN 12/139,269
  misc_feature (1)..(344): Ceres CLONE ID no. 37800
  misc_feature (1)..(344): Utility: Useful for delaying flowering time
  misc_feature (1)..(344): Utility: Useful for making larger plants
  misc_feature (1)..(344): Utility: Useful for making plants with increased biomass and foliage
  misc_feature (1)..(344): Utility: Useful for making smaller plants
MVMVFGEITTKATVDYEKIVRDTCRAIGFVSDDVGLDADKCKVLVNIEQQSPDIAQGVHGHFTKCPEEIGAGDQGHMFGYATDETPELMPLSHVLATKLGARLTEVRKNGTCAWLRPDGKTQVTVEYYNDKGAMVPIRVHTVLISTQHDETVTNDEIARDLKEHVIKPVIPEKYLDEKTIFHLNPSGRFVIGGPHGDAGLTGRKIIIDTYGGWGAHGGGAFSGKDPTKVDRSGAYIVRQAAKSVVANGMARRALVQVSYAIGVPEPLSVFVDTYETGLIPDKEILKIVKESFDFRPGMMTINLDLKRGGNGRFLKTAAYGHFGRDDPDFTWEVVKPLKWDKPQA

SEQ ID NO: 5725 - protein, 341 aa, Glycine max
  misc_feature (1)..(341): useful for making plants with modified plant phenotypes as described in USSN 12/139,269
  misc_feature (1)..(341): Ceres CLONE ID no. 564011
  misc_feature (1)..(341): Utility: Useful for delaying flowering time
  misc_feature (1)..(341): Utility: Useful for making larger plants
  misc_feature (1)..(341): Utility: Useful for making plants with increased biomass and foliage
  misc_feature (1)..(341): Utility: Useful for making smaller plants
MVFGEITTKANVDYEKIVRDTCRNIGFVSNDVGLDADNCKVLVNIEQQSPDIAQGVHGHLTKKPEEIGAGDQGHMFGYATDETPELMPLSHVLATKLGARLTEVRKNGTCPWLRPDGKTQVTVEYYNDNGAMVPVRVHTVLISTQHDETVSNDQIAADLKEHVIKPVIPEKYLDEKTIFHLNPSGRFVIGGPHGDAGLTGRKIIIDTYGGWGAHGGGAFSGKDPTKVDRSGAYIVRQAAKSVVANGLARRCIVQVSYAIGVPEPLSVFVDTYGTGKIPDKEILQIVKENFDFRPGMITINLDLKRGGHRFLKTAAYGHFGRDDPDFTWEVVKPLKSEKPQA

SEQ ID NO: 5726 - protein, 341 aa, Zea mays
  misc_feature (1)..(341): useful for making plants with modified plant phenotypes as described in USSN 12/139,269
  misc_feature (1)..(341): Ceres CLONE ID no. 225429
  misc_feature (1)..(341): Utility: Useful for delaying flowering time
  misc_feature (1)..(341): Utility: Useful for making larger plants
  misc_feature (1)..(341): Utility: Useful for making plants with increased biomass and foliage
  misc_feature (1)..(341): Utility: Useful for making smaller plants
MVMVFGEITTKASVDYEKIVRDTCREIGFTSDDVGLDADRCKVLVNIEQQSPDIAQGVHGHFTKRPEEIGAGDQGHMFGYATDETPELMPLSHVLATKLGARLTEVRKDGTCAWLRPDSKTQVTVEYVNEGGAMVPVRVHTVLISTQHDETVTNDEIAADLKEHVIKPVIPERYLDEKTIFHLNPSGRFVIGGPHGDAGLTGRKIIIDTYGGWGAHGGGAFSGKDPTKVDRSGAYVARQAAKSIVASGLARRCLVQVSYAIGVPEPLSVFVDSYGTGTIPDKEILKIVKENFDFRPGMVTINLDLKKGGNRFIKTAAYGHFGRDDADFTWEVVKPLKKASA

SEQ ID NO: 5727 - protein, 396 aa, Zea mays
  misc_feature (1)..(396): useful for making plants with modified plant phenotypes as described in USSN 12/139,269
  misc_feature (1)..(396): Ceres CLONE ID no. 450648
  misc_feature (1)..(396): Utility: Useful for delaying flowering time
  misc_feature (1)..(396): Utility: Useful for making larger plants
  misc_feature (1)..(396): Utility: Useful for making plants with increased biomass and foliage
  misc_feature (1)..(396): Utility: Useful for making smaller plants
MAAVDTFLFTSESVNEGHPDKLCDQVSDAVLDACLAEDPDSKVACETCTKTNMVMVFGEITTKANVDYEKIVRETCRNIGFVSNDVGLDADHCKVLVNIEQQSPDIAQGVHGHFTKRPEEIGAGDQGHMFGYATDETPELMPLSHVLATKLGARLTEVRKNGTCPWLRPDGKTQVTVEYRNEGGAMVPIRVHTVLISTQHDETVTNDEIAADLKEHVIKPVIPEQYLDEKTIFHLNPSGRFVIGGPHGDAGLTGRKIIIDTYGGWGAHGGGAFSGKDPTKVDRSGAYVARQAAKSIVASGLARRAIVQVSYAIGVPEPLSVFVDTYGTGAIPDKEILKIVKENFDFRPGMIIINLDLKKGGNGRYLKTAAYGHFGRDDPDFTWEVVKPLKSEKPSA

SEQ ID NO: 5728 - protein, 344 aa, Arabidopsis thaliana
  misc_feature (1)..(344): useful for making plants with modified plant phenotypes as described in USSN 12/139,269
  misc_feature (1)..(344): Ceres CLONE ID no. 326
  misc_feature (1)..(344): Utility: Useful for delaying flowering time
  misc_feature (1)..(344): Utility: Useful for making larger plants
  misc_feature (1)..(344): Utility: Useful for making plants with increased biomass and foliage
  misc_feature (1)..(344): Utility: Useful for making smaller plants
MVMVFGEITTKANVDYEQIVRKTCREIGFVSADVGLDADNCKVLVNIEQQSPDIAQGVHGHLTKKPEEVGAGDQGHMFGYATDETPELMPLTHVLATKLGAKLTEVRKNGTCPWLRPDGKTQVTIEYINESGAMVPVRVHTVLISTQHDETVTNDEIAADLKEHVIKPVIPEKYLDEKTIFHLNPSGRFVIGGPHGDAGLTGRKIIIDTYGGWGAHGGGAFSGKDPTKVDRSGAYIVRQAAKSIVASGLARRVIVQVSYAIGVPEPLSVFVDSYGTGKIPDKEILEIVKESFDFRPGMISINLDLKRGGNGRFLKTAAYGHFGRDDADFTWEVVKPLKSNKVQA

SEQ ID NO: 5729 - DNA, 1636 bp, Arabidopsis thaliana
  misc_feature (1)..(1636): useful for making plants with modified plant phenotypes as described in USSN 12/139,269
  misc_feature (1)..(1636): Ceres CLONE ID no. 36891
  misc_feature (1)..(1636): Also known as  Ceres CDNA ID no. 23363031
atatacccctcaatcataaacaataaacagagggagtcgccaaattttctcatcattttctcgagaaaatagactaaaagcgattcccgagagaaagaaagaacaaaaaaaaaacatccgagtgaaaatgagagaaattcttcatattcaaggaggtcagtgcggaaaccagatcggagctaagttctgggaagttatttgcggcgagcacggtattgatcaaaccggtcagtcatgtggcgatacagatctacagcttgaaaggatcaatgtctattttaacgaagctagcggaggcaaatacgttcctcgtgctgttcttatggatctggagcctggaactatggattctctcagatctgggccgtttggtcagattttccggcctgataacttcgtttttggtcagtctggtgctgggaataactgggcgaaaggtcattacacggagggagctgagttgattgattctgtgcttgatgttgtgaggaaggaagctgagaactgtgattgtcttcaaggttttcaagtttgtcattctttgggaggaggaactggttctggcatgggaacacttcttatttctaagattagagaggaatatccagatcgtatgatgatgaccttttcggttttcccatctcctaaggtctctgatacagttgttgagccatacaatgctactctttccgttcaccagctcgttgagaatgctgatgaatgtatggttttggataacgaagctctttacgatatctgtttccgtaccttgaagcttgctaatcctacatttggtgaccttaaccatctcatctcagctacaatgagtggtgttacatgctgtcttcggttccctggtcaactaaactctgaccttagaaaacttgcagtgaaccttattcctttcccacgactccacttcttcatggttggttttgcacctttgacatcaagaggatctcaacaatacagtgccttgagtgtccctgagctaactcaacagatgtgggatgccaaaaacatgatgtgtgcagctgatcctcgtcatggtcgttacttgacagcttctgctgtcttccgtggaaagatgagtaccaaagaggttgatgaacagatgatgaacgtccagaacaaaaactcctcatactttgttgaatggattccaaataacgtgaaatcaagcgtctgcgatatagctcccactggtttgaaaatggcatcaactttcattggaaactcaacttcaatccaggaaatgttcaggcgtgtgagtgaacagttcactgccatgttcaggagaaaggctttccttcattggtacacaggagaaggaatggacgagatggagttcactgaagcagagagtaacatgaatgatcttgttgcagagtatcagcaatatcaagatgctacagtcggtgaagaggagtacgaggaggacgaagaagaagaagaagcctaaagaaaagatgattgattattacttttgtaaggctgtaagttcgtcgcactcatttccttttacctctttttctgaattgggattctctctttttgtgctttgtgtgttttgttattgaatttctttcccaaacctaagatttgttccagagtgtaatcacatttgcctatgctc

SEQ ID NO: 5730 - protein, 444 aa, Arabidopsis thaliana
  misc_feature (1)..(444): useful for making plants with modified plant phenotypes as described in USSN 12/139,269
  misc_feature (45)..(244): Pfam Name: Tubulin; Pfam Description: Tubulin/FtsZ family, GTPase domain
  misc_feature (246)..(383): Pfam Name: Tubulin_C; Pfam Description: Tubulin/FtsZ family, C-terminal domain
  misc_feature (45)..(244): Pfam Name: Tubulin; Pfam Description: Tubulin/FtsZ family, GTPase domain
  misc_feature (246)..(383): Pfam Name: Tubulin_C; Pfam Description: Tubulin/FtsZ family, C-terminal domain
  misc_feature (1)..(444): Utility: Useful for delaying flowering time
MREILHIQGGQCGNQIGAKFWEVICGEHGIDQTGQSCGDTDLQLERINVYFNEASGGKYVPRAVLMDLEPGTMDSLRSGPFGQIFRPDNFVFGQSGAGNNWAKGHYTEGAELIDSVLDVVRKEAENCDCLQGFQVCHSLGGGTGSGMGTLLISKIREEYPDRMMMTFSVFPSPKVSDTVVEPYNATLSVHQLVENADECMVLDNEALYDICFRTLKLANPTFGDLNHLISATMSGVTCCLRFPGQLNSDLRKLAVNLIPFPRLHFFMVGFAPLTSRGSQQYSALSVPELTQQMWDAKNMMCAADPRHGRYLTASAVFRGKMSTKEVDEQMMNVQNKNSSYFVEWIPNNVKSSVCDIAPTGLKMASTFIGNSTSIQEMFRRVSEQFTAMFRRKAFLHWYTGEGMDEMEFTEAESNMNDLVAEYQQYQDATVGEEEYEEDEEEEEA

SEQ ID NO: 5731 - protein, 445 aa, Triticum aestivum
  misc_feature (1)..(445): useful for making plants with modified plant phenotypes as described in USSN 12/139,269
  misc_feature (1)..(445): Ceres CLONE ID no. 861902
  misc_feature (1)..(445): Utility: Useful for delaying flowering time
MREILHIQGGQCGNQIGAKFWEVICDEHGIDQTGKYAGDSDLQLERINVYYNEASGGRFVPRAVLMDLEPGTMDSLRSGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPTGLSMSSTFVGNSTSIQEMFRRVSEQFTAMFRRKAFLHWYTGEGMDEMEFTEAESNMNDLVAEYQQYQDATADEEEEYDEEEEEEAA

SEQ ID NO: 5732 - protein, 442 aa, Glycine max
  misc_feature (1)..(442): useful for making plants with modified plant phenotypes as described in USSN 12/139,269
  misc_feature (1)..(442): Ceres CLONE ID no. 471579
  misc_feature (1)..(442): Utility: Useful for delaying flowering time
MREILHIQGGQCGNQIGAKFWEVICDEHGIDHTGKYSGDSELQLERINVYYNEASGGRYVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRNLTVPELTQQMWDSKNMMCAADPRHGRYLTASAMFRGKMSTKEVDEQMINVQNKNSSYFVEWIPNNVKSSVCDIPPKGLKMSSTFIGNSTSIQEMFRRVSEQFTAMFRRKAFLHWYTGEGMDEMEFTEAESNMNDLVAEYQQYQDATADEEEYEDEEEEA

SEQ ID NO: 5733 - protein, 445 aa, Zea mays
  misc_feature (1)..(445): useful for making plants with modified plant phenotypes as described in USSN 12/139,269
  misc_feature (1)..(445): Ceres CLONE ID no. 422618
  misc_feature (1)..(445): Utility: Useful for delaying flowering time
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPIGLKMSSTFVGNSTSIQEMFRRVSEQFTAMFRRKAFLHWYTGEGMDEMEFTEAESNMNDLVAEYQQYQDATAEDEEYEEEEEEEEET

SEQ ID NO: 5734 - protein, 444 aa, Triticum aestivum
  misc_feature (1)..(444): useful for making plants with modified plant phenotypes as described in USSN 12/139,269
  misc_feature (1)..(444): Ceres CLONE ID no. 686137
  misc_feature (1)..(444): Utility: Useful for delaying flowering time
MREILHIQGGQCGNQIGAKFWEVICDEHGIDGTGRYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPSFGDLNHLISATMSGVTCCLRFPGQLNSDLRKLAVNLIPFPRLHFFMVGFAPLTSRGSQMYRALTVPELTQQMWDAKNMMCAADPRHGRYLTASACFRGKMSTKEVDEQMLNVQNKNSSYFVEWIPNNVKSSVCDMPPRGLKMAGTFVGNSTSIQEMFRRVSEQFTAMFRRKAFLHWYTGEGMDEMEFTEAESNMNDLVAEYQQYQDATAEEEYDEEEEEERDA

SEQ ID NO: 5735 - protein, 445 aa, Triticum aestivum
  misc_feature (1)..(445): useful for making plants with modified plant phenotypes as described in USSN 12/139,269
  misc_feature (1)..(445): Ceres CLONE ID no. 1315179
  misc_feature (1)..(445): Utility: Useful for delaying flowering time
MREILHIQGGQCGNQIGAKFWEVICDEHGIDGTGRYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPSFGELNHLISATMSGVTCCLRFPGQLNSDLRKLAVNLIPFPRLHFFMVGFAPLTSRGSQMYRALTVPELTQQMWDAKNMMCAADPRHGRYLTASACFRGKMSTKEVDEQMLNVQNKNSSYFVEWIPNNVKSSVCDMPPRGLKMAGTFVGNSTSIQEMFRRVSEQFTAMFRRKAFLHWYTGEGMDEMEFTEAESNMNDLVAEYQQYQDATADEEYDEEEEEERDAE

SEQ ID NO: 5736 - protein, 447 aa, Triticum aestivum
  misc_feature (1)..(447): useful for making plants with modified plant phenotypes as described in USSN 12/139,269
  misc_feature (1)..(447): Ceres CLONE ID no. 725504
  misc_feature (1)..(447): Utility: Useful for delaying flowering time
MREILHIQGGQCGNQIGAKFWEVVCDEHGIDPTGRYTGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPTGLSMASTFVGNSTSIQEMFRRVSEQFTSMFRRKAFLHWYTGEGMDEMEFTEAESNMNDLVSEYQQYQDATSDEEGEYEDEDQEPEEDM

SEQ ID NO: 5737 - protein, 445 aa, Zea mays
  misc_feature (1)..(445): useful for making plants with modified plant phenotypes as described in USSN 12/139,269
  misc_feature (1)..(445): Ceres CLONE ID no. 705622
  misc_feature (1)..(445): Utility: Useful for delaying flowering time
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEAEYEDEEAIQDE

SEQ ID NO: 5738 - protein, 445 aa, Triticum aestivum
  misc_feature (1)..(445): useful for making plants with modified plant phenotypes as described in USSN 12/139,269
  misc_feature (1)..(445): Ceres CLONE ID no. 726433
  misc_feature (1)..(445): Utility: Useful for delaying flowering time
MREILHIQGGQCGNQIGAKFWEVICGEHGVDPTGQYTGSAPEQLERMDVYFNEAGGNRYVPRAVLMDLEPGTMDSLRSGPIGAIFRPDNFVYGQSGAGNNWAKGHYTEGAELIDSVLDVVRKEAENSDCLQGFQVCHSLGGGTGSGMDTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMMNVQNKNSSYFVEWIPNNVKSSVCDIPPVGLAMSSTFVGNSTSIQEMFRRVSEQFTAMFRRKAFLHWYTSEGMDEMEFTEAESNMNDLVAEYQQYQDATAEEDYEEEEEPAADQP

SEQ ID NO: 5739 - protein, 447 aa, Arabidopsis thaliana
  misc_feature (1)..(447): useful for making plants with modified plant phenotypes as described in USSN 12/139,269
  misc_feature (1)..(447): Ceres CLONE ID no. 256068
  misc_feature (1)..(447): Utility: Useful for delaying flowering time
MREILHVQGGQCGNQIGSKFWEVICDEHGVDPTGRYNGDSADLQLERINVYYNEASGGRYVPRAVLMDLEPGTMDSIRSGPYGQIFRPDNFVFGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPSFGDLNHLISATMSGVTCSLRFPGQLNSDLRKLAVNLIPFPRLHFFMVGFAPLTSRGSQQYISLTVPELTQQMWDAKNMMCAADPRHGRYLTASAMFRGKMSTKEVDEQILNVQNKNSSYFVEWIPNNVKSSVCDIPPTGIKMASTFVGNSTSIQEMFRRVSEQFTAMFRRKAFLHWYTGEGMDEMEFTEAESNMNDLVSEYQQYQDATADEEDEYDEEEEQVYES

SEQ ID NO: 5740 - protein, 445 aa, Zea mays
  misc_feature (1)..(445): useful for making plants with modified plant phenotypes as described in USSN 12/139,269
  misc_feature (1)..(445): Ceres CLONE ID no. 264576
  misc_feature (1)..(445): Utility: Useful for delaying flowering time
MREILHIQGGQCGNQIGAKFWEVICGEHGVDSTGCYSGVSPQQLERINVYYNEAGGGRYVPRAVLMDLEPGTMESIRAGPFGGIFRPDNFVYGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPVGLSMSSTFVGNSTSIQEMFRRVSEQFTAMFRRKAFLHWYTSEGMDEMEFTEAESNMNDLVAEYQQYQDATAEEYDEEEQDGEEEHA

SEQ ID NO: 5741 - protein, 447 aa, Zea mays
  misc_feature (1)..(447): useful for making plants with modified plant phenotypes as described in USSN 12/139,269
  misc_feature (1)..(447): Ceres CLONE ID no. 1412402
  misc_feature (1)..(447): Utility: Useful for delaying flowering time
MREILHIQGGQCGNQIGAKFWEVICGEHCVDSTGRYSGTSSQQLELERINVYYNEAGGGRYVPRAVLMDLEPGTMESIRAGPFGGIFRPDNFVYGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTNPSFGDLNHLISATMSGVTCCLRFPGQLNSDLRKLAVNLIPFPRLHFFMVGFAPLTSRGSQQYRALTVPELTQQMWDAKNMMCSADPRHGRYLTASAMFRGKMSTKEVDEQMINVQNKNSSYFVEWIPNNVKSSVCDIPPVGLPMASTFVGNSTSIQEMFRRVSEQFTAMFRRKAFLHWYTSEGMDEMEFTEAESNMNDLVAEYQQYQDATAEEYEEEEHDGEEEHA

SEQ ID NO: 5742 - protein, 445 aa, Triticum aestivum
  misc_feature (1)..(445): useful for making plants with modified plant phenotypes as described in USSN 12/139,269
  misc_feature (1)..(445): Ceres CLONE ID no. 914491
  misc_feature (1)..(445): Utility: Useful for delaying flowering time
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQMYRPLTVPELTQQMWDSKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEGEYEEEEELEQE

SEQ ID NO: 5743 - protein, 447 aa, Triticum aestivum
  misc_feature (1)..(447): useful for making plants with modified plant phenotypes as described in USSN 12/139,269
  misc_feature (1)..(447): Ceres CLONE ID no. 773962
  misc_feature (1)..(447): Utility: Useful for delaying flowering time
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQMYRSLTVPELTQQMWDSKNMMCAADPRHGRYLTASAMFRGKMSTKEVDEQMINVQNKNSSYFVEWIPNNVKSSVCDIAPRGLSMASTFIGNSTSIQEMFRRVSEQFTAMFRRKAFLHWYTGEGMDEMEFTEAESNMNDLVAEYQQYQDATADEEEELYEDEDDADLQE

SEQ ID NO: 5744 - DNA, 1511 bp, Arabidopsis thaliana
  misc_feature (1)..(1511): useful for making plants with modified plant phenotypes as described in USSN 12/139,269
  misc_feature (1)..(1511): Ceres CLONE ID no. 36904
  misc_feature (1)..(1511): Also known as  Ceres CDNA ID no. 23376069
ataaagtaggaaaaaattagggttagactcgatcattcatagctgcgactattctctgctctttctacattttctcattttctcttgggctacttttcgactactaacaaatccaacgatgaggggattggtgaacaagctcgtgtccagatctctctccatctccgggaaatggcagaaccaacagcttcgtcgtctcaacatccacgagtatcagggagctgaattgatggggaaatatggagttaatgtgccgaaaggagtagctgcttcttcgttggaagaagttaaaaaggctattcaagatgttttccctaatgaaagcgagttggttgttaagagccagattttggctggtggaagaggtcttggaacattcaagagtggtcttaagggtggtgttcacattgttaaacgtgatgaggctgaagagattgctggaaagatgctaggacaagtacttgtcaccaagcaaactggtcctcaaggcaaagtagttagcaaggtttacttgtgtgagaaattgtcactcgtcaatgagatgtacttttccattattctggaccgtaaatctgctggaccgttgatcattgcctgtaaaaagggtggtaccagtattgaagatcttgctgagaagttccctgacatgatcatcaaggtaccaattgatgtatttgcaggaatcactgatgaagatgctgctaaggttgtggatggtctggctcccaaagctgctgacagaaaagattcgattgaacaagtgaagaagctatacgaactcttccgcaagactgactgcacaatgttggaaatcaatccccttgcggagacatcaactaatcaattggtagctgctgatgccaaattgaacttcgatgataatgctgcgttccgacaaaaagaggttttcgccatgcgtgatccaacacaggaggatccacgagaggtggctgctgctaaagttgacctgaactacatcggtttagatggagagattggttgcatggtgaatggtgctggattggccatggcaaccatggacatcattaaattacacggtggaacacccgccaatttccttgacgttggtggaaatgcttctgagcaccaggtggtggaagcgtttaagatactgacatcggacgataaagtgaaagcaatcttggtgaacatatttggtgggataatgaaatgtgatgtgattgctagtggaatcgtgaacgctgcaaaagaggtcgcattgaaagtgccagtggtggttagtctagaaggaacgaatgttgagcagggaaagagaatcctcaaggaaagtggaatgaaactcataacagctgatgatttggatgatgcagctgagaaagcggttaaagctttagctcactaatctctctatatataccaaaagccggtttgttaattgttttgtggttgacgcccaatttacactttcttgcggatatcatttcctcaaacagatcaataatgaactggtctcctttttttgtgtgatc

SEQ ID NO: 5745 - protein, 421 aa, Arabidopsis thaliana
  misc_feature (1)..(421): useful for making plants with modified plant phenotypes as described in USSN 12/139,269
  misc_feature (69)..(232): Pfam Name: ATP-grasp; Pfam Description: ATP-grasp domain
  misc_feature (280)..(416): Pfam Name: Ligase_CoA; Pfam Description: CoA-ligase
  misc_feature (69)..(232): Pfam Name: ATP-grasp; Pfam Description: ATP-grasp domain
  misc_feature (280)..(416): Pfam Name: Ligase_CoA; Pfam Description: CoA-ligase
  misc_feature (1)..(421): Utility: Useful for delaying flowering time
  misc_feature (1)..(421): Utility: Useful for increasing chlorophyll and photosynthetic capacity
  misc_feature (1)..(421): Utility: Useful for making plants with increased biomass and foliage
  misc_feature (1)..(421): Utility: Useful for making smaller plants
MRGLVNKLVSRSLSISGKWQNQQLRRLNIHEYQGAELMGKYGVNVPKGVAASSLEEVKKAIQDVFPNESELVVKSQILAGGRGLGTFKSGLKGGVHIVKRDEAEEIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKTDCTMLEINPLAETSTNQLVAADAKLNFDDNAAFRQKEVFAMRDPTQEDPREVAAAKVDLNYIGLDGEIGCMVNGAGLAMATMDIIKLHGGTPANFLDVGGNASEHQVVEAFKILTSDDKVKAILVNIFGGIMKCDVIASGIVNAAKEVALKVPVVVSLEGTNVEQGKRILKESGMKLITADDLDDAAEKAVKALAH

SEQ ID NO: 5746 - protein, 417 aa, Arabidopsis thaliana
  misc_feature (1)..(417): useful for making plants with modified plant phenotypes as described in USSN 12/139,269
  misc_feature (1)..(417): Public GI no. 27803873
  misc_feature (1)..(417): Utility: Useful for delaying flowering time
  misc_feature (1)..(417): Utility: Useful for increasing chlorophyll and photosynthetic capacity
  misc_feature (1)..(417): Utility: Useful for making plants with increased biomass and foliage
  misc_feature (1)..(417): Utility: Useful for making smaller plants
MLRKLANQSLSVAGKWQQQQLRRLNIHEYQGAELMSKYGINVPKGVAVASLDEVKKAIQDVFPNQSEVVVKSQVLAGGRGLGTFKNGFQGGVHIVKADQAEDIASKMLGQILVTKQTGAQGKVVSKVYLCEKMSLVNEMYFSIILDRATAGPLIIACRKGGTSIEDLAEKFPDMIIKVPIDVFKGISDADAAKVVDGLAPKVADRNDSIEQVKKLYKLFCETDCTMLEINPLAETSDNKLVAADAKLNFDDNAAYRQKEIFSLRDSSQEDPREVAAAKADLNYIGLDGEIGCMVNGAGLAMATMDIIKLHGGTPANFLDVGGNATEGQVVEAFKILTADEKVKAILVNIFGGIMKCDVIASGIVNAAKQVQLKVPVIVRLEGTNVEQGKRILKESGMKLITAEDLDDAAEKAVKALA

SEQ ID NO: 5747 - protein, 384 aa, Glycine max
  misc_feature (1)..(384): useful for making plants with modified plant phenotypes as described in USSN 12/139,269
  misc_feature (1)..(384): Ceres CLONE ID no. 476815
  misc_feature (1)..(384): Utility: Useful for delaying flowering time
  misc_feature (1)..(384): Utility: Useful for increasing chlorophyll and photosynthetic capacity
  misc_feature (1)..(384): Utility: Useful for making plants with increased biomass and foliage
  misc_feature (1)..(384): Utility: Useful for making smaller plants
MSKHGVNVPRGVAVSSVEEARKVIKDLFPNENELVVKSQILAGGRGLGTFKSGLKGGVHIVKTDQVEDIAGKMLGQILVTKQTGPQGKIVSKVYLCEKLSLVNEMYFAITLDRTSAGPIIIACSKGGTSIEDLAEKFPDMIIKVPVDVFEGITDEGAAKVVDGLALKVADRNKSIEQVKNLYKLFVDCDCTLLEINPIAETADNQLVAADAKLNFDDNAAYRQKEIFSLRDTTQEDPREVTAAKADLNYIGLDGEIGCMVNGAGLAMATMDIIKLHGGTPANFLDVGGNASENQVVEAFKILTADDKVKAILVNIFGGIMKCDVIASGIVNAAKEVALKVPVVVRLEGTNVDQGKRILKESGMALITAEDLDDAAQKAVKAAYK

SEQ ID NO: 5748 - protein, 384 aa, Zea mays
  misc_feature (1)..(384): useful for making plants with modified plant phenotypes as described in USSN 12/139,269
  misc_feature (1)..(384): Ceres CLONE ID no. 336060
  misc_feature (1)..(384): Utility: Useful for delaying flowering time
  misc_feature (1)..(384): Utility: Useful for increasing chlorophyll and photosynthetic capacity
  misc_feature (1)..(384): Utility: Useful for making plants with increased biomass and foliage
  misc_feature (1)..(384): Utility: Useful for making smaller plants
MGKYGINVPRGAAAGSVHEVKDALKNMFPSEKEIVVKSQILAGGRGLGTFKSGLQGGVHIVKAEEAELIASKMLGQILITKQTGPEGKIVSKVYLCEKLSLTNEMYFAITLDRKTAGPLIIACSKGGTSIEDLAEKYPDMIIKVPIDVFKGITDEDAAKVVDGLALKAADRQSSIEQIKKLYELFCKCDCTLLEINPLAETADNKLVAADAKLNFDDNAAFRQKEIFALRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 5749 - protein, 422 aa, Zea mays
  misc_feature (1)..(422): useful for making plants with modified plant phenotypes as described in USSN 12/139,269
  misc_feature (1)..(422): Public GI no. 50910635
  misc_feature (1)..(422): Utility: Useful for delaying flowering time
  misc_feature (1)..(422): Utility: Useful for increasing chlorophyll and photosynthetic capacity
  misc_feature (1)..(422): Utility: Useful for making plants with increased biomass and foliage
  misc_feature (1)..(422): Utility: Useful for making smaller plants
MVRGSLGKLASRALSVAGKWQHQQLRRLNIHEYQGAELMGKYGINVPRGAAAGSVEEVKNTLKNVFPSEKEIVVKSQILAGGRGLGTFKSGLQGGVHIVKAEEAESLAAKMLGQILVTKQTGPQGKIVSKVYLCEKLSLVNEMYFAITLDRNTAGPLIIACSKGGTSIEDLAEKYPDMIIKVPIDVFKGITDDDAAKVVDGLAPKTADRQSSIEQIKKLYELFCKSDCTLLEINPLAETADNKLVAADAKLNFDDNAAFRQKEIFAMRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 5750 - protein, 384 aa, Zea mays
  misc_feature (1)..(384): useful for making plants with modified plant phenotypes as described in USSN 12/139,269
  misc_feature (1)..(384): Ceres CLONE ID no. 306053
  misc_feature (1)..(384): Utility: Useful for delaying flowering time
  misc_feature (1)..(384): Utility: Useful for increasing chlorophyll and photosynthetic capacity
  misc_feature (1)..(384): Utility: Useful for making plants with increased biomass and foliage
  misc_feature (1)..(384): Utility: Useful for making smaller plants
MGKYGINVPRGAAAGSVQEVNDALKNMFPSEKEIVVKSQILAGGRGLGTFKSGLQGGVHIVKAEEAESIARKMLGQILVTKQTGPEGKIVSKVYLCEKLSLTNEMYFAITLDRKTAGPLIIACSKGGTSIEDLAEKYPDMIIKVPVDVFKGITDEDAAKVVDGLALKSADRQSSIEQIKKLYELFCKSDCTLLEINPLAETADNKLVAADAKLNFDDNAAFRQKEIFALRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 5751 - DNA, 1151 bp, Arabidopsis thaliana
  misc_feature (1)..(1151): useful for making plants with modified plant phenotypes as described in USSN 12/139,269
  misc_feature (1)..(1151): Ceres CLONE ID no. 37288
  misc_feature (1)..(1151): Also known as  Ceres CDNA ID no. 23380533
agcccctttcccaatatttgatcaatttctaaagaaaaccccttcctctactagtcctcctcctatatatacaaaatcttaagaaatctctctacttgtttcctctgttatcataatctcttctctctatatctcttctcttcttcttttaccctgtttttttttttcattccacagagcccaggttgattgattttgttattcagagatatggggagaggaaggattgagattaagaagattgagaatatcaacagtcgtcaagtcactttctctaagagacgaaacggtttgatcaagaaggctaaagagctttcgattctctgtgacgccgaggttgctcttatcatcttctccagcaccggcaagatttacgatttctccagcgtctgtatggagcaaattctttctagatatggatacactactgcgtccactgagcataaacaacaaagagaacaccaacttctaatttgtgcttcacatggaaatgaagctgtgttgcgaaatgatgattctatgaaggtggaacttgaaagattacagcttgcaattgagagacttaagggtaaggagcttgaaggtatgagtttcccggatcttatttcttttgaaaaccagttgaacgagagcttgcatagtgtcaaggatcaaaagacacaaatcctgctcaaccagattgagagatccaggatacaggagaaaaaagcattggaagaaaaccaaatcttgcgcaaacaggttgagatgttggggagaggttcaggaccaaaagtgttgaatgaaaggcctcaagattctagcccagaagccgatcccgagagctcttcatcagaagaggatgagaatgacaacgaggagcaccattccgacacttccttgcagttggggttgtcgtcgacggggtattgcacaaagagaaagaagccgaagatcgaactggtctgcgataactctgggagtcaagtggcttctgattgatggaatcgattatttttctaattctggttgtttaggggtctctatgtgtcttcttgtttctggctgttcttttgctttatttcatctcaagtagagttttcttaatgtttaggtggaacatttttccataatcaagaagggatttgatcaatcaataacattagattttc

SEQ ID NO: 5752 - protein, 256 aa, Arabidopsis thaliana
  misc_feature (1)..(256): useful for making plants with modified plant phenotypes as described in USSN 12/139,269
  misc_feature (9)..(59): Pfam Name: SRF-TF; Pfam Description: SRF-type transcription factor (DNA-binding and dimerisation domain)
  misc_feature (102)..(180): Pfam Name: K-box; Pfam Description: K-box region
  misc_feature (9)..(59): Pfam Name: SRF-TF; Pfam Description: SRF-type transcription factor (DNA-binding and dimerisation domain)
  misc_feature (102)..(180): Pfam Name: K-box; Pfam Description: K-box region
  misc_feature (1)..(256): Utility: Useful for delaying flowering time
  misc_feature (1)..(256): Utility: Useful for increasing chlorophyll and photosynthetic capacity
  misc_feature (1)..(256): Utility: Useful for making larger plants
  misc_feature (1)..(256): Utility: Useful for making ornamental plants with modified flowers
  misc_feature (1)..(256): Utility: Useful for making ornamental plants with modified leaves
  misc_feature (1)..(256): Utility: Useful for making plants sterile and for genetic confinement
  misc_feature (1)..(256): Utility: Useful for making plants with increased biomass and foliage
  misc_feature (1)..(256): Utility: Useful for making plants with increased size and biomass
  misc_feature (1)..(256): Utility: Useful for making smaller plants
  misc_feature (1)..(256): Utility: Useful for making stronger plants
MGRGRIEIKKIENINSRQVTFSKRRNGLIKKAKELSILCDAEVALIIFSSTGKIYDFSSVCMEQILSRYGYTTASTEHKQQREHQLLICASHGNEAVLRNDDSMKVELERLQLAIERLKGKELEGMSFPDLISFENQLNESLHSVKDQKTQILLNQIERSRIQEKKALEENQILRKQVEMLGRGSGPKVLNERPQDSSPEADPESSSSEEDENDNEEHHSDTSLQLGLSSTGYCTKRKKPKIELVCDNSGSQVASD

SEQ ID NO: 5753 - protein, 254 aa, Arabidopsis thaliana; identical to SEQ ID NO: 2897
  misc_feature (1)..(254): useful for making plants with modified plant phenotypes as described in USSN 12/139,269
  misc_feature (1)..(254): Public GI no. 52789958
  misc_feature (1)..(254): Utility: Useful for delaying flowering time
  misc_feature (1)..(254): Utility: Useful for increasing chlorophyll and photosynthetic capacity
  misc_feature (1)..(254): Utility: Useful for making larger plants
  misc_feature (1)..(254): Utility: Useful for making ornamental plants with modified flowers
  misc_feature (1)..(254): Utility: Useful for making ornamental plants with modified leaves
  misc_feature (1)..(254): Utility: Useful for making plants sterile and for genetic confinement
  misc_feature (1)..(254): Utility: Useful for making plants with increased biomass and foliage
  misc_feature (1)..(254): Utility: Useful for making plants with increased size and biomass
  misc_feature (1)..(254): Utility: Useful for making smaller plants
  misc_feature (1)..(254): Utility: Useful for making stronger plants

SEQ ID NO: 5754 - protein, 247 aa, Glycine max; identical to SEQ ID NO: 2898
  misc_feature (1)..(247): useful for making plants with modified plant phenotypes as described in USSN 12/139,269
  misc_feature (1)..(247): Ceres CLONE ID no. 523628
  misc_feature (1)..(247): Utility: Useful for delaying flowering time
  misc_feature (1)..(247): Utility: Useful for increasing chlorophyll and photosynthetic capacity
  misc_feature (1)..(247): Utility: Useful for making larger plants
  misc_feature (1)..(247): Utility: Useful for making ornamental plants with modified flowers
  misc_feature (1)..(247): Utility: Useful for making ornamental plants with modified leaves
  misc_feature (1)..(247): Utility: Useful for making plants sterile and for genetic confinement
  misc_feature (1)..(247): Utility: Useful for making plants with increased biomass and foliage
  misc_feature (1)..(247): Utility: Useful for making plants with increased size and biomass
  misc_feature (1)..(247): Utility: Useful for making smaller plants
  misc_feature (1)..(247): Utility: Useful for making stronger plants

SEQ ID NO: 5755 - protein, 235 aa, Glycine max
  misc_feature (1)..(235): useful for making plants with modified plant phenotypes as described in USSN 12/139,269
  misc_feature (1)..(235): Public GI no. 38326712
  misc_feature (1)..(235): Utility: Useful for delaying flowering time
  misc_feature (1)..(235): Utility: Useful for increasing chlorophyll and photosynthetic capacity
  misc_feature (1)..(235): Utility: Useful for making larger plants
  misc_feature (1)..(235): Utility: Useful for making ornamental plants with modified flowers
  misc_feature (1)..(235): Utility: Useful for making ornamental plants with modified leaves
  misc_feature (1)..(235): Utility: Useful for making plants sterile and for genetic confinement
  misc_feature (1)..(235): Utility: Useful for making plants with increased biomass and foliage
  misc_feature (1)..(235): Utility: Useful for making plants with increased size and biomass
  misc_feature (1)..(235): Utility: Useful for making smaller plants
  misc_feature (1)..(235): Utility: Useful for making stronger plants
MGRGKIEIKRIDNASSRQVTFSKRRTGLFKKAQELSILCDAEVAVIVFSNTGKLFEFSSSGMKRTLSRYNKCLGSTDAAVAEIKTQKEDSKMVEILREEIAKLETKQLQLVGKDLTGLGLKELQNLEQQLNEGLLSVKARKLEQSRVQEQRVMLENETLRRQIEELRCLFPQSESMVPFQYQHTEGKNTFVDTGARYLNLANNCGNEKGSSDTSFHLGLPAGVQEEGPQERNLFK

SEQ ID NO: 5756 - protein, 269 aa, Glycine max; identical to SEQ ID NO: 2899
  misc_feature (1)..(269): useful for making plants with modified plant phenotypes as described in USSN 12/139,269
  misc_feature (1)..(269): Public GI no. 34452081
  misc_feature (1)..(269): Utility: Useful for delaying flowering time
  misc_feature (1)..(269): Utility: Useful for increasing chlorophyll and photosynthetic capacity
  misc_feature (1)..(269): Utility: Useful for making larger plants
  misc_feature (1)..(269): Utility: Useful for making ornamental plants with modified flowers
  misc_feature (1)..(269): Utility: Useful for making ornamental plants with modified leaves
  misc_feature (1)..(269): Utility: Useful for making plants sterile and for genetic confinement
  misc_feature (1)..(269): Utility: Useful for making plants with increased biomass and foliage
  misc_feature (1)..(269): Utility: Useful for making plants with increased size and biomass
  misc_feature (1)..(269): Utility: Useful for making smaller plants
  misc_feature (1)..(269): Utility: Useful for making stronger plants

SEQ ID NO: 5757 - DNA, 1155 bp, Arabidopsis thaliana
  misc_feature (1)..(1155): useful for making plants with modified plant phenotypes as described in USSN 12/139,269
  misc_feature (1)..(1155): Ceres CLONE ID no. 37298
  misc_feature (1)..(1155): Also known as  Ceres CDNA ID no. 23372860
ctctctcgtcgtctcaaatctcttcttccttcttcttctctctcgattcaagctaatccacacgcaaaaatgggaagccaacaagcggctgtttcgttcctttccaatttggcgaaggctgctttcggtcttggaacggcggcgacggtgctgaatacatcgcttttcaccgttgacggcggagaaagagctgttatcttcgatcgattcaggggagtgatggatcagactgtgggtgaagggactcatttcttgatcccgattcttcagaggcctcacatcttcgatatccgcacgaagcctcacacgttctcttcaatctctggtactaaggatctccagatggttaatctcactcttcgtgttctctctcgtcctgaggtgtcgcgtctcccgtacatcttccaaactttgggtctagagtatgacgagaaggttcttccttcgattggaaatgaggttttgaaagctgtggttgcacagttcaacgctgaccagcttctcactgagcgtcctcacgtctcagcacttgttcgggagtcactaatcacccgtgcgaaggacttcaacattgtgcttgatgatgtagctatcacgcatttgtcctatggtgtggagttttcaagggctgttgagcagaaacaagtggctcagcaagaggcagagaggtctaagtttgttgtgatgaaggctgatcaagagaggagagctgcggttataagagctgaaggtgagagtgaagctgctcagttgatttctgatgctacggctaaagctggtatgggacttatcgagcttaggaggattgaagcttcaagggagattgcgtctacacttgctaggtctcctaatgtggcctacttacccggtggccagagcatgctctttgccctgaaccgttgatcttgatcagatatgatggttgtttgggagcattttgcgatattttaatgatcaagttgtgaatctgattgaatcaaaaaggtgaaatgctcttttgttttgatgaactctgaagaagaaaaagaaactagttgtttgagttgtcattattgtgttctgaatctcggcaaaatttactctacctgaagaatctttgttttcagcatcatgtttatctaattctcaacaaataaatgattttggctgaactgc

SEQ ID NO: 5758 - protein, 277 aa, Arabidopsis thaliana
  misc_feature (1)..(277): useful for making plants with modified plant phenotypes as described in USSN 12/139,269
  misc_feature (32)..(223): Pfam Name: Band_7; Pfam Description: SPFH domain / Band 7 family
  misc_feature (32)..(223): Pfam Name: Band_7; Pfam Description: SPFH domain / Band 7 family
  misc_feature (1)..(277): Utility: Useful for delaying flowering time
  misc_feature (1)..(277): Utility: Useful for increasing chlorophyll and photosynthetic capacity
  misc_feature (1)..(277): Utility: Useful for making larger plants
  misc_feature (1)..(277): Utility: Useful for making ornamental plants with modified flowers
  misc_feature (1)..(277): Utility: Useful for making ornamental plants with modified leaves
  misc_feature (1)..(277): Utility: Useful for making plants with increased biomass
  misc_feature (1)..(277): Utility: Useful for making smaller plants
  misc_feature (1)..(277): Utility: Useful for modifying plant structure, ie increased branching
MGSQQAAVSFLSNLAKAAFGLGTAATVLNTSLFTVDGGERAVIFDRFRGVMDQTVGEGTHFLIPILQRPHIFDIRTKPHTFSSISGTKDLQMVNLTLRVLSRPEVSRLPYIFQTLGLEYDEKVLPSIGNEVLKAVVAQFNADQLLTERPHVSALVRESLITRAKDFNIVLDDVAITHLSYGVEFSRAVEQKQVAQQEAERSKFVVMKADQERRAAVIRAEGESEAAQLISDATAKAGMGLIELRRIEASREIASTLARSPNVAYLPGGQSMLFALNR

SEQ ID NO: 5759 - protein, 279 aa, Arabidopsis thaliana
  misc_feature (1)..(279): useful for making plants with modified plant phenotypes as described in USSN 12/139,269
  misc_feature (1)..(279): Ceres CLONE ID no. 33731
  misc_feature (1)..(279): Utility: Useful for delaying flowering time
  misc_feature (1)..(279): Utility: Useful for increasing chlorophyll and photosynthetic capacity
  misc_feature (1)..(279): Utility: Useful for making larger plants
  misc_feature (1)..(279): Utility: Useful for making ornamental plants with modified flowers
  misc_feature (1)..(279): Utility: Useful for making ornamental plants with modified leaves
  misc_feature (1)..(279): Utility: Useful for making plants with increased biomass
  misc_feature (1)..(279): Utility: Useful for making smaller plants
  misc_feature (1)..(279): Utility: Useful for modifying plant structure, ie increased branching
MGSQQAAISFLTNLAKAAFGLGVAATALNSSLYTVDGGERAVLFDRFRGVLDQTVGEGTHFLIPYLQTPHIYDIRTKPHTFSSKSGTKDLQMVNLTLRVLFRPEVSRLPYIFQTLGLEYDEKVLPSIGNEVLKAVVANFNADQLLTERPQVSALVREALIKRAREFNIELDDIAITHLSYGAEFSRAVEAKQVAQQEAERSKFVVMKADQERRAAVIRAEGESEAAQLISDATAKAGMGLIELRRIEASREVAATLARSPNVAYLPGGQSMLFNLNPGR

SEQ ID NO: 5760 - protein, 279 aa, Arabidopsis thaliana; identical to SEQ ID NO: 5759
  misc_feature (1)..(279): useful for making plants with modified plant phenotypes as described in USSN 12/139,269
  misc_feature (1)..(279): Public GI no. 21592895
  misc_feature (1)..(279): Utility: Useful for delaying flowering time
  misc_feature (1)..(279): Utility: Useful for increasing chlorophyll and photosynthetic capacity
  misc_feature (1)..(279): Utility: Useful for making larger plants
  misc_feature (1)..(279): Utility: Useful for making ornamental plants with modified flowers
  misc_feature (1)..(279): Utility: Useful for making ornamental plants with modified leaves
  misc_feature (1)..(279): Utility: Useful for making plants with increased biomass
  misc_feature (1)..(279): Utility: Useful for making smaller plants
  misc_feature (1)..(279): Utility: Useful for modifying plant structure, ie increased branching

SEQ ID NO: 5761 - protein, 279 aa, Arabidopsis thaliana
  misc_feature (1)..(279): useful for making plants with modified plant phenotypes as described in USSN 12/139,269
  misc_feature (1)..(279): Public GI no. 9294221
  misc_feature (1)..(279): Utility: Useful for delaying flowering time
  misc_feature (1)..(279): Utility: Useful for increasing chlorophyll and photosynthetic capacity
  misc_feature (1)..(279): Utility: Useful for making larger plants
  misc_feature (1)..(279): Utility: Useful for making ornamental plants with modified flowers
  misc_feature (1)..(279): Utility: Useful for making ornamental plants with modified leaves
  misc_feature (1)..(279): Utility: Useful for making plants with increased biomass
  misc_feature (1)..(279): Utility: Useful for making smaller plants
  misc_feature (1)..(279): Utility: Useful for modifying plant structure, ie increased branching
MGSQQVAISFLTNLAKAAFGLGVAATALNSSLYTVDGGERAVLFDRFRGVLDQTVGEGTHFLIPYLQTPHIYDIRTKPHTFSSKSGTKDLQMVNLTLRVLFRPEVSRLPYIFQTLGLEYDEKVLPSIGNEVLKAVVANFNADQLLTERPQVSALVRDALIKRAREFNIELDDIAITHLSYGAEFSRAVEAKQVAQQEAERSKFVVMKADQERRAAVIRAEGESEAAQLISDATAKAGMGLIELRRIEASREVAATLARSPNVAYLPGGQSMLFNLNPGR

SEQ ID NO: 5762 - protein, 279 aa, Arabidopsis thaliana
  misc_feature (1)..(279): useful for making plants with modified plant phenotypes as described in USSN 12/139,269
  misc_feature (1)..(279): Public GI no. 27765032
  misc_feature (1)..(279): Utility: Useful for delaying flowering time
  misc_feature (1)..(279): Utility: Useful for increasing chlorophyll and photosynthetic capacity
  misc_feature (1)..(279): Utility: Useful for making larger plants
  misc_feature (1)..(279): Utility: Useful for making ornamental plants with modified flowers
  misc_feature (1)..(279): Utility: Useful for making ornamental plants with modified leaves
  misc_feature (1)..(279): Utility: Useful for making plants with increased biomass
  misc_feature (1)..(279): Utility: Useful for making smaller plants
  misc_feature (1)..(279): Utility: Useful for modifying plant structure, ie increased branching
MGSQQVAISFLTNLAKAAFGLGVAATALNSSLYTVDGGERAVLFDRFRGVLDQTVGEGTHFLIPYLQTPHIYDIRTKPHTFSSKSGTKDLQMVNLTLRVLFRPEVSRLPYIFQTLGLEYDEKVLPSIGNEVLEAVVANFNADQLLTERPQVSALVRDALIKRAREFNIELDDIAITHLSYGAEFSRAVEAKQVAQQEAERSKFVVMKADQERRAAVIRAEGESEAAQLISDATAKAGMGLIELRRIEASREVAATLARSPNVAYLPGGQSMLFNLNPGR

SEQ ID NO: 5763 - protein, 279 aa, Arabidopsis thaliana
  misc_feature (1)..(279): useful for making plants with modified plant phenotypes as described in USSN 12/139,269
  misc_feature (1)..(279): Public GI no. 58979188
  misc_feature (1)..(279): Utility: Useful for delaying flowering time
  misc_feature (1)..(279): Utility: Useful for increasing chlorophyll and photosynthetic capacity
  misc_feature (1)..(279): Utility: Useful for making larger plants
  misc_feature (1)..(279): Utility: Useful for making ornamental plants with modified flowers
  misc_feature (1)..(279): Utility: Useful for making ornamental plants with modified leaves
  misc_feature (1)..(279): Utility: Useful for making plants with increased biomass
  misc_feature (1)..(279): Utility: Useful for making smaller plants
  misc_feature (1)..(279): Utility: Useful for modifying plant structure, ie increased branching
MGSNQAAVSFLTNLARAAFGLGISATVVNSSLYTVDGGQRAVLFDRFRGVIDDTVGEGTHFLIPWLQKPFIFDIRTRPHTFSSTSGTKDLQMVNLTLRVLSRPEVARLPDIFKTLGLEYDEKVLPSIGNEVLKAVVAQFNADQLLTERPQVSALVRESLIRRAKDFNIVLDDVAITHLSYGAEFSKAVEQKQVAQQEAERSKFVVMKAEQERRAAIIRAEGESESAKLISDATAAAGMGLIELRRIEASREVAATLAKTPNVAYLPKQGNMLLGLNASR

SEQ ID NO: 5764 - protein, 279 aa, Arabidopsis thaliana
  misc_feature (1)..(279): useful for making plants with modified plant phenotypes as described in USSN 12/139,269
  misc_feature (1)..(279): Public GI no. 1946329
  misc_feature (1)..(279): Utility: Useful for delaying flowering time
  misc_feature (1)..(279): Utility: Useful for increasing chlorophyll and photosynthetic capacity
  misc_feature (1)..(279): Utility: Useful for making larger plants
  misc_feature (1)..(279): Utility: Useful for making ornamental plants with modified flowers
  misc_feature (1)..(279): Utility: Useful for making ornamental plants with modified leaves
  misc_feature (1)..(279): Utility: Useful for making plants with increased biomass
  misc_feature (1)..(279): Utility: Useful for making smaller plants
  misc_feature (1)..(279): Utility: Useful for modifying plant structure, ie increased branching
MGSSQAAVSFLTNVARAAFGLGISATVLNSSLYTVDGGQRAVLFDRFRGVIDDTVGEGTHFLVPWLQKPFIFDIRTRPHTFSSVSGTKDLQMVHLTLRVLSRPEVARLPAIFKTLGLEYDEKVLPSIGNEVLKAVVAQFNADQLLTERPQVSALVRESLIRRAKDFNIVLDDVAITHLSYGAEFSKAVEQKQVAQQEAERSKFVVMKAEQERRAAIIRAEGESESAKLISDATAAAGMGLIELRRIEASREVAATMAKTPNVAYLPKQGNMLLGLNASR

SEQ ID NO: 5765 - protein, 279 aa, Glycine max
  misc_feature (1)..(279): useful for making plants with modified plant phenotypes as described in USSN 12/139,269
  misc_feature (1)..(279): Ceres CLONE ID no. 523811
  misc_feature (1)..(279): Utility: Useful for delaying flowering time
  misc_feature (1)..(279): Utility: Useful for increasing chlorophyll and photosynthetic capacity
  misc_feature (1)..(279): Utility: Useful for making larger plants
  misc_feature (1)..(279): Utility: Useful for making ornamental plants with modified flowers
  misc_feature (1)..(279): Utility: Useful for making ornamental plants with modified leaves
  misc_feature (1)..(279): Utility: Useful for making plants with increased biomass
  misc_feature (1)..(279): Utility: Useful for making smaller plants
  misc_feature (1)..(279): Utility: Useful for modifying plant structure, ie increased branching
MGSNQAAISFLTNVARAAFGLGAAATALSSSLYTVDGGQRAVLFDRFRGILDSTVGEGTHFLVPWVQKPYIFDIRTRPHTFSSVSGTKDLQMVNLTLRVLSRPDTEKLPTIVQNLGLEYDEKVLPSIGNEVLKAVVAQFNADQLLTDRSQVSALVRESLIRRARDFNIVLDDVAITHLSYGGEFSRAVEQKQVAQQEAERSKFVVMKAEQERRAAIIRAEGESDAAKLISDATASAGMGLIELRRIEASREVAATLAKSPNVSYLPGGQNLLMALGPSR

SEQ ID NO: 5766 - protein, 284 aa, Zea mays
  misc_feature (1)..(284): useful for making plants with modified plant phenotypes as described in USSN 12/139,269
  misc_feature (1)..(284): Ceres CLONE ID no. 296971
  misc_feature (1)..(284): Utility: Useful for delaying flowering time
  misc_feature (1)..(284): Utility: Useful for increasing chlorophyll and photosynthetic capacity
  misc_feature (1)..(284): Utility: Useful for making larger plants
  misc_feature (1)..(284): Utility: Useful for making ornamental plants with modified flowers
  misc_feature (1)..(284): Utility: Useful for making ornamental plants with modified leaves
  misc_feature (1)..(284): Utility: Useful for making plants with increased biomass
  misc_feature (1)..(284): Utility: Useful for making smaller plants
  misc_feature (1)..(284): Utility: Useful for modifying plant structure, ie increased branching
MAGGPAAVSFLTNIAKVAAGLGAAASLASASLYTVDGGERAVIFDRFRGVLPETVGEGTHFLVPWLQKPFIFDIRTRPHNFSSNSGTKDLQMVNLTLRLLSRPDVQHLPTIFTSLGLEYDDKVLPSIGNEVLKAVVAQFNADQLLTDRPHVSALVRDALIRRAREFNIILDDVAITHLSYGIEFSLAVEKKQVAQQEAERSKFLVAKAEQERRAAIVRAEGESESARLISEATAMAGTGLIELRRIEAAKEIAAELARSPNVAYIPSGENGKMLLGLNATGFVR

SEQ ID NO: 5767 - protein, 271 aa, Zea mays
  misc_feature (1)..(271): useful for making plants with modified plant phenotypes as described in USSN 12/139,269
  misc_feature (1)..(271): Ceres CLONE ID no. 238897
  misc_feature (1)..(271): Utility: Useful for delaying flowering time
  misc_feature (1)..(271): Utility: Useful for increasing chlorophyll and photosynthetic capacity
  misc_feature (1)..(271): Utility: Useful for making larger plants
  misc_feature (1)..(271): Utility: Useful for making ornamental plants with modified flowers
  misc_feature (1)..(271): Utility: Useful for making ornamental plants with modified leaves
  misc_feature (1)..(271): Utility: Useful for making plants with increased biomass
  misc_feature (1)..(271): Utility: Useful for making smaller plants
  misc_feature (1)..(271): Utility: Useful for modifying plant structure, ie increased branching
MTRMAKVAAGLGVAASAASTSFYTVDGGERAVIFDRVRGVLPRTMSEGTHLLVPILQKPFIFDIRTRPHSFSSTSGTKDLQMVSLTLRVLSRPDVEHLPDIFTSLGLEYDEKVLPSIGNEVLKAVVAQFNADQLLTERPHVSALVRESLTKRAREFNIVLDDVAITHLAYGQEFAQAVEKKQVAQQEAERSRFLVARAEQERRAAIVRAEGESESARLISEATTTAGNGLIELRRIEAAKEIASVLSRTPNVSYIPAGDNGQMLLGLNAAR

SEQ ID NO: 5768 - DNA, 1276 bp, Arabidopsis thaliana
  misc_feature (1)..(1276): useful for making plants with modified plant phenotypes as described in USSN 12/139,269
  misc_feature (1)..(1276): Ceres CLONE ID no. 37663
  misc_feature (1)..(1276): Also known as  Ceres CDNA ID no. 23384271
  misc_feature (279)..(279): w is a or t/u
aaagaagttcctcattcaaaaaagatttctcagccatcaaaattctctttctcttcatccaacaaaaaaaaagcatacctctttttcttccatatagataagttaattaagaaaacgaattatcaggttttgtttcggctgatctgaggaagttcatctatggatacggctcagtggccacaggagattgtagtgaagcccttggaagaaatagtaacaaacacatgcccaaagccacaaccgcaaccgcttcaaacgcagcagccaccgtcggtgggwtggagagaggaaggcaagaccagaaaaggatcaagctgtaaactgtccgagatgtaactcaaccaacacaaagttttgttactacaacaattatagtttgacgcagccaagatacttctgcaaaggttgtagaaggtattggaccgaaggcggttcgcttaggaacattcctgttggcggtggctcaagaaagaacaagagatctcactctttttcttctgatattagtaacaatcactcggattctacacaaccagctacaaagaagcatctctctgatcatcaccaccacctcatgagcatgtctcaacaaggtttgaccggtcaaaaccctaaattccttgagacgacccaacaagatctcaatttaggtttttcaccacatgggatgattaggaccaacttcactgacctcatccacaacattggcaacaacaccaacaagagcaacaacaataacaatccattgattgtttcttcatgttctaccatggctacttcttctctggatctcataagaaacaatagtaacaatgggaattcttcaaattcttccttcatgggatttccagttcataatgaagatccagcatcaggagggttttcaatgcaagatcattacaagccttgcaacacaaacaccacactgctagggttttcattagatcatcatcataataatggatttcatggagggtttcaaggaggagaagaaggtggagaaggtggtgatgatgtgaatggaaggcacttgtttccttttgaggatttgaaattgccagtttcttcttcatcagcaacaattaatgtcgacattaatgaacatcagaagcgaggaagcggtagtgatgcagctgctacgtctggtgggtattggactgggatgttgagtggaggatcatggtgctaattaatttctcggtttggttgatgaagatagtactattagtggttaattattgctatttatttaattaatcaatatgttcttaatttc

SEQ ID NO: 5769 - protein, 342 aa, Arabidopsis thaliana
  misc_feature (1)..(342): useful for making plants with modified plant phenotypes as described in USSN 12/139,269
  misc_feature (48)..(110): Pfam Name: zf-Dof; Pfam Description: Dof domain, zinc finger
  misc_feature (1)..(342): Utility: Useful for delaying flowering time
  misc_feature (1)..(342): Utility: Useful for increasing chlorophyll and photosynthetic capacity
  misc_feature (1)..(342): Utility: Useful for making ornamental plants with modified leaves
  misc_feature (1)..(342): Utility: Useful for making plants with altered leaf shape eg curled leaves
  misc_feature (1)..(342): Utility: Useful for making plants with increased biomass
  misc_feature (1)..(342): Utility: Useful for making smaller plants
MDTAQWPQEIVVKPLEEIVTNTCPKPQPQPLQTQQPPSVGGERKARPEKDQAVNCPRCNSTNTKFCYYNNYSLTQPRYFCKGCRRYWTEGGSLRNIPVGGGSRKNKRSHSFSSDISNNHSDSTQPATKKHLSDHHHHLMSMSQQGLTGQNPKFLETTQQDLNLGFSPHGMIRTNFTDLIHNIGNNTNKSNNNNNPLIVSSCSTMATSSLDLIRNNSNNGNSSNSSFMGFPVHNEDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 5770 - protein, 293 aa, Glycine max
  misc_feature (1)..(293): useful for making plants with modified plant phenotypes as described in USSN 12/139,269
  misc_feature (1)..(293): Ceres CLONE ID no. 476994
  misc_feature (1)..(293): Utility: Useful for delaying flowering time
  misc_feature (1)..(293): Utility: Useful for increasing chlorophyll and photosynthetic capacity
  misc_feature (1)..(293): Utility: Useful for making ornamental plants with modified leaves
  misc_feature (1)..(293): Utility: Useful for making plants with altered leaf shape eg curled leaves
  misc_feature (1)..(293): Utility: Useful for making plants with increased biomass
  misc_feature (1)..(293): Utility: Useful for making smaller plants
MVVKPIEDIVVTNTCPKAVESKPRPQKEQAINCPRCHSINTKFCYYNNYSLTQPRYFCKTCRRYWTEGGTLRNIPVGGGSRKNKRSSASCSTPNNSHNNNNSTNKKLLSDLVITPPTLSHTQNPNSNNTIHQGQDLNLAFPSSTPDFRKISELVQQNNNNNNSSNNSMSASASSSSTTTTTSTSHLSALELLTGITSSSSAGLTSFMPVPVPSDPNSIYTCGFPLQDFKPTLNFSLDGIGNGYTSLQNVQSGRLLFPSDDLRQVSSSTITTMDQKQQGDSTGYWTGMLGGGSW

SEQ ID NO: 5771 - DNA, 1417 bp, Arabidopsis thaliana
  misc_feature (1)..(1417): useful for making plants with modified plant phenotypes as described in USSN 12/139,269
  misc_feature (1)..(1417): Ceres CLONE ID no. 38101
  misc_feature (1)..(1417): Also known as  Ceres CDNA ID no. 23377274
attcgctccgtttctctctcaaaaactacacacacgtaccacaccaccaccctcctcgtttcctcagagatcccctctctaacttctaaggatatagaaaatggcagatggtgaagacattcagcctctcgtctgtgacaatggaaccggaatggttaaggctggatttgctggagatgatgcaccaagagctgtattccctagcatcgttggtcgtcctcgacacactggtgtcatggttggtatgggacaaaaagatgcttacgttggtgatgaggctcagtctaagagaggtattttgacattgaaatatcctattgagcatggtattgttagcaactgggatgatatggagaagatttggcatcacactttctacaatgagctccgtgttgcacctgaagaacaccctgttcttctcactgaggctcctctcaaccccaaggccaatcgtgagaaaatgactcagattatgtttgaaactttcaacactcctgccatgtatgtcgctatccaagctgttctttccctctacgctagtggtcgtactactggtattgtgttggactctggagatggtgtgagtcacactgttccaatttatgaaggatatgctcttccacatgctattctgcgtttggaccttgcaggccgtgaccttactgattacctcatgaagatcttaaccgagcgtggttactcattcactacctcagcagagcgtgaaatcgtaagggatgtgaaagagaaacttgcttacatagcacttgactacgagcaagagatggaaacagcaaacacaagctcatccgttgagaagagctatgagttgcctgatggacaggtgatcaccattggaggagagagattccgctgcccggaggttctgttccaaccgtctttggtgggaatggaagctgctggtattcacgagaccacttacaattccatcatgaagtgtgatgtggatatcaggaaggatctgtatggaaacattgtgctcagtggtggaaccaccatgttccctggaattgctgataggatgagcaaagagatcactgctttggctccaagcagcatgaagattaaggtggttgctccaccagagaggaagtacagtgtctggattggaggctccattctagcatcactcagtaccttccaacagatgtggatagcaaaggctgagtatgatgagtcagggccatcaatagtccacaggaagtgcttctaagattaagctcaaatcaaagtgatgaatgattgttctgtattggtaaagccttttgttcatcgactttgttgcaaaatattcttttgttttctatgtttcttcaccactacattacatttctttcttgttgttatcctcttttggtgtttctgctattaatcgaaaaagaaattttcttttctc

SEQ ID NO: 5772 - protein, 377 aa, Arabidopsis thaliana
  misc_feature (1)..(377): useful for making plants with modified plant phenotypes as described in USSN 12/139,269
  misc_feature (8)..(377): Pfam Name: Actin; Pfam Description: Actin
  misc_feature (8)..(377): Pfam Name: Actin; Pfam Description: Actin
  misc_feature (1)..(377): Utility: Useful for delaying flowering time
  misc_feature (1)..(377): Utility: Useful for increasing chlorophyll and photosynthetic capacity
  misc_feature (1)..(377): Utility: Useful for making plants with altered leaf shape eg curled leaves
  misc_feature (1)..(377): Utility: Useful for making plants with increased biomass
  misc_feature (1)..(377): Utility: Useful for making smaller plants
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDVKEKLAYIALDYEQEMETANTSSSVEKSYELPDGQVITIGGERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 5773 - protein, 360 aa, Zea mays
  misc_feature (1)..(360): useful for making plants with modified plant phenotypes as described in USSN 12/139,269
  misc_feature (1)..(360): Ceres CLONE ID no. 338602
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 5774 - protein, 360 aa, Zea mays
  misc_feature (1)..(360): useful for making plants with modified plant phenotypes as described in USSN 12/139,269
  misc_feature (1)..(360): Ceres CLONE ID no. 331439
  misc_feature (1)..(360): Utility: Useful for delaying flowering time
  misc_feature (1)..(360): Utility: Useful for increasing chlorophyll and photosynthetic capacity
  misc_feature (1)..(360): Utility: Useful for making plants with altered leaf shape eg curled leaves
  misc_feature (1)..(360): Utility: Useful for making plants with increased biomass
  misc_feature (1)..(360): Utility: Useful for making smaller plants
MVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF
